United States Patent 11,001,841 (CCCTC-BINDING FACTOR (CTCF) RNA INTERACTOME) - sequence listing, part 9

SEQ ID NO: 21083 - DNA, 1050 bp, Homo sapiens
atgtagagattgagaaacttattattttacttttcatttgttttctttgatacttttattcaaagggcttgttttacatggcgtttaatcagtaaattgccttgaagaaggagctaaccaacatctctgcagagaacaaaaatatttttcacaactttgccttagtagtaattataactggttttgttaataccaatcctaaagtattaacaatacccattctaattactattaaggcttagggcatatttacaaaattcctttctacatctatgcatgtttctgttcgaatgttaatttgtatattagtcatcaataagcaacatcactttgatatttaagtcttatccttttttaaaaaaacattgatataaatgttttttggttttggatgtttttctgtccaaaatggcaaccctactttaaattcgtttctcactgaagcttcaaccgatgcaagatgcttttgtgttcctttcctacttattactgctaacgaatgctctgactttattgcactactgtactttacagctagcagtgcaatagtattgtcaaagcatctgaaagcaggatgcacgccagaattttgattcttaccttacatctttcttcggtatcagtaaataatttaccacaacctttgttgctgagaactataatgttgttactaacagtatatcttttagaaagtcataatttgaaaaaaaaaaaccttttaactaattaaaaacaatattttactgcattatgaaacacgtctggagaatattttttatatctaagttgttatggtttgtctaaatgagtaatactttataatttgttgctttctgttacatatttggataggttctgtcaaactttaggttttatttgagttttatgatgaattggtagtgatggaaacaatttctgctgtatatttttcctgcagttacttgccccaagtcatttttttttctccagagacagagtctttctctgttgcccaggctggagtgcagtggcccagttacacctcactgcagccttgtactcccgggctta

SEQ ID NO: 21084 - DNA, 1034 bp, Homo sapiens
ttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcgggtaaggggttacatccgggaaactcgtcagggaaatggcgggagatgctgagggtgcggggcctttggaattccttgttccttgccctcacctttacaccccttacgaaactgcgccgggtgcagaccgcattctgtgtttgtaccaaaaaagatgtgaatggaacggtccctaagcgtcccaagaagggagaggtggttcacactccaagaaaggggaacggagggtggggtggggaataaactgacgggggcgaggagaaatccctgtagggccaacccgctcacgttctaaaaggcgggccgagaaagtctgagaaaggatgctagacttgtatgcacaacttcctaacggccaaggaacccgtttctgtttgatccggaggtggcaaaccgtgggtgagggaagaggtgtgagcgaaggggatcgtaaccacgagctccgctcccggagcgcgggcgggattgagacaggaaaggcatcctgctctggagttgtgcactttcattcatctgtgaaagtagaaaacgggggcgaagaattggaaagcactcccgttgttgctggcgtgtttggcctgctcggggggcgcccagctggggggctgtcctagttttctttaaggatccgtccctcacttgttctctttattccctccctcccatccttagattaccagcttgatcgcccgcgcttttttcctcttagtgtccttgttctgtcttcagcccttttcgttcagcattatcttttttttcttttcttttcttttttttttt

SEQ ID NO: 21085 - DNA, 1035 bp, Homo sapiens
cctcagcctctcaaagtactgggattacaggcgtgagacactgtgcccagcccctgtctttttttttatttttttaattaattaagagtttaaaaaaaaaagcccctggcttcacaacttcatgattattaaattatcactaatctagttcaccaaaagaccaatatattcttgattttccttctttttttttttttttttgagacagagtcttgctctgtcatccaggctagagtacagtggcgcgatctcagctcatagaaacctccgcctcccaggttcaagtgattcttttgcctcagcctcccgagtagctagcattacaggcatgcaccaccacagccggctaactttttgtatttttagtagagacagggtttcaccatgttggccaggctggtcttgaactcctgagctcaggcaatctgcccgcatcggcctcccaaagtgctgggattacaggtatgagccactgagcctagccttattcttgatttttctaagcaagacactcataactgaatatctgaaagctactgaatttttaaaactgcttttgtcccagacactgactggtgctagaaatataatttactaaagacaatccctttttctaatgatgaatagtgactgcaacagcttagcgagcaattttaataagtatggtaaatgttatgaggagaaagccctaagttctaggagtacagagcaaaagcacctaaccaggtctggagttaaggtggggcatgggtaggtagggatgcactccctttccctagaggaattgtctcttcatatacataacatttttcaaaaattaactgaatgaaggagaaacaaaatctatctacttcctttgcttattatctgggaaaaatactaatttggaagaaaatgagtaaaaggcaagaccagtaacagtatttttaaaatgtttagccatttttcagaaaattaacatagctcctggtaaaatattcttattaatattaaaataggctgtgcgccgtgactcacgcctgtaatcccagcact

SEQ ID NO: 21086 - DNA, 1033 bp, Homo sapiens
tgtggaaaacccagcgggcctttagcaaatatgagaagtctgcagtgttggtcagcaacagccagttcttagtaaaaccacttgatatgattgttgggaaggcatggaatatgtttgcttcaaagtaagtataaaataagtctacaaacctttctttttttttttttttttgagacagagtctcactctgttgcccaggctggagtgcagtggcacgatcttggctcactggctcactgcaacctccgcctcccgggtttaagtgattctcctgctgcagcctcccaagtagctgggattacaggcgcctaccaccacacccagctaatttttgtatttttagtagaggcagggtttcaccatgttgctcaggctggtctcgaacttctgacctcgggatctgcccacctcagcctcccaaagtgctggcattacaggcgtaagccaccatgcactgcagcctttctaacttataagcagatactgtagcgttaaagcatgaggtccgatctgcaggaagcatagttactactttgtaggtgtgaaggtatgaagccttgggcacgtgacttcaggcttcattgcctcatctgtataagtgggtcctaactgaggacatttctcacgaggattagataagataatcttgtaaaacagctagtacagtgcctggctagtaaatgctcagtaattgtttgacattattaaagtagaattttattatgaagcagggacaataagatagttttcaaaaataacatcagccgggcatggtggctcacacctgtaatcccagcactttgggaggctgaggcgagcagatcagctgaggtcaggatttcaagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcg

SEQ ID NO: 21087 - DNA, 1032 bp, Homo sapiens
tcgccactgcactccagcctgggaaatagagcgagatgccgtctcaaaaaaaaaaaaaaaaaaaaaaagccaggcatggtggctcatccctgtaatcccaacactttgggaggccgaggtgggtgaatcacctgaggtcaggagttcgagaccagcctggccaacgtggtgaaaccccatctgtactaaaaatacaaaaattagccgagcgtagtggtgcgtgcctgtaatcccagctacttgggaggctgaggcaggagaatcgcttgaacccgggagtcggagagtgtgccattgtactccagcctaggtgacaagagcgaaactccgtctcaaaaaagaaaaaaaaaagacaaaaaacaactctctccttgaacctccttctcctagtcaccccacttttcttctccagttgttgcatctcccctgtcctcacttgcatagttctctctgggcaacttcactgtcatagtttgctacatttattacacctgtgactttcagacctctagcccagcctctcttaaaagctctagacagattagtggatatctccacccacatctctcatatgaacctgaaactcaacatctctattcccaaggcattcattattgttccttgtgctcttgctgcatacataccatcaaacaagatctgcttatttgacctcctatatactccttgaaactgttcttccctttccaccttcactgacttgctttagtctggcttttgttctttcttacctggactgtctcaagacactccttttaggattccttgcctggagtctactgtctatcacatccatcctccgtactgctgtgtttaaaaagacatcggccgggtgcagtggctcatgcctataatcccagcactttgggaggtcgaggcgggcgaatcatgaggtcaggagatcgagaccatcctggctaacacagtaaaatcccgtctctactaaaaatacaaaaaaattagccaggcgtggtggcgggtgcctgtagtcccagctacttgggatgctgaggc

SEQ ID NO: 21088 - DNA, 1051 bp, Homo sapiens
gaagaaaccagcagtgaaatatgagaaatagaaaagtgttgtgttaaaagtctagaaagaaaattattcagggagggaagatggaaaaagagagtgaccttgaaatttagccatacagagggagttgatgatcttgacaagcaattcattgaaaggaagagatggaatcctgattggaattggttaagaaaaacacagcagatgtctggtattgatgagtttttttcatttacaggctagaaaggtgtcaactatgacaaaccgtgaagactttttccttattctatgaagggaagatctaaaatccaaacaggtttaaaaagtctctttaagcaaaatgatcctccattccattattgtgaactctgacatcctgccaaactcatattttttacatatcaaaataaaatatttgtagcaaattaaaaccctttattaatactttatctttgtatgttgctctgataaattttgatgtttttcttttggtagcttaatttttttaaatcctactttggaccatttgagcttctgggaagtattttggattgttggaattacagacttcattctgaaattctttttcatgggcttaaaatgccttattttattggtgccttctttcatcatgccttttaaatctaaggtaagaaactcacttatgctttattggagtgatgttatcgaatcacattaatgctatttagtctttgtttaaatgaatcctccttttgcagtttttcagtttgctaactagcttaattatctgtattatttcagcttagcaaccatttgttcaggcacttgaacctgattattaacctatttggataaaatcagaattatatttgcttcagaataattttaaaatcagtccccacatcatatgtgggaaactatttagatgtgtacttctgttctccagggcattatcaattgacagttgactatgtacaattattcagtggtttcccatatgcactaaaaacttttaaattcttataatcagcaaaaacatactcacataggttttacttgcagtatacataaa

SEQ ID NO: 21089 - DNA, 1032 bp, Homo sapiens
gctggccccggccccggccccacccctccgggaacccagctggtggcctctgcctgcctttccctgatcttcccactctcgcgcctgatgatttagtttcaggatggcgtgccccctccaaccttggcacattcttagttctccatttggaagaccctgcagtgcttggcacgctcgagtcattcaaaacccaacttgacgactcctgctctgataatgcctcgggtttcctctctgataccaactttccatccgcccgcaccctccttcactccctctctgtgcacccagaacacttggttgacaaaatgcattactactgtttattgcgtacatggtacacggaccacgtgggaatcttagaacttgcgtagtattagggcttgtttgctaatgaaaatactgaagctcgtaaaaatacagtatacaaaactctgccacaaagcccctatgttttctgttcctacacactagctcctcccctctgccgtctttctgagtaatcttacacacatcaggccttaaattaatgaattctctgaactgttgacaccatggccttctggccctacgtaggaaagagggaagtggtgcaagttgcctgcttgcacaggcatctcaaactagacagttcctaaagatgaaattcattagctccaaacacgcattcccgtccccagtccatcccaccttccaacacacatgcatcatccaccaagtcacaccagacacaaacactggttcttccctccttcatcccagatcctgaccaactcaggtatttcagaatgtgtctcatatatatttctcagttcatcccctcctgtctattcccatagcgagtgccttagacctcaggcaaggcgacttatgcctggactgttcgctgatcccctctgactgatctcctgcctcctgtctagctcctctccaagccagtcattcctccaatgccagaatgatcttttctttaggaggaaaaaaaattgttcataaactttaaaatctgctttggaaaagtcttcaatacgt

SEQ ID NO: 21090 - DNA, 1027 bp, Homo sapiens
agaaaaataataataataataaagtaggcattggaaccatgactttattatatcctcccccctaccccatctcccaccccacctctgcaactctataaacttttttttttttttttttttttttttaaacagagtctcactctgtcacccaggctgcagtgcagtggtgcaacctcggctcactgcaacctccacctcccaggttcaagcaattctcccacctcagcctcccaagtagctgggattataggtgcctgccaccatgcctggctaatttttgtagttttagtagagacagggtttcaccatgttggtcagactggtctcgacctcctgacctcaggtgatccacccacctcggcctcccaaagtgctgggattacaggcatgagccaccatgcccggcccctgtaaacttttatatgcatttatttaatctgccattttacagacaaggagctaggtgttacaccagataaattgtcctacctcagagcattcaataactgaatttggaatttcttgagtgctgtagtatctcaaacaggcaattcccatgtcatttatttgccataaagttcacatcttcctgtgattaacaggtggttatcaagtactttgtaaaaataaagacttgaaaaatgaaaagcatgattccctgaaactgtactaattattaataagtatccctacatttatcagagtctgaagttagaagcccatgacaaattgtgaggcccaagaggaaagcagaaaagtaggaagggagaatattttttattaagaaaatttagattccttcataattatttcttcctctgtggatcttttccccctttttagattttgcagaggctgtaaaattgattgtggggaagacagagctttcattggaaatgcctatatcgctgtggattgggatcccacagcccttcaccttcgctatcaaacatcccaggaaagggtaagtatttagggccaccataaaatggtggtttttatatgagaaatttccaccagtgtaact

SEQ ID NO: 21091 - DNA, 1045 bp, Homo sapiens
actctttcaaaatggttttgctgtctgtcttgctccatctttatgggcaggaagcaaatgacctgaaaactaaataaatctaaatcttcttctaaaacacaagttccagagcaggtagcagatttaataacaagtcaatttctaagctcttaacatctggagcacattataaaaacaaatgcatgagactataatcctcactagggcaatagttattaattctggctgcatatgtagtgagatcacatagagaactttaaaaatgaaaaaatgcctttggccgggtgactcatgcctgtaatcctagtactttgggaggccaaggcaggaggattgtttggatcctccaggagtttgagaccagtctgggtaacatattgagaccccatctctatgaaaactttaaaaattagttgggcatggtgatgcatgcctgtggtcctagctgaggtggaaggatcacttgagctcaggagttcaagggtatagtgagctataggcgactgagcaagaccctgtattaaaaaaagagcctttgctatactccagactaaaaaaatcaaaaagcataagtgaaaaaaaaaagttgaattgatttaaataataaggcatttatgtttatggaaaattttcttttgaaacctaatttaaccaggtgaggtggctcacacctgtaatcccaccactttgggtgactgaggcaggaggattacctgaggctagagtttgagaccagcctgggcaatacagtaagactccatttctaccaaaaaaaaaaacaaaaacaaaaaaaacaaagagtctcgctctgttgctctggctggagtgcagtggcatgatctcaactcacttcaacctccaccccctgggttgaggccatcctcccacctcagcctctcaagttactggggactaaaggtgcacaccaccatgccccactatttttttttaatatttttttgtaaagacgggatctatccacgttgctcgggctggtctccaactctcctgagctcaagtgatccagccaccttggctcccaaag

SEQ ID NO: 21092 - DNA, 1032 bp, Homo sapiens
gtgcagtggcaggcatctgtaatcccagctacttgagaagctgaggcaggagaattgcttgaacctgggaggtggaggttgcagtgagccaagattgcgccattgcactccagcctgggagacagcaagactctgtctcaaaagaaaaaaaggcctggcacggtggctcacacctgtaatcccagcactttgggaggccaaggcaggcggatcacaaggtcaggagttcaagatcagcctggccaatatggtgaaaccctgtctctactagaaatacaaaagttagccgggcgtggtggtggacacctatagtcccagctactcgggaggctgaggcaggagaatcgcttcaacccaggaggcggaggttgcagtaagctgagaactgcactccagcctgggtgacagagcgagacgccatctcaaaaaaaagaaaaaaaaaagagttaaaattgtttttgccaaaaaaagattgaatgtacattagttatactggaaaggtaacatggaagtggactgtctttatatcagcttaagattcttgatataaataggatttcttttttgagacgaagtctcgcactgttgcttgggctggagtgcaggggcacgatcttggatcactgcaacctccgcctcccgggttcaagcaattctgcctcagcctcccaagtagctgagattacaggcgcccgccactacgcccagctaattttttgtatttttagtagcgacgggatttcaccatgttgaccaggctggtctcgagctcctgacctcgcgattcgcccacctcggcctcccaaagtactgggattgcaggcgtgagccaccatgcccagctgtaaataggatattttaagcaaacaaacaactctgctggcctggcaccgtgcatcatgcctgtaatcgtaccactttgggaggccaaggccggtggatcacttgaggttaggagtttgagaccagcctggccaacatggtgaaatcccgtctctactaaaaatacaaaaattggccgggcacagtggc

SEQ ID NO: 21093 - DNA, 1077 bp, Homo sapiens
gctatcacttcctccccctccctttcctcgcctctagtaaccactattctactctctacttctatgagatcaacttttttagcatctacgtaagactgagaactgtttacctttcatgaagtgtttattttttaacaataaaataacttggcaggatagtaatctatataaatataactcagaacatcttgtggaaataactagttttattttcataaaacttagtaagtctctttggggggaatattttatactctgtgcatgaattttcctttggtgattctctaagggaatctaaaagaaagaaacatcttacagagtgtctcatactgagatccacaaattccatgtgctgctgctataagtattaagtcccagtagaatgagaaaataaaccatggccgggcacagtggctcatgcctttaatcccagcactttgggaggccaaggtgggtggatcacccaaggttaggagttcaagaccagcctggccaacagtccctaccaaaaatacaaaaattagccgagcatggttgtcggtgcctgtaatcccagctacttgcgaggctgaggcaggagaatcgcttgaacctaggaggcggaggttgcagtgagccgagattgcgccattccactcgagccggggcgacgagagcgaaactctgtctcaaaaggaaaaaaaaaaaagaaaacaaaccatggtgtcaaataaggacccgaaatcaggttactagggcagagggtgtgatgaaatgcaatctttgatttatgatgaatctatgtatcagtaggaaatgcatcacctgttttgcaagtaaatcttacttatttacttattttatcaaagtgacatatgcacatagttaaaatagaataaaaaaagagttagtgaaaacaagagttcctatccttacctagctcaattttatcagggttccagaagcaaccagtttctagtagttgcttctggtacataccaccatttagttctaaatatttttactttttttttttttttttttttgagacagagtcttactctgtcacccaggctaaagtccaatgacttaatctca

SEQ ID NO: 21094 - DNA, 1050 bp, Homo sapiens
taatgggactagtgaactccttgtagaaaactttacatcaagaacattacatagattatggatgttctaagtggtatgccagatgttaaagaagtaattcatactaaaaaacactcttacagaaaataccttatgtataattacttatttcaaattcttggtgtattaaccgagctactgacatgactagtgtagtagacgataaaaacagttgggatcctatccaagtgagtctttatgagaaacttctatccttaataggtattataaaggaaaataaggttaagtttataactggcagtgttacagactctgccaaaatttagctgataaaacttaatcagaatttggttatacatgttgcaaaattcaatgcaacaacaagatctgtgtaaccttcaacaaaagcacatgacccattgcccacttcttgaaaaataattgctaaggaataaggctaagggccagggagggctatagacagggtttttgtctcagggaacaaaacctggacttgtaactgggctgaccaatgaacgtactctcttgccctggcagtttaccttcatgactaccgtatgttttccacttttcccttttctgaatggaaatttctattgtagatatatttttttctacttcaccattcataatacaagtaaaagaagaggtacaacttgtgttttagtttataggtcaccagaccacaatgaatcacctttagagttagtggaaagaattgaaaatcacatagagaccttggacctgaatgtaggaactggataggactttgtggaagtctttgttaggaatggagttgttttatgcatagaagaaagattttatgtgtaggaataagtgggtgtttggatgaagaaagacagacacatacttaatatttgcagggactcaggcaaggatacaaatggagggccgggtgtggtggttcacacctgtaatcccaccacttttcggaatctcaaggattgcttgagcccaggagtttaagaccagccctgacaacatagtgagacctcctctctacaaaaa

SEQ ID NO: 21095 - DNA, 1012 bp, Homo sapiens
atcacttgagctcaggagttccaggccagcctgggcatagtgagacctcatctctacttaaaaacagcaaccaaaaaaattagcagacatgatggtgtgtgcctgtaagtcccaggtactcaggaggctgaagtaggaggattgcttgagtccaggagtttgaggctagagtgagctatgattgcaccactgcactccagcctgggtgacagtgagaccctgtctcaaaagaaaaaaagaataaattttataagataataaaaactatggctgggcaaggtgtctcacacctgtaatccccgcactttgggaggccgaggcgggtgaatcacgaggtcaggaattcgagaccagcctggccaacatggtaaaacaccatttctactaaaaatacaaaaaattagctgggcttagtggcgggtgcctgtaatcccagctactcgggaggctgaggcaggagaattgcttgaacccaggaggcggaggttgcagtgagttgagactgtgccactgcactccagcccgggcaacagaatgagactctgactcaaaaaaaaaaaaaaaaaataggaattttaggcttggtatattatatagaaccattctttgccatttttaattaaccctagtttctatttctttttattttctttttttctttgagacagaggtttgctcttgttgcccaggctggagtgcaatggcatggtcttggctcatggcaagtttcgcctcccaggttcaagcgattctcctgcctcagcctcctgagtagctgggattacaggctcccaccaccatgcccagctaattttttggtatttttagtagagacgaggtttcaccatgttggccaggctggtcttgaactcctgaccgcaggtgacctacccgccttggcctcccaaagtgctgggattgcaggcgtgagccaccatgcctggccttctctagttcttttaattgtgatgttagagtgttgattttagatctttcctgctttctcttgtgg

SEQ ID NO: 21096 - DNA, 1032 bp, Homo sapiens
ccctggcctcaagtgattctcccacctcagtcttccaaagtgctgggattacaggagtgagccaccgtgcctggacttttttttttttttatctttaaggctatatttttactataccttttctatgtttagatatgtttagatacacaaatactgtgttacagttgcctccaatattcagtacagtaatatgctgtgtaggtttgtagcctaggagtaataggccatcccatatagcctaggtgtgtagtagtctataccatctaagtttgtgtaagcacgctgatgtctgcacaatgatgaaatcacctaacgatgcattcctgtcatttgtgatgcataactgtagtttaaagtgttaatagcttgaccaggatttgttaaatgacaaccagctccttaattttccttggcattttccttctcttagaggagaccactttgtattcttttagttgatctttggtatttggtattgatttttcagtttcagcattatctgttgacttcccacttctgagcatgagaatttagttgtctctcccttccttccaccttagccacttccccttcccctctccctgttacttaatcctaccgcaatagttatatggtaattttagataactgttaaatgtttaccttatgagcatatgcgtaggattcacagctgaaattaggtagtaagttttgattacttttctagcacaatgtttgttttccttggagctgatgactgattttatttgtgtttgcttagtattctaagtatttatcactaattcaaccctgaacactgtcacttgcctaagtctcctttcaagactatgagttgttggcagtttattcttctaatgtctcatgtggcctttttacttacatgaaaggagcttgcaggactggtgcttcatattgtcagtctttcagtttagccatcctgattgttggaaagtagtatctcaatgtggattaatctgcatttccttgactaagtgatgttgaacaccctttatatgtgcatgttggccattt

SEQ ID NO: 21097 - DNA, 1049 bp, Homo sapiens
atagactgcttttatctattctaataattttgtattgtacaatgtgttggaaaggcaagatgaagttagattatgaagggttcatttccattcaattctgtctatccttctggactttgcctaaatcttaccttctttggagctttcctgaacttacttatctcctttgaattcttacatttggatcctttgtatttgagtatttttacatatatatgtacataaataacacatgttttatgtgtattaatttactctcccaactagattgaaagctgctgaagagtaacctttttttaaaaccacattggactgttttaagcacaaatttagcatatgcttgatgattgagagaaccatatggttacagtcattggtgtgtctgtatgattgtgatatgttgctatttaaaaatcaatagttatttcttatttagttttctgttaagccataaccttttgctctcatttatacgtcttctgaacgttaagtaacatgtggctcatatttcaaactcccaatttggaattttatagcaatgtgactgaagtttataattacaggtctcagaggactgcactacacagaagttctctatgtgttagaagaatttattagaagatagacaattgtaggttacactgtaatttagaagacttttgcgcatctcatgtatttgtgtcagtttgagaatttgaaaatgcccccaaaatgtctgttcttcactagtgcctcttgtgatcctggcagagataagctaaacttttgaaagggtagactttttctgtttatcttagtatcctgagtccctaaatctggaatgtagtagatgtttgtgcatttccctatgtcagtgaagtcaaaatactacaggtggatttttcagcttttcaaagttttcacatttactaagtccttcacagttatctcctactagttaaaaaactatttgcctcaatttatgccagtgctactttgacatttgcattgctgtaaaacccttactaaaaggtatgtttttctagtatacaaatacatgtatgcagctt

SEQ ID NO: 21098 - DNA, 1034 bp, Homo sapiens
agttagaatctgtcaccaagttttattagtttggtattgagtttagtctgttagcttctgcttaattgcctccactttagtccccactgccatcatcttttgctccaagacactgtgcagtagtttcctagtttcacacagtcagtgtattcttaaaatccaaaccagatcttgttattcctttctttaaagtctataattaatttttaaaaatgtagtctttatagtggtctacaaggctgtaaataatttggttcctgcttaaaactccaacctcaattgtagtaatttaccccttgcctcctgtacactagctacactagccatcttcttgttcttggaacctattctggcttgcagcctttgcatttgctactttctctcatcctggaaagactatttatgaatttttacatgtctggctcattctcatatctgatggccacagctcagatggcctcaaggacgccttcctttatcacctcatatgaagtggtatttgtctatcactattgtgcaatattctgaacagtttgtgtacagcctttatcataatacgtaattatcacgtttattgtcaggtctgttgctgaatccccagtgtcaggataggtgcagtgcctaatgtattttaagtgctcagtaaatattggatgtctggatgaatgtataaatgtataaataatggagagaagttgtggagagctttcatgtttgtcagatcggggggtaaaaaataaagacaggaatcgagttatactatatgtatccacctcaaaatttcttttcctttcagcagcttttaaaaagtttgtgcttaaagttttttttttttttttttgggacgatgtctgtcgcttcccaggctggagtgcgaccttgggatcactgcaacctctacctcctgggttgaggcgattctcctgcttcagcctcctgagtagctaggactacaggcacaagccaccacgcccagctaatttttgtatttttaatatagacggggtttcagcatgttggccaggatggtcttc

SEQ ID NO: 21099 - DNA, 1040 bp, Homo sapiens
gaaaagcgatttttgaaaatttaatttagattttaaatatattggtataaggaaagatttaaatgttataaatttttattctttttgtttttaatagaaaagggacctcagtatgttgcccaggctggtctcaaactcctgggctcaagtgatcctcctgccttggcctcccaaaatactgggcttacaggcatgaccaccacacctggccttaaatataaattataagtgttttaatgttatcacatatatccctaaaacttgatatatatgagttggcaaaaatatttttagatggaaaatggaggttcatcttacattcaggttgttttttaatagacatatagcctatttttaaaatatgcatttgggagaatggatgagtaaaagtgttacagagttctcatcttagtgggtagagtaggaaagggcatcattatttagtttaaacattatcagtgctagagatgggcatttgatgccttgtgtaatagaaaagtgtgatagaacttccaaactagggtggtgtgaatatgggtgagaatgatttgaaacttgaccaagctagatataagcaaagtgaatagaggaacaaactgattatgataagtgaaaaataagatgaaaaggttagaccaaatataattatcatcacaatacatgtaaatgggctcaattctcctacctaaagatggcagttaccaagagggttaaaaaattaaaactagtgctatatcataaaaaggaaacaccccaaaacaataatactaacaataaggaagaattcaggataaaagtcattagttaatacaaaagggatattgataatagaatgtataattcacaaaaatgtcataaacctatgtgtagcaaataagataggagccacctacataagcagtgtaccttaaaagtacaaaaactttgataaaaagataatcagtacaatgttaagggcctccagggtaggttaattctgaatatatagaggttattaaggaactagattctttcaatctgtctgctaattctttgtgtac

SEQ ID NO: 21100 - DNA, 1029 bp, Homo sapiens
ctgcagtgggagggctgccttccagctacacaggggcaagggagcagctgcaaattcagtctctcagcccaggcaggaagcctgatggagtcaggatggggatcagtggggtcagcattctggatgggataggggcacaggacagggaggtcagttcggatttgggtccctctaagggaactggccagggtgtgaagcagccaggtgcagacagggataggctcactaggcgtgtgactttgtgaccttgggcaaggccctgcccttctctggggctcaggcttgcttgtcatctgcaaaaaaaatgaggctcgaacagaactctcaggtactttctagtttcatgagtccctgaattgtgaaaataaaaaattaccactgagaaaccatatacacttccagactggtggctgcctagcctggcctctgctccttgacagaggggctggccctggtgtttgagcttgtgtgcttgaattggcctcaggcccaccgtgccttttctcatctcagacagtactcttgctccttcagttgccacgctggctcccaccggcctctttccagatcatgaaggtatttttccttcatcaaattgagaggaagtccgtagtaaagctgcccgttgaccaggtagtgccgagagaatcggtaggtcacatggattcctaaaggtcccctgatcagccacagtttgattcatgttctgatgccctcccagatgatgccaccattaggtctgctggggctgggggtgagtcccagattgccctggatgttatctgtagaggataggaagcggctgctctggggccagtggccagtaaggtccccaaccctggggcccagctctcccttccagctgattacaggctatggcaggctccataacctccccaattagccggaggccaggcccaaggcctttctgataacctgagctccagtggcagccgctgtggggccagcttatctggtctctcttatcctcacccttcccccacatactcaaagagttgccctgacttc

SEQ ID NO: 21101 - DNA, 1075 bp, Homo sapiens
gatacttagggtttttttgttttctttgttttttgtttttgtcccagggatatttatttgaattttctacctgtaaacacaatttgctaacagctccatttaccctttcttttcaccaaaatttgacattgtccttaatcctcccaattctttattctccatataacaatcaggaaattttatcatttctacctcctatatattgcatgtcccattttccatctctcgggcccccattgccctagtttgggtccttaacttggttgttataattttcttctatccagtcttcctatttctagtttcatatctttttaaaccattcattgcatatttataaaactgtcttcctaaaatgccatttccctgcttaacacttccagtggttttccatcactgctgaacaaagcacaaatttcctagcatagcctgcctgttcctttataaccttgtccctaactacctctccagctctattgttttcttccctttttaccatagccctcagatctgtattccaaccacacactgaactgaactactaagagtttctcagatgcatcaaattgtttcaacctttctgtcttcgcatgctgtttttctcctgaatattactattctttcttcccttattccttgtttacctgaccagtacctaattcttcctttaagatccaggccaagttatcttttgcattgtaaaacatttcctgaacctcaggcattaccttctttgtgccaacattctatatattcttccactgccatagacccggtagtatactagctatttctcctgctaaaccaatgattctcagtggtgacagagagtgtgctgggggcagtgcaattttgcccatcagaggacatttggcaatgactggatccattttttattgtcacagcaatggggtggtggtggtgctactggcatctattgggtagaggccagagatgctgctgaacatcttctcatggccaggacaacctcccacaacaaagaattatccagtcaaacatgggtagtaccaaggttgggaaactctgtgtcagaccttaaaattgtatcttttta

SEQ ID NO: 21102 - DNA, 1068 bp, Homo sapiens
aacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttatgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttttttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtg

SEQ ID NO: 21103 - DNA, 1652 bp, Homo sapiens
gctgcagtaagccatgacctcactacttcactccagcctgggcaactggagtaagaccctgtctcaaaaaaaaataaaaataaaaaataaaaaaaaataacaagtctaaatatgcaattataaacatacaaagttaacaaaaaggccccaaaacacatctagcaaaaagcatcagaaatcaataatttagtaatacttggagacttccataccctgctcaataatgggtagaacaactagaaggaaaatcaacagaaaataaaagccttgaacaaaactacaaaccaacaactacaaacaaacctaacagacatctgtagcacacttcacccaacaacaggaaaatacgcattctgctcaagtgaacatggcatgttcttcaggataggccatccgttcatccataaaatataaggttccataaatgttaagaggttgaaatcattacaagtattatttctgactacaatgaaataaaccagaaatcaataatgggaggaaaaatggaaaactcacaaatacatggaaattcaatgatatacttttaaacaaccagtgggtcaaagaagaaatcagaagaaaaattgaaaaatacattgtgataaatgaaaatggaaacaatgtcccaaaattttggggacacagtgaaagtactactcccagggaaacttaaaaaagctgtaaacatctaggccaggcacggtggctcacgtgtgtaatcctagcactttgggaggccaacacgggcagattacctgaggtcaggagttcgagaccagcctggccaacatggtgaaaccccgtctctactaaaaatacaaaaattagccaggtgtggtagtacatgcctgtaatcccagctacttgggaggctgaggcaggagaactgcttgagcccagggggcggaggtttcagtgagctgagatcatgccactgcactccatcctggctgacagagcgagactctgtctaaaaaaaaaaaatactgtaaacatctgtattttaaaagaataaacatctggaatcaataatctaaccttcctccttaaggaattaggaaaaaaaaaagagcaaactaaacccaaagcgaggcaattaaaggaaatactagaaatgaaaaaggaaataaatgaaatagagaattcaaagaacagtagagaataaccaaggtaacaaaagttgatttgttgaaaagatcaacaaaattgacagacctgtaccaagactgaccaaagaaaatacagagaagttctaattcactaaaattagaaatgaaagaggggatgttactaccttacagaaatacaaaggattataagagaataccttcaaaaattgtgtgatgacaaataacttagattaaatggacaaattcatagatagacacaaaatactgagaatatatcaagaagaaatagaatatctttttttttttttttttttttttttttttttttttgagacagagtctcacactgttgcctgggctggagtgcaatggcatgatctcggctcactgcaacctctgcctcccaggttcaagcaattctcctgtctcagcctcctgagtagctaggattacaggtgcctgccaccatgcccggctgcatttttagaagagacggggtttcactatgttggccaggctgat

SEQ ID NO: 21104 - DNA, 1046 bp, Homo sapiens
cactagtcagaatggctatcgttaaaaagtcaaaaaaaaaaaaaaaaaaagaacagatgctcgcaaggttacagagaaaaaggaccacatatgtactgctggtgggaatgtaaattagttcagccactgtggaaagcagtttgttgatttctgaaagaagttaaagcagaagtactgttcaacccaacaattccattattgggtgtatacccaaaggaatgtgagtcattctcccataaagacatatgtatctgtatgtttatcacagcactattcacagtagcaaagacgtggaatcaacctaaatgcctattgatagtagactggattaagaaaatgtggtacatatacacaatggaatactatgtaaccataaaaaagagtaagatcatgtcctttgcagcaacatggatggagctggaagccattattctaaatgaactaacggaggaacagaaaaccaaataccacatgttctcacttatacacgggagctaaacattgagtatatgtggacagagaagggaacaacagacaccagggcctacttgagggtggagagcttaaaattaagctgtttgaactaagagttgagctaccattcaaggaaaactacctgttggatactatgctgctttttacctgggtgacaaaataatcggtcctaatttgtcacaacaaatcaccatgacatgcaatctgcctctataacaaacctgcacatgtattcctgaaactaaaataaaagttaaaacaacaacaacaacaacaacaactatagatcaatatccctctgaaacatagatgaagatgtcctcaacagagtgccagcaaattgggtaaggtcctcaaaaatggcagaacaaagacctctgaaatttctaaaagcaatgagaaaataggcaaaaataagttagaagcaactttatcaaaactctgggtattaaccaaaagttacagcattctaggaagaatttactccttaaaaatagctgaattgcagtaagaacagtaagctttgtggtattttaacttgctctgttctc

SEQ ID NO: 21105 - DNA, 1065 bp, Homo sapiens
acagtgtctcattctgttgcccaggctagaatgtggtggtacaatcactggctcactgtagtctttacctccctggctcaggtgatcctcccacttcagcctcctgggtaactgggactacaggaacataccaccatgcccagttattttttttgtagagatggggtttagccatgttgcccaggctggtcttgaaatcctgagctcaagagatctgtctgccttggcctcccaaagtgctgggattacaggtgtgagccaccgcgtctggcttttattgttttcttttcacatgatttcaggaaagtagaatttcatgtgtaaatatgttagttgttttacaaatgtcattttttgaagttttttgcattgtaaatatcattgtatatttttatcagaatgtatcaagaagtaactgtaaatcaggtgtcactagtgcattactgcactagtagtgcagctctgacattttcagagtcctcagtattttaactaatttatgagagagagtgttccttttcagagagggctgtaggatcttcatttccagttagattgccaacagaggtcttactttcactttagggcagtatttgtctatattattcctccaagtgcacctccaactgcacctgtgttcattgaaagtttgattctgaaatataacccagcctcttgaggtgaaagtgctgagtcaaatatcaccaaacaggaagctgtttcaatagaaattcatattcttggttttcttatattttcagtttgtatttagcaaaaattaaggacattcatttttactgtaactaaaaaagttatttaaaaaacactactactttttcatttttattagtatttaaaaggaactcttttttatttctaacatatgccacatatgggtacatatcaactgaataaaagaaagtaaacatttaaaacatatgagtacctcatgaaatgaataatgaagaatcatctttagatggaaaaatataccaggttctacttatgaaataaattatgtgagtaagattacaaaagatggtagtctgtttaggcaggcctatt

SEQ ID NO: 21106 - DNA, 1053 bp, Homo sapiens
gatgtaaggataaatataggaagcacttttgggaaatgacagacaaattagttaaatataacttatgattaatttactgtacattttacatattaaagcaatttttgagcttgatatggactagaaaaacttggaggttctagttgtttcatcttggttacaatctttaatatctacccagttaatcttcataatagcaaccaattgattttcctttttggctgacagtttcatattggcaccttttgaatttagatgatttgtgtggtgtcaggagggacgttaacttgatgcagtggtagtctccaaatatacttatcccagaggtcatgggacaaaaaagtgacaccacattgggatgcttgaatcatatagtttagtaaagatagttaaaacacacagtgggaggcaaggggagagagttgagggtaggttaacatgtgaatacaatgtaagtgggtggaaggaccacactacctaaatcctgggctgtgcaatgtttatgtcttgtctttctcttttccacatcagctctcctttgctgatggtgtgcttacagagactagaaatgaggtttatgcaaggggacccaacagatgcacaattgacacactttattagagtaaggccagcgcaaatgcacttggccacagctgtagtccatcagtttgcctgctgagctacaatgtattttatttgcctttcttgggcagaggatacatggagccagaatgggtgtcaccaatgggtggctgaataagattttatggatattgggtagtattttatatgcctcagatatatttaatgtatcttggatatttgatacctcatgtatatgtagtgtatcttgaatatctagtgtctttccatcctttttcatctatgttcatagagaaatgctgtacttactttatctctttaatatggcttacacaggtttctaacttctagctacgattttaacattttaagagtttcacccatctatttgggttcttgtattttatatattctcaaatatacagcagatgcaaattatagaagcgaact

SEQ ID NO: 21107 - DNA, 1033 bp, Homo sapiens
tcatttcagaggggtttgatactgaccatgcagaagacagaaagcctacattagaattcatttcagggggacatgaggaaccaggattgaaatataattagatgggttgtattagttctatgttgctgcataacaaattaccacaaaattagcaccgtaaaacagtacacatttatcatcttactctttctgtgggtcaggagtctgggcatggcttatctgggtttttcttctcagtgtattacaaggctcccagcagagtcaactggggttgtggtctcactaaaggcttgactggggaaagattagcttccagggtccctcagtttgtttgcagaatttatcccttgtagtcgtaggactgagtgagatacccagtcttttgcgggctgttggctaaggatgactcttaggtcttaaaggttgcattcaggtcctagtcatatcgccctctcaacaacgtggcagcttattactactactacttttttttttccttcttcaaagccaacaaaggtgtctcttctgtaggggtgcattgtatcttttaaggacttttacctgattaagtcaggtccacccaagataatctcccttttgattaactcagaatcaattgaggtagaccttaattacgttcataaaatcccctcatctttactacataatataatctaatcatggaagtaaagtcttatttttatctcacaacggggagaagtttatgcaggttgtatatagggagtaggaatcttaggggctatcataaactttttatcacaggggttaatttatcagggtaagaaaaaggttaggaagaaccattagaataaagatttgtgactatggcatatgaaaatattaatagaagtgaaatgatatttatgaaatttaggtagcaaaggcatcacaactgcacataataatctttccataaatgcttgatgaataaacacacgaatggatggagactaactcttattgttccaagtctttcttactgcctttgaagttagaggtattttagaactgc

SEQ ID NO: 21108 - DNA, 1026 bp, Homo sapiens
aggctggtcttgaactcccgacctcagatgatctgcccgccttggcctcccaaagtgctgggattacaggcgtgagccactgcgttcggccttagcattttttgtgtgtgtacaattaagtacattcacaatgttagacaaccaagaccactatctattttcagaacctttcatcataccaaataagaactctgttcccacaaaataactccccagattccttttccccatttcctgttaccctctagtattctttctgtctctgtgaatttggctattgtagctacttcatataagtggaatcatacagtatttgtcctttgtttctgatttatttcattagccataatgttttcagggttcgtccatcttgtagcatacatcggaatcctttttatggcagaataatatttcattttatatatatatatatatatatatatatatatatatatatatatatatatataatctcacatttgcttatccattcatctgtcgatgggtatttggattgtttctaccttttgcctgttgtgaataatgctgctatgaacgctggtgtacaaatatctatttgtgaccttgctttcaattcattcggatatatacctagaaatgtaatttctggatcttgtgataattctaaatgtaacttctttttttgagatggagtctcactctgtcacccaggctggagtgcagtggcatcatctcagctcattgcaacctccgctttccaggttccagtgattctcctgccttagcctcccgagtagctgggattacaggtgtccgccaacatgtctggctaatttttgtgtatttttagtagagacagggtttcaccatgttggccaggctggtcttgaactcctgacctcaggtgatctgcctgcctcggcctcccaaagtgctgggatcacaggcgtgaaccaccacgcccagcctaaatttaactttttgaagaaccaccaaactgttttttttatagtcaatgcataatttagattcccatcagcagtg

SEQ ID NO: 21109 - DNA, 1044 bp, Homo sapiens
ttgcctatggcaaattatactggccttcatccccagtattttggaattatctgattctgctattggtatatattcatcatttcacttgttcatttattcacctaacaaaaatttgttacatgcttaaattttgcaaagctattaagtaaacagagacaggtacaacctgttttgctttcaaagaattttcactctaagagaatttagtgatctgcctaaagcaaaacatttataaattaaatctgtatacagttaattgaaggtaatagaaaaccccctgacaatttaaaaataaattgttaaacttgttgcttgatcttttatgtacatacttccaaataaatactaatttccatgcctttttcaggcataactctaataatgacatattcatattctaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaaggtaagggaatatttattgtttcttttgcctttaaataatcatttacattttaaacattggcatgctaattttaaaattaccacagtaagcttcctagggtagaggcaacaaggtaataactatagttttctaaacatcacatattattttacttattttttgattaagatactgcctgattgtcctacctctgttttacttaaaagtctgaaagagcaaggctggacgtggtggctcatgcttgtaatcccagcaggttgggaggctgagctgggaggatcacttgagcccaggagttcgagaccagcctggagaacatggtgaaactctgcctctacaaaatacaaaaattagctgggtgtggtggcacacacctatagtcccagctacctgcgaggctgaggtgggaggattgcttgagcccaggaggttgaggttacagtgagctatgattgcacccctgcactccagcgtgggcaac

SEQ ID NO: 21110 - DNA, 1044 bp, Homo sapiens
attgagccatttaagagtatgttgttgccctgatgttccctcaccctgaaatactttagtgtctatgtcttataagcaaagacattcttatacataatcacaatataaccataagaatcaggaagttaaaattgattcattgttgccatctaatactcagaaccggtttaaattttagcagttgtcttaataacgcttttataaaagcaaaagaatccagtcagaaccatgcattgcatttagttatcactttagtaacttcttcagtctggaacacttcttcagtctttccttgactgtcatgattttgacacttcagaatattacagcttatctagaatgtctcttaatttgggttttctcattagactgaggttatttatctttggcaggaatgtcacagaagtgatgccttctgctcattgcatcttataaggtggcacgcagtttcattttttctcattaatgattgataacttgattaatatgatatctgctaggtaaaaaatataactttacagttatctttttgcctttataaaagaggactttatggggaagaactctgaaattatataaataacatgtccttacaaaaattcagtttactcattttatttatatctttatggacttgtgattttccattttattcggtgagttataattattatatgatttgttttggtactcaagtgggaaaccagttaagttgcttgtgtctttctgacatatatcaatcattcttggaacgcttccttattttttggcaaaagatagtgttccaggctcaccttatattttccctgccctagtctcggattcagacatttctccaaggaaccctggttccatttagtgaaaaataacatttgaacgctgtgttctgggagttagttttgctcattgctgttggagttgctgctccaggccctttcagcagacagctagagaatatacacaatgtattgtgtacacaaacccagactcatagacatatacatttatgtctatattttttctgtatctgtctgtctgtacact

SEQ ID NO: 21111 - DNA, 1052 bp, Homo sapiens
gaaatcaaggtattggctccaacctctctctctctctctttctctctctctctctttttctctctctctctctctatatgtatataattttttaaatttatttattttaatttttttttgagacggagtatcgctctgtcacccaggctggaagtgcggtggcgtgatctccgcccactgcaagctccgcctcctgggttcatgccattctcctgcctcaacctcccgagtagttgggactacaggcgcctgccaccacgcctggctaattttttgtatttttagtagagacggggtttcaccacgttagccaggatggtctcgatcttctgacctcgtgatccgcccaccttggcctcaacccaacctatgttaataatagttttccagcatcattagatcacagttttgaaaaaaaaccagtttcatttaagaatgtctttgatgaagcagtaaaaattactaattttatttaatctcagccgtttaggtttttaacattctgtctgaagaaatgaatagaactcataaaacacttttgcatacagaagcaggatggatgtcctggggagaagcgcctgtaggatagtttggattgtgagctgactagccactttttgtcatggaacatcatttttgcttgaaaaagagtgaatgatatactaaccatggtaattctttatgataaaatgagccagataaaatttgagctttcaagtgaaaatcagaattttaaaaaatttgtatatactctgagcttggcagctttgtgataactacagacttttctgatgaaattggtgatattacagaatatgactttttatatttatataatgaaatgtgtcaacatttgtaagatctgtaaaactcaatgaacttaaactcagcgaactaaatattatttaaatgaccagtgcatgatattgcaaaatgatgcctagaaaaggtccatcctaagtgcaagatagactgatggaccttttttctgccctgtccccccattcccaggcaaccacagatttgttttcagttactgtacatttaatttg

SEQ ID NO: 21112 - DNA, 1364 bp, Homo sapiens
ggccatgggttagactcagtgtaataaatgattgttggctgggcacggtggctcacgcctgtaatcccagcactttgggaggctaggcgggtggatcacctgaggtcaggagttcgagaccagcctgaccaacatggagaaaccccgtctctattaaaaatacaaaattagccaggcgtggtggcacatgcctgtaatcccagctactcaggaggctgaggcaggagaatcgcttgaacctgggaggtagaggttgtggtgagctgagatcacaccattgcacttcagcctgggcaacaagaggaaaactccatctcaaaaaaaaaaaaaaagatggttaaaaaagattgttaaattaattcaagccatgggagtggagagaatgcttagagagaagcaaagaggaaggagggtacctttaagaatatttatatttaggaaaagggagaaaccaatgtatgagaatagttaagagcagtgttacagacattaaggaagaagaaaatgtgtttgctgtgttccaagaagacagtgttggctgtatgcctaagaggttacatgtatggatgttggagtcacacagcaggattcagtcatgtctaggctctaccatttaataactgtatgatactgggcaagctactagacttttaaaaacctagtgttcacatttgtaagattgggataattaatgttatttggtgattaagaggtcctggatgaccttgagaaggagctttcaggattatgggattaaaagacagattatatgagcttgattctataatcaatggttttgctctaaagaacgtggagaaacttagtagggaagaaacgttgatactgtaaagaaagatttttacagacatgaaatatattttcttcagagatccttgcagttatacattttaaatcatgttattgggagtagtctacaagtacataaggcgatttaaaaaatcaaattggacttttcctattgaaagcatgtttctcagaatctttggtaaagtaaactgaatggtagagaagtactttttaaacatgtttaagtttcatgttttagattatggtatgaaatttctagaaataagccttacatcctggttccagttttcttctagaaaaattgcctacctgtaagttatttatgctgttttttttaaattacttatataagactcccctgaaaaaaccactctggctgcaaagttatctgctaagaaacaggcatccatatacagagatgaaaatgatgattttcaagtagagaagaaaagaattcgacccttagaaactacacagcaggtaaacagagtttattggcagtaaataacccagttagttacagctgaacatggtag

SEQ ID NO: 21113 - DNA, 1026 bp, Homo sapiens
tctttcttatttcttcatgtacatctccatatccattggtacctccatagtccaaactaccatttcttgtttagagcatccaataacgcttttttctgcttttactcatgctattcctttaccagtcactggcagggagacagaggttgccatgattgacttaagtcaaaacaaagagtatccatttcctaaaatcaaggatggagtcagcttcctctaaagcatgtgactatatagaggagggtagatgattgaacttctggtaggaatgaggaaagagaagtggaacagttattaaataggtgaccaatagtgttgtctacattgttttgattttggccttttggatttcttccctttccttcaaagatttatgctttctccttcctcagagcctttgcttctattagtgtctcttctgagcaaagttccatcttcaatttattatccttttcttcctcagtttacatgtgacttccttggggtatccatcactgatttttctgtcagagtagatttgattttcctattatagtctgtcttctccttgtgtacctttcctttatagcacttgttacagtttgtattatatgtgtctgtctaaatcttttattaatctctgcttccttggcagactacttcatgaggttaggaatattgtcaatttgcttaccattgtatccctagaactctagcagggtgcctggcatatggtaggtgctagataaatatttgttgttaggaatgaatgggattaattttcagctaattataggaattctggtgtataatatttatatacaaccttttaaaaacagctttattgacgtttacttgacataacaaattgcatatatttaaatggtactttttttttttttttttttgagacagaatctcactctgttgcccaggctggagtgcagtggtgtgaccttggcccactgcaaccttcacctcctgggttcgagcaattatcctgcctcagcctcccaagtaattgggatgacaggcgcctgccaccac

SEQ ID NO: 21114 - DNA, 1023 bp, Homo sapiens
actgtttgtagtttgtaagagaataaacacattgtacatcctttgtgaaattacaaacaccctgattgagattctcatatattcctgtggtgtaaaggaaagtaccttggaatgagctttgggtgccaggcatatagaatgcagtagagatgagacagagaaagatactattgactggcaaggacctttactctgtgtgatctgaggattcactgaaggtggccaaatctctatttaaataagatgactatggccgcaggttgaaggatggattaaattggaggcagggaaagtgggccatagaagatatttaaacaaaaggtgagtaggcactgaattaggatagcagcaaaagtacagaaattaaaatggacttagaagaaaaaaaggttggacatggctggttgagggtaggagttgtgagagaaggaagtcaaattcgtattgcctgacttaatttaaaaagaggccagatatgatggctcacgcctgtactttggaatgctggggctggtggatcacctgaggtcaggagtttgagaccagcctggccaatatggcgaaaccccgtctctactaaaaatgcaaacattagctaggcgtggtggcgggcacctgtagtctcagctacttgggaggctgaggcacaagaattgtttgaatccaggaggcagaggttgcagtgagccaagattgaaccactgcataccagcctgggtgacagagtgactcatctcagggaaaaaaaaagatttagtcaccactattgtatataatatgataaaattcactgtggctcatgcctgtaatcccagcagtttgggaggccaaggcgggtggatcatgaggtcaggagatcgagaccatcctggctaacacagtgaaaccccatctttactaataatacaaaaaattagatgggcgtggtggtgggcgcttgtaatcccagctactcaggaggctgaggcaggagaatcacttgaacctgggaggcagagtttgcagtgagccaagatcgcgcca

SEQ ID NO: 21115 - DNA, 1028 bp, Homo sapiens
gtgaaggacctatctctctctctccaaattcctatctaacgtgagctctcccatgacgacacacatggtgctctaaatacagatatggtagggacttaaaatgtttttcccactacttaaaaactaatagattaaaccgaaaggcaagcttctagtggagggtgcacctaagatgatacagatataatggtagttcatattttaaaatcaaaggcagttatgatactagataatatatttggaactgccaaaagttaatagtgagttttactgattcataattcatgtaaaactgtatgtacttttataattttgcttggtttttctttttgccacaattaattcagtgtctataacattctttcttaggattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattggggtaaaatagtggttcttttatatctattaacttatttttcttttagttcttcttacttaacccatatttttattttcctatcagaggacttctaggtagttctgaatttaaaattagattaaatttccttagatcacctctaaaaattaaaagaatggtattagttccaagtagtttgctaaacaggcacttttttttttgagatggagttttactcttgttgcctaggctggagtgcagtggcgcgatctcagctcactgcaacctcctcctccctgcaacctctgtctgccgggttcaagtgattctcctgcctcagtctctcgagtagctaggattgcaggcgcctgccacaacgcctggctaatgttttgtatttttagtagagacagggtttcaccatgttggccaggctgatctcgaactcctgacctcaggtgatctacctgcctcagcctcccaaagtgctgggattacaggtg

SEQ ID NO: 21116 - DNA, 1042 bp, Homo sapiens
attttggcttgatgatgactcgtgttggaggaatacactaatttaaaagccattaactatttttatattttaactttaacttggttctacaggatattaataatgctgttactttgattttttttttttttttttttttttttactgttgatacccacagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccaggttagctatctttagtttatatcagatttaattctttatgcagttaagtttttaagtattatatacaatttattcttcgtttattaaaagaaaaaatgtctttcattttcagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatggtacgtaatttgttccattttggtagtctgaagaataccccccaaaataaattcatgtccaatacctgaaacgtgtgaatgttaccttgttttaccaaaaaatgattttgcagatgtgataagttaaggatcttgagatggagagattatcctcaattacgcaggtgggcccttaatgcgataacatgtgttcttataagaaggaggcagaaggaggtttgactacatagaagagaagaaagccatgtggtggaaacagtgggaagcaaagtcaaagggagaagatgctatgttgctgactttgaagatggtgaaagagcccatgagccaaagaatatagttctagactctgaaaaagacaaggaaacagattatccctttcagccttgccaacatcctgattgcagtccaacgaaactgatttc

SEQ ID NO: 21117 - DNA, 1041 bp, Homo sapiens
tacttcgatacattaaggtgaaaactgagacaggctattggatgtgaccaaatagaagttggtggtcaccttgataggcagtttcagtcaatctgattggagtgggttcacaaaagaacgggatgagaagcaaacttagacaattttctggggacttttgctgtaaatagcagagaaattgcataatagggttaaaagagaggtttattattattttattaaaggtgcattgggagtgatcctatagaaaggaattttttttaattgacagatatggcttatggctgtaatcccagcatttgggaggctgaggcaggcagatcatttgagcccaggagttcaagaccagcctggtgaacatggcaaaacccatctctactaaaaatacaaaaattagctgggtgtggtagcatgcacctgtagtctcagctacttgggaggctgaggtgggagtatagcttgaacctaggaggtggaggattcggtgaaccatgattgtaccactgcactccagcctatttgacagagtgagatttttctcaaaaagaaaaaaatggccatgtttgcagggttgagtaatcatgatagtacagatggaatgttatatggcttctgaaaatgaattacagttatgtataacaaatagatgaatcttagtgatactattgaggagaggaagagggaacaagtcccagaagattacatatagtcagataccctttaaaaatacctctttaatgtattaccgttaataaagttttgaaacaagcacaactaaatgtattatttacatgcacataaaattgagaatattggttaattcttgaaatttcacatgtgtccaaaaatgaccaagagatagggatagggagaaacatttaataagatcgtttttggtaatgttctagttcttgggcagtgagattacagttgttcattttattattaaagaaaatttttgaaatgtaagaggacaacacatggaccagtgattaagttcatgtatatgacagtatcagcatttatccaattattcattct

SEQ ID NO: 21118 - DNA, 1192 bp, Homo sapiens
aattcttgcaatacttgtcctttcataattttctatgtaattgaaaaacatttgggacgtttttagttgtatttcacattactaatatgttcctttatatatatatttgatcttcttttaccctggtgatgatagtgatggaagtaatatggatcaagaatatggcactgcttatacacctcaaactcatacttcttttgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactttgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacggtaaagtatgccaataaaatacttttttgtttgcttatttccctttagttacattcttaggaaaaagtaataaaggcagtttcccatgtggcaaatacatttaaagttggacttaaaactctttatggatgatgttttta

SEQ ID NO: 21119 - DNA, 1048 bp, Homo sapiens
cccgtcctccatcaacaagtttgatttatgactcagacctggctgtctcttatactgaccttgataatctcttcaattctgatgaagatgaactaacagtgagtatctcattaatgaataggattataatttgttttccttgattttattatttttttattttttagaagtgatttgtgagtttaatactatgttttagccctgaacaataggaaatatagtaaaacctcattcattgatttcttttttaaatctcatgtttgagtagtcttgccatagtgtcatctataaactttgagggttttgtttctccttttgtttttacatttgggggacacatgattaaccttaatttgagctctgccgtatgttctgttttgtagttttaggaagcagaattattttcctatttgattctgtagtttgagaaatgactctggaatttactcattcagagaacacatacataattgacattaaagttatttgctttgtcaatttattaaggaataccagctcttttgaatttgttttgcatcacagctattataagacagatacatgatataacaataaaagaggaaaaaaataatatttaatctttaacacccatttgcagagaaaggtgaagataaaagaaattaaagcttaaaatgagattccctagaatgtcaagtctctgtcaaattaatgaattgggtgctgcattatcataaaagggaattccttttcatctgcataaaggtagcttggaaacttctatggtacatttgatctttcctttcctatataatatgcatttagtcctctctcaacatatatatctctatatgtgtgtatatgtgtgtgtgtacatatacatatatatatattgcagatacataaacttttactgtgtatcccataatgtagtacattttagggcaccctttactaggcaactatatccttgaatgctttggcacattcatactttctctctactaccattcctgtatcagctgtggttcctctgaaataaaagattgtagtcagaacgtggtctaca

SEQ ID NO: 21120 - DNA, 1021 bp, Homo sapiens
ttataatttaaacaatggagactggtatgaggagaattgttagtctcctattgtaaccccacaactataagcttgaaagtactgtcaagtcttcagtgagcaaacacttggaattattttacatatatatgtgtgagtgtgtatatatatgtgtgtgtgtatatgtgtgtgtatgtatatatagtggaatgggtagatcaagctgtttaacatatgcattaccttacataccttttttgtgcgtgtgggtgagaatacttaaaatctactttcagcaatttgcaagtatacaatatgttattattcactatgatgtacagcaaaatccatttaacttttgatgtgggcaaagtaagtcatcttctggtgtgtgttttcgatgacaaagttttaatatttggaataaatagagggtcagtctgtggataaccaaaaataagaaaaaaatctatctgaacaatgaacaaatggtctaggtagcttgaaaattcaacagtttggattctttgccggagtgatctacagattcagagcaatccctatcaaaattccaatgacacttttcacagtaatagaaaaaacaatcctaaaatgtgtatagggtcacaaaaggccctgaatggctaaagcagtcttgagcaaaaagaacaaagttggtggcatcacactacctgatttgaaagtctgctgcaaggccaagtgtcatggcccatgcctataatctcagtattttgggaggccacagtaggagaattgcttgaggccaggagttcaagaccaccttggccaacgtagtgagaccctatctgtgtaaaaacaataaataggccaggtgcagtggctcatgcctgtaatccgagcactttgggaggccaaggtgggcagatcacctgaggtcaggagtttgagaccagcctggtcaacatggcaaaactccgtttctactaaaaatacaaaattagccaggtgtggtggcgtgcacctgtaatcccatctatttgggaggctgaggcagaattgc

SEQ ID NO: 21121 - DNA, 1862 bp, Homo sapiens
tttgccactatgtgacctcagcaaagcccttgattttacataatttccacatcaaagtcagggataataccctttgcttcttatcttaaaatattattttaagtattaaataagaaaagtacatatcaaagtagttagaattactattttaaaaagatttgcattagtgaatatttggtagacaattcagctaaccgttatttagagtctaatgtggtgaggtaaaaaactacacttgatactcagctgtttatagaacagaactatcctgatgattaattataaaacatatccccaatgacagtgtgctagcattatattcccacagcagaaagtttttgtatgcttgggattttagtttttgcaataaatctggggcgtatttggaataataatgatatgtatttgagcatttgatagcatgtttagaaatcagtttttgttttgatggcctactttgccccgagtttgtaagagatcaagtgctactagtgttaggcattagtgaatagatgaatgagataagatttgcctgtgagtcaaagaatgtacgatctgcaaataccttcattgctaccagaccttacatatcttacaatttttgtcttagtactcagagtagataagcagtggcattggtaccttctagtgtgtaaaaattgtttatttcaaagtacaagatagtgtattttagtagtactaatgcaaaaacatctcagtctgtgatttttagatttcatttattcactagcaagtattgacacctattatgtaccaggtactctaggcatctgtgctaaattagtgaacaaaggttagacccctgtccttgtggagcttttatgttctagtgtgagtgacagtcaactatgaatataataaattatgtaatatgttaaaagataaatgctatgcaggaaaatagagcagggtaagggggattattattgaggcaagtgggcatgggcatattgctatttaaaataaagtagttatgggctcataggtgacatttaagcaaagacttgaaggaagtgagcgagttggccatgcagatatttggaaggagaatgttccccataaaagaaatagccaggaatgggtctggaacccattgaggaacataaaggaagcccttggaagcagtataagagaggactagaatagtaaaagatgaagaggagaagaacaagatgatgggaagttttcataggatggtataaggactttggtttttttctcagagtgaaatagtcattgcaagattctggccatgatctgactgcaagcttggctgctagctactgttaggacaacctgagaaccttagctttgtaaacccgagagaataggaatttgagagtctaaacatgtcttatgcaaaccagaagctaatgattctgtgttcacactcaccgagcagtcgggtcttcagagagaaaaaactcctgatgctttccagggttctttggtatagatcagcttgcttcttgttgtggcatccctcttttatccttagatttcagctttctgtggtctgtcagtttccactagctcatctttccaacttccttgttgtcttctcttttattctgtcatctcctgtcattttattggttattttaggagaataaagagaaacaatttcttagttgctgtgttgaaccagaagactaataacttaaaaattgatgtgccaatgtgattagaaaactcagatacttgcactgaaacttcactttccattgtgaaacatcttgccagaattaatagtaataatgctattttcatgaaacacaaatcaggccttcaaaaatttaaaacttaaagtatatctactcatggcagtaaaaaaaaaatac

SEQ ID NO: 21122 - DNA, 1077 bp, Homo sapiens
aataaaaaactagccaagtgtggtggtacacacctgtagtcccagctactcaggaggccgaagagggaggatactttgaactctggaggtggaggttgtagtgagctgagaccgcaccactgcattccagcctgggtgacagcaagaccttgtctcaaaaaaaaaaaaaaaaaaaaaaaggcggtgggaagattttgacattattgcattcatttgtttcttaactttccgtctgtagcttatctgcttctataattgtcatcttaaaaactgtcatacctcatctggaagaatttttattgaataaaggcataacagcatatgctaccataagctatgttaaattctatatgagtacatttcaggatagtatgttattgtcatagtaaaaggaaagagttgcaattaatgaataatataatgctttgggccttgcagcacttcctgttcatggctgtacctgatctttttgcagtttgtctgtatttagctttatgtctaattgaaactgtgtctgtagttaattatttggctgtatgtgaaagttcgtttgaggaaaggagagggttattcgtattctaaaagtgtatgtgtactatataattgatgttgacagtatggtaattagagtttttttatctggcatctcttaaaagtaacaatttttaattctattatcagctttaaatatagaatgtataatgtaaatgaatttatattttaaaatttattgtgtcttgatactcttgaaattgactacatttaaattctttgcacatgctaatgtctgtgagaatgattcaataaaataacaaacagtcatatttaggtaatgcatttggtttactcattttttattttaatagagccctgtgcagtagagttggtttttttaataatgttactgcacagtagtctagcaactacttatgtaaacagtgtgaaggtttttatacttctgccagaggacaacgtaatatgaaacaccgagttttatttgtctctacagagagtagtagtgtctttcaggctgggggaagggagatttcttatactttattccctaaggatagttat

SEQ ID NO: 21123 - DNA, 1056 bp, Homo sapiens
tggtgaaaccctgtctctactaaaaatacaaaaaattagctgggcgtggtggcaggcgcctgtaatcccagctattcaggaggctgaggtaggagaatcgcttaaacctgggagccagaggttgcagtgagccaagaccacgccactgcactccatcctgagcaacagagcaagactccatctccaaaaaataaaacaacaaaaaacaaaactattgatacaccttatgaaagtaaggtcttgctaaataatgaaggtctggctaaataataatggcatatccacttaaataagcaaaggaaatctgtataggctgatatgagaagctctgtatgtagatgaggaaccaaagtacatatgtgcatacatatatgctggcatatacctaggtttttttccaccttaattagatgatagaaatagtacttgttatcttgaaggagagagattgatacttaggcttttcatctttttgtactacatgactttagctatgtacatgtaatgtgagtacatcgtaaacatgtgaatgcagtttgaggtgcctgctgagagattccatcaggcggttgggatcatgtctgaaacttaatagaggggattgctgataacccagttagagtagatatacaatgcaaaaggacaagaatgcatcagtagaaacagagaactagtggatttataatagtggaacttttacaggtatgtgacttcatagaaaattacggtaggagaaattcaaagctttgttttatttgtgttaagtgaaactccattttctgtttggtgtaaataaatgtttccattgattgctattgaaaggtggcactgtccttccatagtagtgggttagtgaaagaaattaatactcttgatttttattttttctttttatgagagaggatcttgctctgttacccaggctatggtgcagtggcatgatcatggctcactgcagccttgaactcctgggctcaagccatccatcctccttagcctcccaagaagctgagactacagacatgtgacaataccgcttggctaattaaaaacatt

SEQ ID NO: 21124 - DNA, 1027 bp, Homo sapiens
aaaataccattatgctcaatagaactgtctacctatttattagtacaaggccaaggaatgtacaaagattacgattccttccttatcagatcattgtcagtgaattaccttttttttagtgaattacttgcttattgcttaaatgctactaataggttaaataatgtcttagactttatttgcttaaaatgtcacattttcattatcgatttatgtttattttttaatgtagctttttttctcaacatcagattgctccagataatgtaactattatatggagtttaatactttcttatttctgttataatgtgaaccagttgctttctagacttgttttcagctctctaggatttcattttgattagactcaagttaataccacaattttttataactagtggcttctttttggttttgcctttattttcttggtgaatatctttagctccctcggggggagggggcggcggggggaagagtgggagataaatttggcatcctttgtatttctgaaaatgacctgatttttttgccctcatgcttggattgataatttggctacatgttggtttcataattgaaaataatttcccccttgaactcataggcattgctttactgtcttctggtatcttcagaagaaatgtgtaataatgagtttcattcttgctcatttaaaaaaacgcgatctcttctgtgaggcttttaaggtcttctcttagctttagaaatgtcacaagaatctgtgtagcaggtataatgatcttttttccagtccttgtgctgggcacttgaaaggctaactcaattttttttttttttttttttttttttgagacagagcctcgctctgtggcccaggctggagtacagttgcgcgatccctgctcactgcaagctccgcctcctggttcacaccattctcctgcctcagcctcctgagtagctgggactacaggcgcccaccaccactcctggctaattttttatattttttagtagagacgggggtttcaccgtgtta

SEQ ID NO: 21125 - DNA, 1067 bp, Homo sapiens
tcagcctcccgagtagctgggactacaggcgtgtgccaccatgcccagctaatttttatgtttttagtagagtcggggtttcaccgtgttagccaggatggtcttgatttcttgacctcatgatccacccgccttggcctcccaaagtgttgggattacaggcatcagcccccgtgcctggccactttctaagtattatttactgtataatgtaagtaatatgttcactgagtgagcagaaatatgtacaggattcacaggtaagatgttaacttctggattttagtatagatcttttgttcatggagctatgttaataatacctgatactggtattatacctgtaaatttaaaaatttaaaagttactctgaaggctgtagaaatacagattaatgattcccaaacttgtctggatgtgggaatcacctggagagcttacaaaaaattattgatgcctgtgtcttaacctgggactgtaatctgggctttggaaattttagaagatcctaatgtaagacaagtttggaaacttttgaattcacggaataaaaataatctcagaattaagatggctaggggaggctgggcacagtggctcatgcttgtaatccctgcactttgggaggccaagacaggaggattgcttaagctcaggagttcaagaccagcctggacaacatagtgagacctcatctctacaaaaaataaattctaaaaattatctggacatagtggctcacacctgtagtcccacctaacttcgttggctgaggcaggaaaatcgcttgagctcaggaggtggaagctgcagtgaattctgatcatgccactgcactccagcctgagtgacagagcaaggccctgtctcaaaggaaaaaaaaaaagatgactacagtttctttttattgtggtaaaatgtacgtaacaaaacttaataatttttcagtgtacagttcagtggcattaagtacattcacattgttaaccatcaccactatctatctgcagaactttttcatcatcccaaactgaatgtgtactcataaaattttatgagtggcagct

SEQ ID NO: 21126 - DNA, 1025 bp, Homo sapiens
tgaagtgttaccagaaatagtatatgctctttcgagttactcttgaaccatagttgtggtataataactgactttattctggaaagataaatgctgctcctcaaatctcttttttacaggaactttcttaccctttttccttctttggaaaagcaagtaggacaaaaatcaagcagctaagtctatctttaagttattacttcggacttcttttctgttgaattcagtggaatgatatagggaaggtagataaagattgattataaattaatgcatttctagaccattctgaaacataagtattatatagactgtttttgttgactaatcaattcacttttggtataagtattctgaaaaaagaacaagagttgtaaagaaagaaaatttatgatgtgaaactactttgacctgaacaaaggagaaaataatattgcttacctttttatcttctttttcctttctttaaaatttttaaagaaaaaaatctcattttctgataatctggacctacatgtagttgtgtgtttaacagtctttagggactgaaagagaggaaatagaatcaaattctagggatacagctaggttacctgtaaagaatcccgcaagtgtaagagtaaccacaggaacaaaccagtcttcagataattggtttaaagaatgatgaccagtgttttcttgaatagtttaggtgttttcctacattgctggggactggatcacatgacaggcattgagttttctagtgagcccacaagcaaatgggttgtagtaagtaccactgacttaatgtaggttttagtctcttctataaaagatattctgaacttgccatgtttgagagtgcatttgaaaaagattatcttgaataagaactttttttttttttaaatagagacagggtcttgctctgtgcccaagatggatggcagtagcgcaatcataactcattgcagccacaaacttctgggcctaattggttctcccacctcagcctccagagtagctgggactacaggcac

SEQ ID NO: 21127 - DNA, 1053 bp, Homo sapiens
gtgccgtggtggtttgctgcacctatcagcccgtcatctgggttttaagccccatatgcattaggtatttgtccttatgctctccctctccatgctccctatcccctaacaggccccagtctgtgatgttcccctccctgtgtccatgtgttctcactgttcaactcccacttttgagtgagaacatacagtgtttggttttctgttcttgtgttagtttgctgaggatgatggtttccagcttcatccatgtccctgcaaaggacataaactcattctttttgtttttgagatgaagtcttgctctatcgcccagggtggagtacagtggcatgatttcagctcactgcaacctccacctcctggattcaagcaattctcctgccttagcctcccgagtagctgggattataggcacccaccagcacgcccggctaatttttgtatttttagtagagacggggtttcaccatgttagccagactggtctcgaactcctgacctcaggtaatccgcccatgtcggcctcccaaaggcctgggattacaggcgtgagccaccatgcccagccgaactcattctttttttatggctgcagacccccgtctctttaaaaaaaaaaaaaagctgggcacagtggcacacactctgaagtgggacttcagagtcccagctactctgaagactgaggtgggaggatcacttgagctcagaagattgaggctgcattgagttaggattgtgctgttgtactccagcctgggcaacagagcaagaccctgtcttaaaaaaaaaaaattgaaattataactttttttttttgagataaggtctcttattttgtcacccaggctggagtgcagtggcacaatcatggctcattgcagcccaaactgccaggctcaagtagtcctcacacctcagcctcccatgtagctgggaccacaggtgcacgctaccaaggctggttaatttttgtagattttgtagagacaagatatcaccatgttgcctaggctggtcttgaactgagctcaagctacccaccatctt

SEQ ID NO: 21128 - DNA, 1064 bp, Homo sapiens
tgggactacaggtgcccgccaccacgcccagctaattttttgtatttttagtagagatggggtttcaccatgtagccaggatggtctcgatctcctgaccttgtgatccgcccacctcggcctccccaagtgctgggattacaggcgtgagccacggcgcccagccttcacatttcatttcttgtacatcgttttgttttcccaggtgttaatgattatccctttttttcacttaattattaatgttatgagttagtaaacacctgcctgtactctgccactttttttgtaaataaagttttgttgtaacacagccatgctcattcattgatagattgttttatgcctgctttcacactagagcagagttaaatagttatgatagagacagatggcttgcaaagctgaaaatacttagcctgaaatattttctagctgactttttgtagtttgctgactcctgatctgtgtacctgttggtagttcatcagtagactatctattagaagtataaatcacttctccctaccttcaaggactttgtataatcttatgagtttccctttttttctcctcttgttaattaatatccctgttgttacccttcattcttcttttccgatttggattagtagttctgtagtcctgtttcacagtagtcatcttggggattctctttgcttttcccttcttgttggatccctcatttctcatttctcctttttttttttttttttgtcttatttactgttatggtggtgcccaacctgagagtagtttcctgagagtgcaaggatggtgatacttttgagatcctctgtgttggaattctgagtcaaaccgcagaattgcaggctcttaagtttctttcttttctatccttataattgatagttttgactgggtatagaatctttgattagcaaccctcttagacttctgggtactaaaatgctaactggaggttctgtgtatgtgagtagcttatgacattgcaggctttactagagtgaatgatctggggacttgactctttttattgggtgcctgtcacccacctgcca

SEQ ID NO: 21129 - DNA, 1233 bp, Homo sapiens
ctgtattttaatacagtggcctaaattttgatttgtgatgatagacttaatgtgggatgaaagcagagacttaggcttggaagtatcttttttttagtatttgtggaaatatatgcacagcactctgatattaaaattaagtaacaacacctgttaaggatagtgatctgtgagtatgttttggatcaagttaacccttcttattcccaatctctcaattccctttaattaaagtaatttaaatttgtgttttctatataagaccatttactctttgagagcttataattttcttgagcaatgaattaagcaaatttatgacactacttattagactagttgcagatagaggcacagaagacttatgatagatacctccttctcctatgcaattaaaaccttcaggttactcgcttctccgtgatttagataatataaggcatagtctctcaaaagatttaagttcccagcagtcattgagttagtgagacttcaagagagatgaaccagtggcaagtaagttgggatgtggggaagagaaaactaaagggaacttactaatttttcctgaaagatgtgagaggatgtgaagtgaacatttggttgagattgtaatcattttgaggtctttgatgtcatatatgcacatcttttttcatgtgcacctggagtttttgtttgtttgttttttcaaactttttagttttagtaagactggatgagtagataagcctggataaataaaggtgctttcattttttttcctctttgaaaattaacgtaaacctttattgttaacaaaatacttgtgtaagttcagaatgcattcagctggaaatgacagaacaacattaactacttggcttatgtagggattgatttttctcagtagcaagcagtatggaggtcgatagtttagtactggtatagctgttcaataatgtcatcaaggattcaaagttccccagagttttctctgtgccatttttacatcttcatggtcctcccgtgtgttgcacctccagacctcacagtggattccaggcaggaagagaaaggaagggaggaagtaaggaaggtgtggcacctgagtcagaaagtaaattattttctggaaactttagttgacatatctttggccatactaagagaaacaaatatcttttatttggaaacagctgctctgaacaaatgaagtttttgttagtaagaagaaagggctgatagatatta

SEQ ID NO: 21130 - DNA, 1028 bp, Homo sapiens
aagcgggatgtagggatgatcattgtgtaggttagcccaggtctggtaacatccaacagttaaggctttcagaagtaccaactgttgcaaataacttgtcctgtatgggacagtagctgagcttcatcaatgactttaagtttgggtgactttactttttcattttctcctttgtgctatgagaaatattaagagtatatgataggtaagtgagttaagtgggaggagcacaactagttggcaagtgtaaactgccagtcatgtatcagcagtttcatttttggcaccttatgctttgctcctttaagttagattaaattactgaattcctcttgtcgaatttcttaacgcccatgctaaattgagatctttaatactctatcctcgtctacagtatgtttttcttttcaatgtccattaatcagcatctcttcacatgtaataagacatacaccaggttttatatttctatcttatccaactcagtctatttttggtacttttaggatcagttctttgaagatagactagcacaaatctgacagttctttgtgagtagctatttgacttttccgacaggggtgtgtgtgaagaattaacatagattttttcagaacttgttcagatgtcttttcattagagacgttacttctgtaaatgtggaataaaaacccatgatagggtctttaataattgattttcagttaaaagtttgacaccagtgaacaaatgtgaccagttaggacagagaaaaatgtactctgtttgcatattgaagtgtgtgtctatatttaacatcattcagtttcttctgtttctacttggagtacatatttgcttgctattcagtgacatggtggtggtaatttttaactgtattcttctccctaaaattcttggttgttgaattataaagtctttttttgttctaatttgcagtcaatatctcaagcatacattgaaaaattgtaatgtcttaatgaaataagagacatcatattgagtacttttgactttgagtgaatatg

SEQ ID NO: 21131 - DNA, 1096 bp, Homo sapiens
aatattcttcacctagatttttccaattagcattttgccatctgtgctttctctgtgtatggggtatgtgtttaattttttgttattgttggagcactggaaagtttcaagtatctactctttctgccctaaatactacaatgtgtgtctcctacagtttctctcttaccacacaccattatcacacacaacaaattcagagctgctatatattatctaatacaggccaggcgtggtggctcacgcctgtaatcccagcactttaggaggctgaggctggagaatcacttcctgagcccaggaagttgaggctgcagtgagctccctgcactccatcctgcatgccagagtgagaccttgtctcaacaaaaaaaggtattatctaatatggagtccattttccaatttccccatttgcccccaaaatgtcctatatagctatttttttaagtataaatattttttatttcagagatagggtcttgctctgtcacccaggctggaatgcagtggtgcaattgtagctcacccacagcctcaacgtcctgggctcaagccatcctcctgcctcggcctccgagtagctgggactatacccggctcatagctgttttttaatccagagcccaggcagggatgagatgaggccaggcactggtgatcatgctgttttactcttccttcccatcccaatttggcttccagattcctccctccacccagagggctctggtcaaagtcaggagccacttgcattaccagatctaaaggatccttctcgctgggcgcggtggctcacgcctgtaatgccagcattttgggagggcggaacacctgaggtcaggagttagagaccagcctggccaacatggcgaaaccccatctccactaaaaatgcaaaaattaactgggcatggtgggcgcctgtaatcccagctattcaggaggctgaggtaggagaatcacttgaatctgggaggtggaggttgcagtgggctgagatggcaccattgcactccagcctggccaacaagagtgaaactccatctcaaaaaagaaaaaaaaaagaaagaaagaatccttctctatcttgtct

SEQ ID NO: 21132 - DNA, 1247 bp, Homo sapiens
gccactttagagcactggttcctgtcctaaagcctgtggagcagtgctgaggattctaagcacaggagtgacagcataagatggctcatttacaaagaccaccccggcagatggattagatccagtagctcagttaggtgggtatggaagtctatgtgaggaatctaggagatctcagtaaaataattcagtgacagaggatgctcaggaaagaaaaggtgactgaggaggaacaagaagtccaggcctagaagcagcaccatccactagaatttgctgcagcgaaggagggcttctgtggctgcactgtctagcgtgggagccatgagactgtgtggctgtcgagcatttagaaggtgaccagtgagactgtgggactgaattttaaacctcatttaaatcgaaatagccacaagtggctagtggctatcacgttagtgcagctctagagcaatttccaggtttctggcttggacagcttatgcggtcatgaggacttccacgaggacagcagtcccaggtggggctggttttatatgtgttgagttggggtactttggaacagccacccagcctggcctccccttgggcatcttgctcccgtgtggcctgctgcagcgacagcccaggctgtggcactgcagggactgcctctcagacctcatcggatccacctgagcatggcagacggctgggcttcaaagcaggttcatctgactgctccttccctctagggtgaagactctacggtaaaaggaatttgatgccttggaaagggagagcggaaactgtgagccctgctttccagccatggcgaaagcgggtacttttgtgcaacccctctcctttcacgttggcctggctagggcggagctgccacgccagtgaccagcgtttctttgggaaaattggacttactccacttccaccttttccactcttcaaatgatcacatttgcatattgggaacagtgtatttgtgaagagactctcaggccttccagggaccaccccccccccccacccgctacagcccaggtcctggttctgtcctccccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttct

SEQ ID NO: 21133 - DNA, 1047 bp, Homo sapiens
ggttttattgatgaatctagttgactcattttttcatggtagaaattatgagatttaagagaactaaggaaaaatctttcagaacaaaaatatgaacttcctattgtaaaacctgactgttgatttcagaagtaaactttgacaggcctaggcattaccctttggccattttcaaagtgagcctttttgggaactgtcatcttaatttagggcaacaaaaattattttcaataaaaataatagtagagccccattctttgtgtctgaattctaagatactcttttaggatcctatagtttaagaaacagattaccggccgggtatggtggctcacgcctgtaatcccagcacattgggaggccgaggtgggcagattacgagatcaggagatcgagaccatcttggctaacatggtgaaactccgtctctactaaaaatacaaaaaaattagccgggcgtggtggtgggtgcctgtaatcccagctactccagaggctgagacaggagaatggcgtgaacccaggaggcggagcttgcaatgagcggagatcgcgccactgcactccagcctgggaaacagagctagactccgtctcaaagaaaaaaaaaaggaaagaaagaaacagattatcggccgggcacggtggctcacgcctgtaatcccagcactttgggaggccgaggcaggcggatcacctgaggtcaggagttcaagaccaggctggccaacgtggtgaaaccacatctctactaaaaatacaaaaattagccgggcatggtgatgcacacctgtggtcccagctgctagggagactgaagcaggagaatggcttgaactcgcgaggtggaggttgcagtgagccaagatcacgccattgcactccagcctgggcgacagagcaaggctgagtttttgagactccgtctcaaaaaataaaataagaaggaaatttaaaaaacagattatcagattgagtacattggttagctgatccaaaatacgcccagataggtttttttggtcttgttttattttgttgttgttt

SEQ ID NO: 21134 - DNA, 1092 bp, Homo sapiens
gcaacagcacgagactctgtccttccccaaaaagaaaatggtttttaggctgggtgtggtggctcatactgttagtctcaccactttgggaggccaaggtaggagaatcacttgagcccaggagttcaagaccagcctggacaacatagtctgttacctaggctggagtgcagtggtgcgatcgtggctcacttcaacctctgcctcctaggttcaaggtatcctcccacctcaccctcccaagtagttgggactacaggcacatgccaccatgcctggctaatttttatatttttgtagagatgggctttcgccatgttgcccacactggtcttgaactcctgagctccagaaatccatctgcctcagcctcccaaagtgctgggactacagacatgaaccaccacgcccggcctacacaagcaattttttttttttttttaactagccaggcagcttctcacacctgtggtcccagctattcagaaggctgaggtaggaggattgcttgagcccaggaggttgaggttgcagtgagccgtggttacaccactgctttccagcctaggtgacagagcaagaccctgtctccaaaaaaagaatggtttttaatatgccactattggccaggtgcggtagctgacacctgtaatcctagcactttgggaggccgaggcgggtggactgccttagctcaggagtttgagactagcctgggcaacatggcaaaaccccgtctctactaaaaatacaaaaaattaggccaggcgcggtggctcacgcctgtaatcccggcactttgggaggccgaggcgggtggatcacaaggtcaggagatcgagaccatcctggctaacatggtgaaaccctgtctctactaaaaatacaaaaaaaaaattagccgggtgtggtggcgggcgcctgtagtcccagctactcaggaggctgaggcaggagaatggcgtgaacctgggaagcagaggttgctgtgaaccgagattgtgccactgcactctaacctgggcaatagaatgaaaccctgtctcataaaaaacaaaagaaagaaagaaaatttgattttatttttaaatt

SEQ ID NO: 21135 - DNA, 1049 bp, Homo sapiens
gggcatatctgccgtctcctctactatactctccattcacattctagcctgcagctttctctccatttcctgagacagcacccttatgtccacttttcaactcctagaaatttattgaaatttcatctaatagctcctctcattctgtcctcagatatatggttattatttgtattcctttgccttaattgggaccttgggagagaggtgagattctaaaatcttaaatcagaaacctgaaatctaatctttctaattctctgaaaaagttaattttaaggtctctcctagaaacataagccattattataagcatcactatcagagggagaaagatatttgtctcaggtgtcagacggatgtcattaacctcattttagagttattaacgttgagattcggcaagccaaagtatgctgatcaagttaacacagatgcaagaacgcaattcataccatgctcgtcttatttcagagtatgtgctttttttactacgccatattgtcacccttaagtataaatctctgacttcaggttactcttaatgagcctttagccatgttttaaccttattgattattcttacgatttgtatagtaacattatgggtgaaattagctcactcttttttttgagacagagtctcgctctgtcacccaagctggcgtgtgcaatggcacgatctcggcccactgcaacctctccctcctgggttcaaacgattctcctgtctcagcttcacaaatagctgagcttacaggtgcccgccaccatgcctaatttttatattttttattagagacggggtttctccctgttggtcaggctggtcttgaactcctgacctcaggtgatccacctgccttggcctcccaaaatgttgggattacaggtgtgagccaccgtgcccagccaaatttgctcttttctagatgttaacctttcctaatagcttctatttttctaaattaatctttactatctttgaaacatttccaagttctttgtgtgtctttaccattttcttacataggactgaaatacacatg

SEQ ID NO: 21136 - DNA, 1029 bp, Homo sapiens
tgggactacaggcgcccgccaccatacccggctaattttttttgtaattttagtagagatgaggtttcatcatgttagccaggatggtctcgatctcctgacctcgtgatctgcccgcctctgcctcccaaagtgctgggattacaggcgtgagccaccgcacccggcctgttccccattattattattattattattattattttgagatggagtgtcactctgcagcccaagctggagtgcagtagcacaatcacagctcactgcaacctcctgcctcagtctcccgagtagctgagactacaggtgcatgccatcacaccctgctaattttttgtattttaggagagatggggtttcaccatattgcctggggcagtgtggaactgcggagctcaggagatctgcctgccttggcctcccaaagtgctggaattacaggcagagccactgggcctggcctcaattaatttaatcattttttgttttagtcctttaatgatggacttctgtaattctaaacaacatgtttagactttccactgacaggagagacagagaaatgactagtgaagcttctccttatttttccaagagagtaaaggtcatgctgaatctcacaccaccccctcctcactgcctcccaactttttctttttttcattttctttttcttttctctttttttttttttttttgagtcggagtctcgctctgtcgcccaggctggagtgcagtggtgtactctcggctcactacaacctccgcctcccggtttcaagcaattctcctacctcagcctcccaagtagctgggagtacaggtgcccgccaccatgcccggctaatttttgtatttttagtagagacggcgtttcactatattggccaggctggtctcgaactcctgaccttgtgatctgcccgcctcggcctcccaaggtgctgggattataagcgtgagccaccgtgcccagccccttcttttcttttttcttttcgtttcttttcgtttattttcgtttttctt

SEQ ID NO: 21137 - DNA, 1045 bp, Homo sapiens
gaattttagtaagaataatcttgagataattgaagaatattcttaggagcaaaggggtcacgtgtccaagaaaatgtgagctgctgtgcgggcctgcatttgacagcagtgtcattaatgctgttgagtgaactgcccaggatactgcaggcctgtcatcatcatcttaccccttttatcatttttttgttttatttgacttggtttagtgataggtatttttcccctgaaaatgtagctctgtgtttatgcagtcttctttataaataaatatggctttttatgtacatgtgaagaatctacagaggaatcattaataggtaatgcctttcatttttctataaaaggaagttctacatttctttctaaggtttgaaactataatgagttaaaggaagagggggcctgaaacttaacctgagtcagattgtaagcttcttgtcgatgtaaatcatttaatttttttgaactaccactttatagtatctggtctgggcaccttgtaaaaagatctggtgaactcaatagaacaacccacccaaccccctctaccagtatatgatatgaaagctcctttttttcttttaatttatttttatttttatttttgagacagggtctcactctgttgcccaggctagagtacagtggcaaaatcgtagctcgctgcagcttcgaactcctgggctcaagccatcctcccgcttcggcctcccaatatgctgggaatacaggtgtgagccactgtgcccagccagagagctcctcttcactcacatcttttcaaaaactagttattaatttttttttttttttgagacagagtctcgctctttcaccaggctggagtgcagtggcgcgatctcagctcgctgcagcctccacctcccgggttcaagcgattcttctgcctcagcctccctagtagctgggactacaggcacatgccaccatgctcagctaatttttgtatttttagtagagatggggtttcaccatgttcaggatagtttcaatctcttgacctcgtgatccgcctgcttca

SEQ ID NO: 21138 - DNA, 1362 bp, Homo sapiens
tgtgcaggtatctgttcatctaagtgtattgggtgacttgtgtacatggaaaacatctttcttgtattccttcttaattgccttttcttttatgacagggaaggtcagcctttaaagctacctgacactaagaggacactgttgtttacatttaatggtaagtattctgggtcctttctgggttcttagtcttctctgagatgaccttaaggagagtattgtttcctcctaaatgatagctttaaaactacgtcaaaactataagcctgtgcttgcttactgatttccagatttcttcaagaagaaattacctattatatattttaatttatattttctgctgcattttaactgcctaacaaacttagagaaatgagtctcttaagattaaaaaaaaaaaagagttgggtgacctggaaatattaatgctaccattaactcagtaggaaaaatggctttgttttccagtgcctggctcaggtaacacttacccaaaggatatggaggcactgctacccctgatgaacatggtgatttattctattgataaagccaaaaagttccgactcaacagagaagtaagacccaatgcctgtattatataaattggcacctttttttgtttcttctcaagggggagggcagctatcaatgatttcagtgactgaatttttgctagttgatttagaagtgccaaatgggagtagttttatgaaagaatgctaaacgggattttgttgctgttgactagaaatggatttcttatgaaatactttgtttcttggggaagggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggttagacaaacttatcactggggtaaaactacgatttgtaaggatgactgcttgtgttctgttggttgttaaggtaatctttgtaggctaaaagtttagcattttctcaacatttgggacattgtatcaattgataacactataaagaagaataaataatccttcctgttcaagccgtgccacactgagtctgtgaacgtgaaaaattatcagtattatcctgttcccccagcacaatttcattttgaaaattccattatcagttttcgagccaaacactttggtagaaagaagttagaaattttaatagaaggcagcacatgcgccctattatctaaataaacttgctatgtaaaatttaaaatctgattatagaattagagatttccaatatttttgtttgt

SEQ ID NO: 21139 - DNA, 1050 bp, Homo sapiens
cccgttggaggttgatttgtgtggttattacagtgttcctgcagatggcagtcgagtgtctcgaggaagtccctcgtgggctgcaagagggcaccatttccctgcctccagtctgcccagagtcctgcttccatccttcagggcccaggaatcttcagtatccggagctccagggctgaaatggggcttctctttcttgggatttagcatagcttgagatttgagagctcagcagcaccatctcacacccctttccatccccagcctagcaaacagaagaggaagttttcttcattctttaagagcctcgtcattgagctggacaaggagctgtacgggcctgacaatcacctggtggaggtgagagtgggcctggggcaaaagcaggctgatgtgcaggtttggcagggaaatggcctcagggcccttgggaggccctgtgttcacgcccacccccttggtgataagccatgcttccctccctgccagtggcaccggatgcccaccacccaggagacagatggcttccaagtaaaacggcctggagacctcaacgtcaagtgcaccctcctgctcatgctggatcatcaggtgacagagaccctggggtcatttctgggcccacagggacccctcaggaggggagctggttcctagaaacccttcctgtccctgccctattttcccactgttctactataagaacccgttctgactcccctccatccaactccagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccaggttagccagatgccagcccccgttttctcagcccttgctttgccttgcctgctgggctactccttggccacagcctgcagactgctgccctcactggtcctggaatggtccactccactgtgcccacaagccaacgctgagcctttcgtatt

SEQ ID NO: 21140 - DNA, 1050 bp, Homo sapiens
cctggaccagagcatttcagggaatggtttcctagtctcatccccagtggcctgtgagttcccaacccagctcagctgtgacagcgcctttgacctcagtgctggtggtggtacacatggaattgattacccagaaaacatcactgactcagacaagcagggcagactcatccgagcaataaaatgatcctcgaatagaatcatgaagatccttccggtcataaacagcaatatgtggagcaggctgaatctacctgctttaatcacaaagtcagaattatttataattagatgattgattttgtagcacagagggtgctcctaaaagtgttttgagaagcattttccctaaataatacaatattgacttgcgtagtaaatccctctctttgtagatagtgtatctgctgcctagggtttgtctgatttagtaaatattccaaaattgtgaggtaactcatgaagcttaatttttttccctcttaaatgcctagaatagataaactggaacttttacatcctattctccttaaaattactgctttgactataaatttaaattatattattgtttttaccaaattaaaaatgttgactagaggctacttctcacatctttagccctttgcatggaatcaacagtatgatgacatgaaaatgtcacaaggagctacctccatggggtctaaatataagatactggctcttagacttttgcttggttctggtactgacctaatgcttttattcatgcttgtggtagtagcagattgggggagctgggttatgcattggagaatattcttttacttagattattctgatttattcaagttacttaatgaaatgtttctattttaataattggagaattttaccagctatatgcaatctaaccggtgtctgtgctattttcctttcatttttctatttgttaaaatatgtttggattcggcaatctgtggatttatattttctggtgagtgtggtatttatcaactctccacatagcatttcataccctgtaacttctgagtcttgttcggtccc

SEQ ID NO: 21141 - DNA, 1040 bp, Homo sapiens
gatttcactggtttttctactaatgtcctttttctcttccaggatccaatccaggatattaaatgtaatattagtttacatctattttttaatgtttttgatgtagcttttatcctagcaattaaaaaaatgctaaacatgaaaacggtataaggataataaaagttacaaaaatgtatttttatagttatgcagtgtaaaatattaaagtgctggaaattatctggctaaaatttaaattaagaaatggcttgcgtgaccctttgtgaggctctggggaattatggttctgatggttggagcctcttaagaagaaaatggtttgatttgattttttgatttctttctttctttctttcttttttttttttttgagacagagtcttgctctgttgcccaagctggagtgcagtggtatgatcttggctcactgcaacctccgcctcccaggttgaagcgattatcctgccttcagcctcccccagtagctaggactacaggtacaggccaccatgccaggctaatgttttgtatttttagtagagatggggtttcatcatgtcggccaggctggtctcgaactcctgacctgaagtgattcatctgtctcggcctcccaaagtgccgagattataggcgtgagccaccgcgcccagcctggtttgattttaaccactttacgtttcacctggccatcagagtaaatctaaataaaattgttagcatcaggcgcatcccatgcttaaaacctctggcgcaacagggtcaatattaaattcgaggttggcttttgaggcactttgcagtctgttcctggctaatctctccatcctcatttcctatcctctgccccccgtactatgcttagaacttcactgaatctctcactggcctccaaacatactgtgccctgtcactgctttttgcatatgctgcttcctgtacctggaatactcttccccacctgggccaggaaaatggcaactattccctcaagatacagcgtagatgtcactgctgtgaaagtcagctagggtaag

SEQ ID NO: 21142 - DNA, 1024 bp, Homo sapiens
ccgcccttcatggattcttcttggttttagtagctctgcaagcataaacaacctctgaagtatcttagaaaaacgattatatctgcttcaagttctttattaatctagttgcctttagaactttagccctggtaaacctgttatatatgtaagacagtattttctgcaaccaaattgaataagaagaaagctgtgtgttctgtgtcaggagatctttggtgaaaatggttgtgcttaaaaagacaaataaatatatttatagaaaaccctactcaacagcagaatgcattttttttaactgcacttggaaccaagatagaccatataacaagcttaaaagaattgaaattatacaaagcctgtttcctattatgaaattacactaaaaaccagtaagagagatatctgaaaatttctcaaatatttggaaattaagcaaaatacttctaaacagcctgtgggcctaaagataaagtcataagggaaaatagaaaatatttttaactgaaggaaactgaaaatacaacctatcagaaattgcaggtaatacagtgcctagagggaaattaatagtattaaaagcttgttagaggatgggtgtggtagttcatgcatgtaatcccagcactttgggaggccaaggtgggagaactgcttgagaccaagagttcaagaccagcttgggcaacatagcaagactccatttctacaaagatctttttaaaaaaattagcttggtgtagtgacacgtatctgtagcccttgctacttgggaggctgaggtgggaggattaattgagcccaggagttccaggttacagtaagttatgattgtgccactgcagtacagccaggatgacagagaaagaccctgtatcaaatacatagatgatagatacatacatatatacatatatatgtgcatacatacatacgaaaagaaagatttgagagaagcacaaattaccagtgtcaggactgaaagagggggcatcaccatagacactacagatattcacaggat

SEQ ID NO: 21143 - DNA, 1251 bp, Homo sapiens
ttaaaaaaccatatgcttatgatttctttataaactctaaacaaattgtaccttaataaactgtcagtaggagaaaaatcactatggcttgaacagagggtgaggtgtaggggccagggaggcatgaaactgggcagtaagccacctggacccttttacaggtgagcaaagcaagtgtctgagggataagcatcacctaccttggcaggaggtaagtggtgcaggcatgattggaacccaggtctgtcagattcccagtacttctgctaaggtaggtgagttggtttcagcgcatgtgttttgaccagcagtcttttgtgtaattggatacgatcagtgtagggtctcatttaggctaacaaatgattgttcacaataaatgtgtaattcaaatcctgatttgtgtgctgtgtttatttgttttttagcagctgtggactttagcatctgatgaatctttaacacaaagataggaacatggtagttcaggaaggaggaaatttgaagataaaagggaaggagaaaccacagcagctggtgattctgaaaagatgggggtagggagaagaagggccaagccaagcccaagcagaataaaggaatttgggtcccctccaggctttcgcaagagaaggaaagcatctcctagattctctttctatgcctacctacttcttgcctctcacttctgcctcctgcagtgcagcaggtaaggttttgtgcttttgaactgtgtaggtaggacttgaaactcccttctctctttcacattcttctgaatcaggttgttctgggattcctgaatttggcaagtggtagaggatgacctttatctgtcagagctgtcagcaaagaaggtaattgcatactcatctcagaactgtgcccatgtgtgagcgagcacacaggctgcagccagcaagaactccacagtggctgttcttcagctaaggtggtagctcaggttgctgggttgaatgcctggctttgtggctaaaaaccgaatccctgaagcactgtggaaatggttgctcttgttatccagggacaggaattttcctaggaataataattgagtagcagttggttagactggggcagagtaacagctcagcacctgaaactgacctgtgaacagatgagctggtgtatgtatctcaacacacatgcctgtatgtcttgttttgttttctaagtctaaaaatcaaaagaataagctaaaaaaatgatatgtttgtctattaattatct

SEQ ID NO: 21144 - DNA, 1029 bp, Homo sapiens
tcagaaggtaagatgagccccagctttgggagttgtgtttgctgccaggagggtttagaggctgcctctaggcaacacccaggggctcaaagaagacagacgcagagagcatgagctgctggtcacctctctatccccagagcatcgtagatgcttgataaatgtgttaaaaatggatgacagtttcaggaatagatttaggagtaaataagagatgggcttgaaatttttctagaaattctgaaaaataggtgccgagggaagtgcagtgccagtgagctgcagagtttgttcagcctgtgctttctgccagaggtaattgacatttctcctcactacgaatgcaagctcgacctccctcctttcgcccttatctagtcctgcaccaaatactgctgatttttatcttataaacgactcttggatggttcttttctctgaagcttctctgccactgttctagtttggtgcaaacaaccatctttttgcttggaatactccagcagcccctcactgacctgccctcatctacctctactcctttctaatctcttcacctctcagcagtctgagtggtctttaaaaaattcctatcatggccgggcatggtggctcacacctgtaatctcaacacttggggaggctgaggtgggaggactgcctgagcccaggagttcgacaccagcctgggcaacatagtgagaccctgtctacaaaaaaaaaaaaaagaaagaaagaaagaaggaaaaattaaaattagctgggtttggtggcctgtgcctgtggtcccaattactcgggagactgaggtgggaggattgtttgaacccaggaggttgaggctgcagtgatctgtgatcacaccactgcatccagcctgggtgacagagaccctgtctcaaataaataataaataattctaacatcatcatgtcacatccttgctcaaactctctgaatgtttctttgttgcctgtgggataaaatctacattccgaacatgtttaggtgctgtgtgatctagcccct

SEQ ID NO: 21145 - DNA, 1050 bp, Homo sapiens
tttttttttttttttgagatggtgtctcactctgtcacccaggctggagtatagtggcacaatgtctgctcactgcagcctccacctcctgggttcaagtgattctcatgcctcagcctgctgagtagctgggattacaagcatgcaccaccatgcccagctaatttttgtctttttagtagaggtggggttttaccatgttggccaggctggtctcgaactcctgaactcaagtgattcgtccaccatggcctcccgatgtgctgggattacaggcatgagccactgctcccagcccagtttatcttattaactatcagttcgacgataactgtgtgaaatacaactggtagaatagagtcccaggtatcagaaagtttactgcctttgagggcaaattcttgtgaatctttaaagtatcatatgcaattcaaataggtttaaaatgtcagtacatatatgtattaatgaagactgtggttgatcatgaataattaacagaagctgaggatttaaatttgtggggttttctctcttttttttttgttctgtgactctagctaaaggtggttatttaagtatttttaaaaattacatgaatatccaggtgaacaatgatttacaaaaaaagaaagatgaaagtggaactgtttttatccaaaacttaagaaatttctaggattgaaatttttaagaagtttgaaatgattcctcttcagtttagagaagaagtaagtctgtttatcaatacttaattcatatcatgtactatgtgtagtttgttttcataattatggctttaatgcaaaaagtaagtttttgaaagatttcttttttatgaaaataactttacgtttcagaaaattatactccaaacccctttccctaaagcacaccatttttttccctaaggcctcttttgaataatcagcaaacaatttttacttaaaagtgttacctttcgaggtagggcgcagtggctcacgcctgtaatcccagcactttgggaggctgaggtgggctgatcacctgaggtgaggagtttgagaa

SEQ ID NO: 21146 - DNA, 3551 bp, Homo sapiens
gtggccctagcaatggtcttttaaaactcaggatttttcctttctctctcctattattagacttattcgtctaatggaagagatcatgagtgagaaggagaataaaaccattgtttttgtggaaaccaaaagaagatgtgatgagcttaccagaaaaatgaggagagatgggtatgtgtgagctcctccattgaagcagattgattaaaacagcttaggaaagggcaaacttggatcacgagcagtggatttttttcatatctgatagtgaatttaactttttcatttctggcgaaattaaagagatctgtgaccaaaagtggtcaagcactggagtctgaggttttcaatgtgagtttaataacacaacttgtcttttaacttaggtggcctgccatgggtatccatggtgacaagagtcaacaagagcgtgactgggttctaaatggtaaatatttcaaatgaagtatttttcccccttacttaacctagctagaattctgctcagataattgatcatgtatatgccttcctttgtagaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcacataaaggtgctgtctttgtggcaaggcctaggcatgacaatcggaggactcgagggggatggaggactagtgatcggctggctgcttccagtcgattagagaggtgaaaaagctgaacgtgtgccagtaatcttcaaaaggcagaacatatcacctctgccccgtaaactgttctctccgagggaaaaaatggaagttatcctcacagttcactgccgtggtatttcttctgtcccatgctttgcatgactgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagctttaaaaggtactaagccttttacaaattggtgagtactggcacatgagatctagagcaggagcaacttctcacacatagtaagtgggaaaagaaagtgctttgaaagttcctccctcacctacacagtagtcgtcatgtcgagacctgccagagagagacacattctcaagtgaatcctggcttcttggaagcgcttgcctagacgagacacagtgcataaaaacaacttttgggggacaggtatgttttcttgcagctgcggttgtaaggtcttggcaagacaagcagtgtggccagaattttgaacttctgatgaatgtgtaatgcaaaggaccttgtacatttttttgtttcaaggtcctcaaaatgagcacatgaagaggttgctgtgaaactttaagtggccctactgcgcagaagcattcagatgtcacttgatgatctgtaagggaacttgctgatttgggaatgtgcttagggaacacacattccttttgacagggtctgtcactgggtgggtgatgaattatacagatgacatgtgcttttttttcttttttcaacctcaatggtattcctacaggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtaaggatgactgataggaaatgttggtagttacgagtcacatcgttgtctacaaatccatttaaatggtattggagggtgagtaaaaccttgaatgtgaaaacttaagctgaaaaattgtaaaaacatttcacgcctaccatgaatagatctgtttctttctgtccacaatgatttgtgtcatagacataattgatcaatttgcaattgttttcttgacaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgcttaagatggtctggttttttttttgtttttgtttggttttttttttccatgaaaacaaatgactgttcctttttatttaatttgggaggcagggggaatcagaaggcccttctttataatgagctattcatattgcaggagtcagaatgaattgatacaggtgaatttttagttacaggctaaattgcataaaagctttgtcagcttccagcatcaggggagtcatttaatagcctttttccttatttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttac

SEQ ID NO: 21147 - DNA, 1056 bp, Homo sapiens
gttaaacatgatgaaacgcatagatgcttttaataataaatgtgagtctcgatacagtggctcacgcctttaatcccagtgctttgggaggccgtggcagcaggatcacttgaggccaggggtttgagactagcctggtcaatatagtgagacctcatctctacaaaaaaaaagttgtttaaattaaaaaattagctgggtgtggtggtgtatgcctgcagtcctagctacttgggaaactgaggcaggagaatcgcctgagcccaggagtttgaggctgcagtggactatgatcacaccaccccaactccagcctgggtgacagatggagaccctgtctcttaaaaaatgaaagaacatctactttcatcagttataatttacttttattgagcaaaatttatgtaagagtgtgacaaggtttactctgatatgagtattttaaacctactatgcttttaggtaggaacctgtcttggaatgttaggaaaagggttattagaggtgctcaagatggccttttacagaggcaatatcttgacaggagaagtaggggttgaacaggctaattttgtgttgccattgtaatacaaaattattaataatttatattaatggctaacaccttagtagcacttactgtgtgacaagcattgttctttatactttacatatgttggtaaggccaggcatgtggctcatgctgtaatcccagcactttgggaggctgaggttggagaatcacttgagcctaggagttcaagaccaacctggccaacatgtgagtcctattctcttcaaaaaatttttttaaaattagctggtcatggtggtgcgcacctgtggtcccagctactcaggacaccgaggtgggaggatctcttgagctcaggaggtcgtggctgcagtgagctgtgatcgcgccactcattctagcttgggcaacagagtgagactcttgtctttaaaaagcaaacaaacaaaaacaccccaagttcgtaatttcatcctcagaaaaactctgtgagttagctactgccatttttacagatgagg

SEQ ID NO: 21148 - DNA, 1032 bp, Homo sapiens
tttggctatttttccatctctatctgtttatgacatagaatgtctccccagtatctcatctgttttgcttctctttgagctcaaatgtaatcttgagaatatacctttgtctagcaaagagaaaacataagttttggtataaaattaggcataataagcattatcaacctccagactctttgaaaatttctggaagttcctcctcaaatcttcccaatgttggccagcctctttctcagagccttttatacatcatttaaaattttttagttattagtattgtgacaatcttgatttgttttccattgcaacatatttagtatttaagccacgttataagtttagtttgtttatggatagctggcctgtggccctcatcatttgtaaaattgtttccaagagacagaacaaatgatttgtaaagcccttttttgataataaataaaatagattggtaatttggagatttttccctattagtatatcatcttagtgtatataactgtctttgatctggacactctgaatgtttttgttatcagtgtttattaattttacagaacagaggacaacgcaacaaggccaggtgtatttcttacatacacagactggtgtgagcacatggcatgatccaagagtgcccaggtaagaacgtattttaagcactctttagaccatcaaagagccatttcacctaggatttctttgatttttaagaaatttttaccttttaaaaatagtttatgtaaaagtttgactcttctgatagttacttcagttttaacgtttagtagaaagtcctgcctactgctctgcaatcccacctcagttctcccctccctcaccagttcctagccaccctcccctgcttccccttaaaaaaaagtggaataggcagggcatggtagctcatgcctgtaatcccagcactttgggaggccaaggtgggcagatcatgaggtcaagagatcgaaaccatcctggccaacatggtgaaaccccatctctactaaaaatacaaaaatgagctgg

SEQ ID NO: 21149 - DNA, 1045 bp, Homo sapiens
gaaaataaatataaaacctcccaactttgaaaagtctttgaagtggtagatgactacctaaccaacagtttgaccttgtgctcatcattcagcctcagcgtttgtgctcttctataatgaagtgagatgactagtttataacaaaggtagtgtgagaagcatacgaaatgaagtgagactgttttgtaaataggcactgtatagaaaggtaagatggtattgttactgataacggtaatctgaagttcaacctatgacataattttttagacatatatatttagaaataattttaaaggcatatttctgatcatatatttgtattgtctgtaattttggattatctgattggattgttgtaaatgactgagtcacttctatgtttgtataaaatgattacaatcttatataaaatcctagattataaagtttcatgtggaagataacatgagtcttctcctaatagaatacggaagtttctaatttaataccatcttgtgaatccttgtatatagtctgaacttgacttcctcttcttgccaaaagctcaccaaggttacttacatctttgccctcttaacagactatagataaaccactttggattgatgttgacatctaatgaccaacactgggaattgccacatctaagttttattttactcaagaatatattttaaaactcttctgcaaatgcatgattcttattttagttttaaatgtattttagctctttaatttgaaaaaacttgtccattaactgtgctatgactcaaaggttaacttttagcacaatcattaaattataggcttgagtgacagacagacttaggacctaggttcgtatcctggctttgccatgtaacaccgagcacattatttaacctctttgagcctcaattttatcctctatagaggaaaataacagcaccaaccatctaggtttgttgcaagaaatcagtgatatctaatttcatgtgaaatgctggcacagtgtctggcatagtaaattttaactgtcattatcagtgttcagacctgagaa

SEQ ID NO: 21150 - DNA, 1083 bp, Homo sapiens
acccatttttattatatctgagcacaaatgaatatgtacttgtgtcagtgttcaaggtttcacttgaacaccaatttccttctgactcatttaaccagtaaaattagcttgaatttctacatgtataaaaggatgattgttgttttaaatgttaatttttttttttttttggagatggagtcccgctctattgcctaggctagagtgcagtggtacgatctcggctcactgcaacctctgcccactgcaacctctgcctcctggattcaagcaattctcgtacctcagcctcccgagtagctgggactacaggcgcccgcccccacacccggctaatttttgtatttttagtagagatggggtttcgctgtgttggccaggctggtctcaaactcctgacctcaagtgatccgctcgcttcggtctcccaaagtgctgggattacaggtgtgagccaccataccctgccatgttaatttaagaatgaactcttgattatttttttattttgaaagatctgcaatagtagactggaagccccttaaagagacaaactgtcttctttccttttgtgatgtattgtcaaatgactgggtgacttttttagattgggaggtctgagggacctcttaggaggcaataataaactgatttgaatgacaaaaaagagccaggcctagggagagtaggagaaaagaatatgccagatggaaggaagagcaactgctctcaggtggaatgaccttggcaagttcaaggaacaggaagaatatgagtgtggctgaagcagagtgggagggagaatggtgggaagtcaggtctgagggagaggctatagctagatcaagcagtgttttgtaagccagtctcacatccacagatacgtatggattttatatcaaatgtcattaaagtcatttaaatacatagttgatgacatgcttatcatttgcatttctttggtgcttagagacttcaggtttgcttttactcagagttcttgaagtcattatacttgtattagtcattctgttttcagacatgataagtggttgttactgcagtatatatatattgtctaga

SEQ ID NO: 21151 - DNA, 1048 bp, Homo sapiens
gaacagaacttagtgagattattttgttatgaacccatcagagaggttttagttactgaaggtactttattttacaaggcagtgaattgggttcatagttagagaaccatcagagtagccacatagcaaagccctattgtggttatcccagggaagtatctataccagcgcaccccaccatttttggtaccaggaaccggtttcatggaatacagtttttccatagaccaggctgggggtggaggtggtttcaggatgattcaagtgcattacatttattgtgcactttattattattacattgtaatacataatgaactaattctacaactcaccatcatgtagaatcagtgggaaccctgagcttgttttcctgcaactagatggtcccatctgtgggtgatgggagacagtgacagatcatcaggcatgagagtctcataaggagctggccttgtgtgtgcggttcacaatagggttcgtgctcctatgagaatctaatgtcgccactgatctgataggaggcagagctcgggtggtaatgctcactcacctgccactcactcctgttgtgcggccgggttcctaacagaccctggaccaataccccacccatccatggcctgggggttggggattcctgatctacactacatcattactgataattcctgtcattcttagattgagaagggagcaaaaaaaaaaaaaaactcaaaaataaattcagtcatacaacactttcacatgtaagtgttccttctgtatttgatttgttatgttacataatgcttgccaactactgtctagtagtaacaatagttttactaggtatgaatttgcatttatataaatagcaaactttgttagacattagaagtatacctactggagtacaccacatagaaaacaaatgttttactcttaaatatgtgtatgcctgtatatatgtatttatttaaagctcttatgtgaatctggtgttcataataggaccattaataaagagagaggcaggctggactcaaacattatgattctttagttt

SEQ ID NO: 21152 - DNA, 1030 bp, Homo sapiens
ataaaaacctttaataagctttttctttaaatgagctactgagggagacatttggaaagaaaaagccatgaatggttacaagaattcatgtaaccattcatgaccccattcctcgggtcagagggctggtaacaacctattaaaaacttccacattatgaggtaacctctagattttggtagtttaaactgggactattttgagacagaaacgagaaaaaatatagttttggtatttaatgtagaagtaactttagtctttttttttaaaaaatggactattcatttatagctaaatgttaaacttttttaaaagaatggaataatcttttgtagcaaatggaatgcttgtataattaatcttctatcttaaatgtcaaattattaattttagaaaatcttttttcacaggacttcctgatccatttgctaaggtggtggttgatggatctgggcaatgccattctacagatactgtgaagaatacgcttgatccaaagtggaatcagcattatgacctgtaggtttcaacaattagtttgaaatggaacatatcattaaattatttgatatagtctttgaaaataatcatgggaaatgatctgggtttcatctgtggtataatttggtcatcacaaaaggggtaaagaaaagcccagtgggaatgtgctttggcttatagacaggttttgaaagatgaggtatctctaaaattctatgaagaagaaaatgaaactggctcacagtagagcaatcccccacctcttttttcaattaaataaaggtattaattcaccactttagaccaattataaaaccagaaataaggatttgggttgcactgaataggcttctttttgcctttatatggatggtttctttcttttaaattttattttaaaccattggagtatatgcacctttttaaaaaggcaaatgatacaataaagcttttactggaaaacagcaagttccctgctccattctcattcctgattcccatcctcaaggcaactgctttaataactttg

SEQ ID NO: 21153 - DNA, 1033 bp, Homo sapiens
ttgctgagaattgtaattgtcaggatgtcaggagggaatacagtgaaggttgctatggagatttctgacttgggtagtggagtggaaaggaaggctatttattgaaaagaaagtcaactggagggaggagcaggtttgcggggaagacgtgatttttggggggaacgcatatttggtttgtggacctggagttcaggagaaaactaaggatcgggttttatgaatttaggtatcatcataaccatagagtaaatggtaaagaccagagagaatatatggaaaagtggctcttcggattttattttttgagagagaggaagagttctgtcaatctattaagctatgaactctctcccaggaaaaatgtggattctctccccagaaaataaacatatatgtaacagtttacgtataattgcaagatttacaaaaatggacactgtgatcctcaggttacagagtgaaataagagaacctagggcaaaaccctgaagaacttcaagttttatagcacagcaagatctggcaaagagaacttagaatgagttttatgccgtgtagaaccaggtgaatgtggtgttaaacagaactggaagagagggtttctagaagagggagtagtcagcagtggcaaatgcccatgagggggtcaagtgccataaagaatgaaaaatgtccattgtatggacttggtaattaggtctccagggctttgtagcagcagttcagaggcaatggtgagggaggaagccagattgcagtggatcagggcattagtgggaggtaaagaagtagagtcaaaaagtgtaggcagttctttttaaaaatgttttaaaattatactttaagttctggggtacatgtgcagaacgtgcagttttgttacataggtatacatgtaccatggtggtttgttgcacccatcaacccatcatctacattaggtatttctcctaatgctatccctccctaacccccaacccgccaacaggccccagtgtgtgatgttcccctccatgtgtccatgtgttct

SEQ ID NO: 21154 - DNA, 1026 bp, Homo sapiens
gtgctgcttggctttagctgagcttttactttatttatttatttattttagaggcggagtctcactatattgcccaggctggtctctaactcttgggctcaagtgattctctcacctcagccttccaaagtgctaggattataggcgtaagccaccgcacccagcccttttttatttttaacatgtgaacttacaccagaagttgattattatgcttgttaagataagctttactttaaaattacctctgatcacgataagtaaaaaaaattataattgtgactagaataaaatctataattctgactagatttctttaaaatctgcatttattatgtcaaagtagatctattattgataaacttgcactcagtgtttagaaagcttatttgtatagtctcatcttgttttattaatgtaaaaagtacgcatgtttgtgagaactttaccaaaatcttcatctttgttgaaaaaaaatttttaagtagttacttaaaagttgtttgatatgagtggactagaaaggtcattttaaatttgttaactgaggctgggcgcagtggctcatgcctgtaattctaacagtctgggagactgaggtaggaggattgcttgagcctgggcaacatggcaagaccccatctctgcaaaaaaattttagacattagcaaggcatggtggtgtgcgcctgtagtcccaggtactcagaggttgagatgggaggatctcttgagcccagaaaatttaactggagtctgcagtgagtcgtgtttgcgccactccattccagcctaagtgacagagtgagatcatctcaaaaaaataaaaatataataaattttctgagaaccaattttgccttgttgaaatgtttaaatgctgatactgttcttaggataattacctcagaacctgtatcttttaatacatcatcaaacatactaattagattaactacttgccaggtactgaatatattaagttaaacttaagggcctagtttgttttgcagcatgaatgaaatga

SEQ ID NO: 21155 - DNA, 1078 bp, Homo sapiens
ctattgtgaatgagagagaaggctcagtgagatctgttattagataagtagttgggccctaaggaatgggtacgcagagtacttatgaatagttaaggaagccatcctgatttgaacataaagagttactaggttaggggaaacaaggagtgagctgcatgtatcctttaccttttagtttgcacatccttataactcgtcagtggttttctgaggattttatttgattcaacaagtatttgcatattatgtttaagatattatataataaactgtagaagaggtttatagcttaatgagacagaggtaagacatcacatgaataactttaacaagcaaaatgagaaagcactataataaaacaagtagaatccaagtgttggaggttcacgggaaggaagagatcaaaatcagactgaaaaaggagagtcagaaaaggcttcacagaagtttgatgaatggataagattttgagggccagtggttgggataataacatttaaggtgggaagaacattatgaataaaggcaaaggcagaaaagtcctgggcttatttgagggaagaggatgagcttgtcagtctaggggttaatgagagagaaaacaggaatcattgacactgcttgagtgaaggatttatagaaaaataggatggagcctgaattcacaatgcctaaactcttttcctaggtggcagttaggggtgagccaaaacattcacttacagtttttctgtggatattagataactcacaagctttaggggttaaagaaaacaatctatgtagaagttttttggcacattgtaaaatactctagatgtattatttaaatgtgaacactggaaatggagataagcagaggtatgtgataaccggctataatctggcaactgctttaggtatgtgaggtggtcagggagaggaagagagataaagacattgctttctggatgactggaaacgtggtgcagttcacagcactacggaggtcaaaaagaagagcaggttcactagggaagctgatgaattccattttgaaaaaatataatttgaagtgctggtgaggaatctaaat

SEQ ID NO: 21156 - DNA, 1034 bp, Homo sapiens
gccatagtacttattagacatgtatatgaatttggactataatgaataacataaaagattcaggagtcctgacaggatttgactcttttacttaacagacccccataacaaataccaaaaaggagatttatttcactatttgatagaaaatgtatacatagaatacttagtcagttgaggcagacccagtagtctaggacctccagcctttgaatctggtccaaacgtttgagttttctgagtattctcttaggacacaggtggactaacaatggaacatacacagaatagacccactctttttgtatcactcaaagaagagaccaaatttcctctccatgtctacccacaagaaaccagaaggcttcaaacaaacttgcgagacagcagaacaaactcataaagtcagcggaatcaccatcagaaggtgatggaaaccagggcttactatgttctcaggtgttggtggcttgttggcttcatcggatggctcagtcatatgatctgtgtgggacttccaaactgttaaagtacaaagactgttggagaccaaagattgtgtactgagtgaaaaaactttattgccaagcaggaagcctaatccagcacaaagtctaagcgcgctgtcagggatggagatcctttaaagccaaaagatcatgaactgtccttttccatattagaaaagccaaatttttgagtgttcttgattggttggtggtgatatctgggtttgttggatggtaagcagggaactggctggagatggtctatagcatacatgtggtatgaaattataacatctaactgcctctgttttgtatgtgatatacctgagttaggattatgtcacctgcttacatctgcattggccgcagcagactaggtgtccagattagggtttgtcagagtttagtagtcatttggatatgaggatgtggatattaggggagaggtctgcgtgtagttcagtagctatatactttgaaaagtggtctaatggagaaaactgtcagcttgactgggttttaatc

SEQ ID NO: 21157 - DNA, 1041 bp, Homo sapiens
agctcaccacaacctccgcctcccaggttcaagcgattctcctgcctcagcctcctgagtagctgggactacaggcgtgcaccaccatgcctggctaatttttgtatttttagtagagacagggtttcactgtgttggccaggctcgtttcgaactcctgaccttgtgatctgcccacctcgacctcccaaagtcctgggattacaggcgtgagccactgtgcccggcctcctttctcagttcttaaaggatgattacttttctagtacctgaattatttatggattcaacatccccccaggacagttctttcctctaccagtcataggaggtattgttagactttgaatgagttgtttaatttgaagagacatatggtttttaaaaaatttgtttagagttcttggacaatattctgttgtaattcatgtagataatttatttgccaatccactgacattcttcccactaatctatttctggttttaatccattaaaggaggctgaaaaggccatttagctctgcctctaggtctataaaaatattgcctaaaagtttctaaaatcttctgattacaaatgactgcttgcaatttaggattttggtgtaatctactttggtaagaaagacttcggggatggtgtgaagcagatacttttccttctacttgttttatcttagagacagggtctctctctgttgtccagggtggagtgcagtggtgtgatcacagctcactgcagcctcaaacttctgggctcaggctatccttttgccttagccttccaggtagctgggactacaggcaagcgccaccatgcctggctaattaaaaaaattttttttatagagacagggtctcactatgttgttcaagctggtctcaaactcctgggctaaagggatcctcccgccctgacctaccaaagtgctgggattataggtgtacacacacttttcttaaactttcttctgattagtgatacctgatctgcattagggttccaacctgttttttggaaccatcttcgaccttctta

SEQ ID NO: 21158 - DNA, 1040 bp, Homo sapiens
gttggtaagattattcagaattgtatgaatctaataccataaataaggttgatagagattttttacagttgaacttggggaattttgtagagaaagaaggatggaaaaaaaactataaggaaaagtaaaacggcatttgatagattcaaaataccatctctaacatagtgctgcatatgtagtacttcaataaattgtgtgtgtgtgtgtgttttgttttttgtttttgtttttgtttgaaacagggtctcactctgtcgctcaggcttatggctcactatagccttgaccacctgggctcaagtaatcctcctgcctctgcctcctgagtagctgagactataggtatgtggcaccatgctggtgtaatttttaaattttttgtagaaatggagtctcattatgttgcccaggctggtctcaaactcctggcttcaaacagtcctccagtcttgacctcccagaatgctggagttacatgtgtgagccatttgtgaattaaagaatgatgaaattgaaaacaggctttcgtgatctcagggacctcagttgaaacaaataagatctctctttgtgatgtcattattgaattaactaacatttataccttagtaatttcaacatcattaagttataaagatataggactgaagtgttcatttgttaatatttgacttgatggatagaactgttttaccacactgcaaattttgctgcttaacaaaatgaagatcactaacattcactggaataaaatctgttgctggattatcatctaagaaaagtcacatgtaagtagtctgtcaatgttaggaagataatttaacatttttttttagagttctatggttttaagatattctcatttattgtctcatttaattactattgagatcctgttttttttttttttttttttttttttttttttttaagagatagggtctcactgtgttgcccaggctggagtgcagtggcatgatcgtagctcacttacagcctggaactcctaggctcaagcagtcttcctgcttcagcct

SEQ ID NO: 21159 - DNA, 1049 bp, Homo sapiens
gccttctcctggctgggggtcccctgtgaggcatgaagggagtggggcaggggcccccgtccaggcctttgtgtctgtctaggggctgggccagagagaggaagcagaggtagcagaagggcctgcctgcagaatcctcccaacctcccccttcctttctcctcgttggcccagttaaatgtgtaaattactattccctccctataaaaatagcttaactccattacaaatatttgaataataggaggaaatctcaatcaaatgactgttagcatgttggtttcttcccatttattctgccttcttatgtgtatgtcttgggcagttcccatagagacatcacagcgtaatgacgattgtgccttctgctttttcacttaccatattcacctagtcagtgaatgtcagctgctgtactgggcactagggagcaatgaaaaataaaggatggttcctgccctcaggtagcttactgtccaggagaaattgaacagcagatccaattatgatatggtatggcatggtagttatggtatggcagatatgatatgatatgacatgatgcatctgcaaagagctgtggggggcatgttggaggagccatcctcccagaatcttgttcgcaagagggaaatccaagagtgcttcctggaggaggaaggtgttggcaaagatgaattcaaaaggtttctacagttccctctcatgaaaccctctggacctggtgcctttttcagtggcagattttttttctcatcagtggtaattagtttatttaagtttctactcaccttctagttaattttggccattttatattttactaggaaagcattcattttctccagatgtgtaaaatctccacttttaaaatttattatgaatttctttgtgaccaagtaaatgatttttctaagtttttcatagacatataagaaaaatgcatattttcttatttttatttttattttattttttttgagatggagtcttactctgttacccaggctggagtgcagtggcacagtcttggctcaccaaaacctcca

SEQ ID NO: 21160 - DNA, 1033 bp, Homo sapiens
ctggggcaggttcccaagcatcctctgacttggagtaacctcccacccccagtacccatgtaaacacacacagccaggccaggcaggttttgtaccaggggactttctgcaagtgtttcctctccatctctctggatggggcccgctggatccctgccgttggtgtggtggaaactagagccgcgttggcagctgagcccttgtcctctgctccccccgccacctctgaaatgggactgctgtacttaggacacgtctcggttgctctcatgtagcactgaaaccagacacttggatgtctgtccctcggccaaaccaggggccacaggagggcagaggccatatcctgtgcattactgtccccagcactgtccctggtatgtgactttggcaataatgacaacagcctgcatctctaggcatttaccaggtggacaagggtgcaggctcaggagccaggcccctgtgttcaaactccagctctcccacctactagatatgtgacctcaggcaagtgacttaacctctctgtttcctcttctcaaagttggggttgtgttagtaccagcctcacaggattattgtgaggatcaaatgaatgagtgcgtatgaagctcttagcccagttcctggtcccagatgtcagcacctatcctcctcatgattaattaattaattacatgtttactgtgagctctgcaccaagccaaatgctttcaataagttactcaatccagacaactccatttcccagagaggggaacccaaggttcagagagcttaagtaacatgtccaaggtccaaccagctagttagttaccttgaagaccgggtcccaagcaggctgaattgtgctcctaggccctgccccgcccaggcgggaggtgtctgcctggtgagcagcgccaggggaatgaaaataaacaacacgggctggcctgggtcttcgaaacttttctaaagaatcgcttgtgttttgtttgaaggctcaaccaccggaattatctcttggagtctccgcataggttccgtg

SEQ ID NO: 21161 - DNA, 1067 bp, Homo sapiens
atctcagctcactgcagcctctgcctcccgggttaaagtgattttcctgcgtcagcctccggagtagctgggactacaggcaccgccaccacgcccagctaatttttgtatttttagtagagacagggtttcaccatgttggccaggatggtcttgatctcttgaactcgtgaaaaaaatctgaattttatcaatagctgaaactctgggagtttagtctatatttcaagcacattttttctctatgcctttgatctatattcttcttatcctcagccaaaatgcaaatctctctgtttttgacattctcaggagctctcatttgtttcttaacttttcctcctctgctgttcacttccagttctttcagcacttttaatccttactgctcttacatcttcactactcaaagtttttactggtcatctatttctttgtaataaactaaccgtaaattaagtggcttaaaacaatgacaacgtttattttcataaagcagcaattttattttgattttgctctgatcatggtcattgggggggtattgcaaagacttgttgctagaattgtctaaagattgcttactcacaaatctggaagttgatgccagccattggcttagatgttagctgatgctatctgttggaagacttacatgctgactttctgcatggcattggcttccttatacctggtactaaattccacaacaagcttcaatagagacagtgagctgtattaacttttatgacttatcctcagaaatcctacactgtcattctctgtatattctatttgttggggattttatagaagcccattcaggataaaggggtggagaaaggtctggaagaccaatttcagttgaaaattttgttgaagcagttttttatagtctaccacagtgcacgttcttttttctctttcttcagcttgctatagaatcatagaaagctatgcattctaccatgtaccattcaccatgtgggtcattattacttcctctaagctaacaattgcatttatgaaactattgctttagacatattattaaaaatctgctcctt

SEQ ID NO: 21162 - DNA, 1060 bp, Homo sapiens
tggaaaggcatataaatgacacaaatacatggccacaatatgtattttctcaataatatttggggaaatgttctgggcatcaggtttcccgtctaactttccctgtaggaaacggatagtcattgaagtaattttgatttgggtgagttgttacacggatagcgaagttgtaagttctcttgccacttttcttgttctgcacctttcgagagtcattatgagaactgaacactagggggacccagtttccttacttatgcaacggcggctggcccagctgtacgctacgatcgccctcacttaggacacatgcaatataaacacaaatctgaaaacaagggcagcttctcttttctcaatgcaatgtatatttatagcagtgatcatttttgcatgtaacatgtctgaattccttaaataggtcattttaagtaatgtgcataaccattacaatttttcttttttgagacaggttctcactctttgccaaggctgtgtgcagtggtgccatctggactcattgcaacctctgccccctgggctcaagtgatcttcccacctcagcctctcgagtagctgggaccacaggcatgagccaccacacctggctaattttggtttcaccatgtggcccaggctggtcttgaactcctgagctcaagcaattcactcaccttggcttcctgaagtgctgggattatagggatgagccaccacacctggccaccgtttaaagatttaaaggcaatggtttctaaactctagttccttgtgagccccatatttgcaaacttgtgaaaataaggatcatgatttcttattttttattattattattatttttgagatggagtctcactctgttgcccaggcttgggtgcagtggcgcgatcttgactcactgcaacctccacctcccaggttcaagtgattcttctgcctcaccctcccaagtagctgggattacaggcgtgcaccaacatgcccggctaatttttgtatttttagtagagacaggatttcaccatgttggctgggctggtctcgaactcctgacctc

SEQ ID NO: 21163 - DNA, 1465 bp, Homo sapiens
ctaatgtgatgtgactaagccgtagcttctcagcctgcagttaaattgcagaaatgatagggcttacattagttttgtttttatttgatgttgaagatctttgagtcacactagaaacgaggagtatttttcatgtggcactaatgagttaattcataatatgattttttgagacaaagtctctgttgcccaggctggagtgcagtggcacgatcacagcccactgcagcctcgacctcctgggctcagatgatcctcccaccttagcctcccaagtagctgggactacaagtgcacaccaccatgcccggctaatttttttgtagatatggggttttgccatgatgcccaggctgatctcaaactcctaggctcaagtaatccttctgccttggcttcccaaagtgctgggattataagcatgagccaccatgccaggccaatattattccccaaaagaaggaaattgggtgtgaggtcctgctcctatggtcaccatgagatttttttgtttgttttggactcttgcccaggctggagtgcagtggcacgatcatggctcactgcaacctcagcctccctggtagctaggaccacaggtgtgcaccactatgcccagggaatttttaagttttttgtagagacagggtctcaccatgttgcccaagctgttctcaaactcctggcctcaagcagtcctcctatcccaaagtgctgaaattacaggcatgagccaccacgcctggccaccactagtttttgtaatgggagcaggttccatatgagatggaggaatggatttcatgattgtctttgtaatttcttaggtccccaagaaattgattggacatgaggaaaccactctaagtgtgaccactctaaagcattagcagtcagtcatttcactctagggagaaatcagagctgtatatggagaataggtaaagtccccaatatggatatgtatttttatatttgactgcttgtatttttttgttagatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggtaaatactggtaatgtgctagttttggttcggttttgcaatggttctgttgtcaggaatagtccgggctattggtctgattcagatgggccattttaggatcatttttgatattcattgcaatggtacaagttttgtagccaaacagacctagaacatttttttttaattcatatcaacaccgatgaa

SEQ ID NO: 21164 - DNA, 1047 bp, Homo sapiens
ttgttgtggggagcacaagtgggtcttgctatattgcccaggatattctcaaactcctggcttcgcaagcgatcctcctgcctcagcctcccaaagtgctgggattataggcatgacccaccatgtctgaccagtcttggcattttataataagcataatctatctgaaaatgtcacttaaaagatcattttgtttgcatatctattcactagtccagttagtagtccattaaaaattcgcattacttcgggattaataggtataaaacaagttttttcttttccaggattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcg

SEQ ID NO: 21165 - DNA, 1050 bp, Homo sapiens
gcagcattgtgaataacagcattgttttaaatcctgccttgatttttaaaatattttgaccttgatgataaatattagctgtcccgttcatgtattaccagaaagttgtgttgtagttttggaaaaatgctagactgacaaggaagaaccagttacattgcataaggaagtgtgccatcacagagtagccagagacttgtgtgaccagcagcttctgtttgttcagggtcttagagttcactgaccaagagtgcagagaagagctcatttgatccttgcaacaaccctccctcccaggtatatagaccaagtgtgatcacctccatttcacagacagaggtgctgacactcagagtaagtgactagtttgagttcttgggtcaataagtaagaaattaattatagtagagaaaggatttttcacacatgtaatatagcagcaatgaaaacatagaagttttaagtcatgagtggggttgcacagtaaaagaacttttagaataggttagagagaggtgggcagaacttggaactgggaagtgatccttgtgaattggcactggaatcagatcccattgccttttttttttttttttttttttttaagacaaagtcttgctctgtcacccaggctggagtgcagtggcatgatctcagctcactgcaagctccacctcctgggttcacaccactctcctgcctcagcctcccaagtagctgggactacaggcgcccgccaccacacctggctaatttttttgtatttttagtagagatggggtttcactgtgttagccaggatggtctcaatctcctgacctcgtgatctgcccgtctcggcctcccaaagtgctggaattacaagcgtgagccatcgcgcccagcccccattgcttttaatagaggagcaaggagcagtgtggagaaggtagatacgcagacaggaagatcactctggctagaaccaagagtggctgatagtggggagtaagattgcaggtggatatatagcagtgagggtgggtaagaacaattgataagacttcagct

SEQ ID NO: 21166 - DNA, 1051 bp, Homo sapiens
gatattgagtgaagagtatgattaccgagagttgggaagttgcagtggaggtaggggaaaaataagaatcaggatacattaaattcttggttctgccactgaaacagttttgttggctaagccacctaacttccctgacccttaggcttctcatctgtaaaatggagcataaggttacttgttctccaagctgtcttccaacttaaaatttatctttgctccctgtataatagtaagaaccccagaaggagaggtggaagcagaggcgtgtgggggaaatggtgttaggcagaggaggtaggaatatgcacagaattttccagaagcatggggagatgagcatggagcttgtttcatagggaaaagtaggagataatgttggagatagtcagttgggactagctggagacttcaaacacgagacatgctaactgcatagctaattcagcattttatcagatactattatatttctcctgttttaggtagttcttggtaaatactttttgactcagcagcacaactgaacagtatccttgatccttcagtgttcaccaagtttttcccaacatccttatgtttctcattcaggtgaacttctcagtattatatcagtaactctgcctcctttttttttctttttctttttctttttgtttctacctcctttttaagaaacaaaatccatagtattcctctttaaggaaactgtcacctacttggggaaggctagattctagagactgcatgtagaggctgtagctctctggaaggtgtgtaggtgggggaagtggaggctgcagattggaagaagaaggtggtgtggagctgaagagtaaagtagggaggcaggaattagagatagtttgatctgtattccttgactttcatctttcttggtgacctgaaagttgcttaaggttgtggcgctatcatcctagtgttgaggccaagacaagtgatctgcagtcatacctctcatgacacatgaaacagtcttcttaggctcaagtatttcatgaaatgccctaagtaccagtgagctaattac

SEQ ID NO: 21167 - DNA, 1023 bp, Homo sapiens
gcattttgggaggctgagacgggaggattgcttgaggccaggagtgcaagatcagcctgggcaacaaagtgagacctccatttctacaaaaaataaaaataggagctagatgctgtggtgtgtgcctgtagtcctagctactcaggaggttgaggtgagaagatagcttgtacccaggagcttgagtttgcagtgagcaattatcaagccactgcactccagcctcggtgacagagcaagaacctctctcaaaaataaataggctgcacatggtgactcgcgcctgtaatcccagcactttgggaggctgagctgggaggattgcttgagcccaagagtttgagaccagcctgggcaacatggctggtctcaagccagatgaacacctcatccctattttttttttcttcttctaaaaaaaaaaaaaaaaacaggatacgtgtgcagaacatgcagacttgttacataggtatatgtgtgccatggtggtttgcttcaccgattgatccatcctctgagttccctcccctcaccccccactccccaacaggccccggtgtgtgatatttacctctctgtgtccatgtgctctcattgttcaactcccacttatgagtgagaacatgtggtatttggttttctattcctgtgttagtttgctgaggatactggcttccagtttcatccatgtccctgctatgacatgatctcattcctttttgtggctgcatagtattccatggtgtatatgtgccatattttcttcatccagtctgtcactgatgggcatttgggttggttccatgtcttcgctattataaatagtgctgcaatgaacatatgtgtgcatatgtctttatagtagaatgatttatattcctttgggtatgtacccagtaatggtattgctggattaaatggtatttctggttctagatccttgaggaattgccatactgtcttccacaatggttgaactaatttacagtcccaccaacagcgtaaaagagttcctatttctcc

SEQ ID NO: 21168 - DNA, 1028 bp, Homo sapiens
ggctttgcagaccgcacctgtgcatgtatggacatcagtttggtgggaggggagtatgacaagggtatggtgctgattaaggaggatgacatggtcatctgggtagggtaaagcttagagctttgaaagttgggaggatattgtaacagaagaaaaactaaaggacagtagaagattaggatgaatgaatatttatagattccttgagtttaaaaaaccttcttctggttgtcatcatctggttgtccctgtgggaacagttgcttggctggtccagaaacccaggtatcctgtctgcagaaccaacagctgggagacaaggtggcattagaagggtctgtgtttaggtattcattgtttttggaggaaaaggcattgcaagtgggggtgagaaagccagaaatctctaaagagccacagtgtgtaatgttccgcattgttttgtttttaaatggacatcgtttattcagtaagtgtgggtggagtgttagatactctgtgttagatactgaggaccctaagtaggggctctctccaaagtagtgtctgatctggatctttggcagacagcctttgatttttgaaagtaacccaagacattggcgtggtccgatgaggtcagaaggcccttagtcaaggtaacattttgaattttaggtcatttgaagtcaagtcatggcaatctctgtggatggacagcagtgatcctcagtgagtctcatgaggagggatgtgtagctgtggcctgggtatccctgtctccggctgtcctttgaggttttggttcaggagacccagagtggagcctggggataggggatgggtaaaattccccaaaggcttctcacccaacacccggttgagattcattgttccagaaatggtcttgaaagcttttcaatgttttggagtcagaatttcgcctgctaaaggaacaattttgaaaggcaaacccattgaaccgtgtaagttctggcacacttatttagagtttgttccttttagcttcctaaaactggaccatctat

SEQ ID NO: 21169 - DNA, 1103 bp, Homo sapiens
cgtggtggtgggcacctgtagtcccagctactggggaggctgaggcaggagaatgctatgaacccgggaggcggagcttgcagtgagccgagatcgcaccactgcactccagcctaggcgacagtgagactccgtctcaaaaaaaaaaaaaaaagaaagaaagaaaaacccagcacctcatatatgcaatacaaacagcctcgcccgggctgcatgcagacacgtggtagcaaatacttcgagagaggttcactgtggcttcctacctctgtgcatcccctcctttgtcccctttggacctggtcttgggtgccccctggggcccatcttacagctcttgggagaaggaacaagaattatagaacaaggccgggtgtggtggttcatacctataatcccagcactttgggaggctgaggtaggtggatcacctgaggtcaggagttcaagaccagcctggccaacatggtgaaactccatctctactgaaaatacaaaaattagccaggcatggtagcacaggcctgtaatcccagctactccggaggctgaggcaggagaattgcttgaatccaggaggcagagatcacagtgagctgagatcgcgccattgcactccagcctgggcaacaagagcgaaactccatctcaaaaaaaaaaaaaaaaaaattatagaacacatcaatgcagcgtttggcaccagaggaaggcctggagggtagtggtgatgggggcacctagcaaagctgggggctgtgatgctgtacagggttcagggctcctgaattcaaagaacacgtgaccatttgcaagtacctagaagtccccactgtcatcacagcaagacttgagcatgggagtgggcacattctgatggagactcaccaggggtcacctggctgcagccgctacccctagctgaagacttgcaatgagcagtgaaaagattaaatgtgcgccaagacctttacgggccttgggaagccatttgtgccagaaagctgagcacttacatctttcagaaactaaatgtactggctagactatttccattcaaacctcaccttaaatctgtcatatttcattcccactttatagggaag

SEQ ID NO: 21170 - DNA, 1048 bp, Homo sapiens
tagtgaaaccccatctctactcaaaaatacaaaaaattagccaggtgtggtggcaggcacctgtaatcccagctactcgggaggctgaagcaggagaatcgcttgaacccaggaggtggaggttgcagtgagctgagattgcaccattgcactctagcccaggcggcagagcgagactccatctcaaaaaaaaaaccagaagagtccatactcctcccatttttctcctcggtccctctctcccacttcatcctgggcctcttctgttcagcaatccacatttcaggcaaataggaagaaagtccgctaatagacaggtaagcgtggttgtgtgcattttatccaggaggaagaacatttgaggccattctgctgtgcctttcaagtccgcagatctggccaagagcctgagatagcaggaagtgtgaagaacagaaacttcaagggaagaagtgtgtgaggggatggaaatgctagaggcttatagggccaggaaagttatcactcctatctgtctgtactcactcacaaaagtcccctcgctcaggaaatggactcccggttctatcaaactcattatatattttcttccactttcttgtccggtatttccaggctgctggtgtcctggtttgggtgtgtctgagcatctgtgtgtgtgtgagcatatgcatgtgtgtgtgcacacgtgtgtgagtgtctgcgtgtgagagagagaaagagagagagaggctgggcgcagtggctcacagttgtaatcccagcactttgggaggccgaggtgagcagatcacttgaggcctgcagttcaagaccagcctggccaagatggtgaaaacccgtctctactaaaaatatgaaaattagctggatgtggtggcgggcgcctgtaatcccagctactctggaggctgaggcaagagaattgcttgaacccggaaggcagaggttgctgtaagccaacatcgtgccactgcactccagcctgggcgacagagtgaaacaacatcaaaaaaaaaaaaaaaaagagagagagagacagagagag

SEQ ID NO: 21171 - DNA, 1017 bp, Homo sapiens
cccgagaatcgcttgaacccgggaggcggaggctgcagtgagctgagatcgtgccactgtactccagcctgggcaactgagcgagactccatctcaaaaaaaaaaaaaaaaaaaagaaagaaagaaagaaaagagaaacactgtggccaactgtgcctggattatcagagatcatagagagtgttccctgaagaagggcaggtaatgtgtagcggtgtgtaacatagactctccttgatcacagataggctatgcattcatttgatttgttcttggaaaattctgatgattagctgggcatggtggtgtgcacctgtcatcccagcttacttgggaggtttgaggtgggaggattacttgagcccaggagttcaaggctgccaagagccatgatcacaccactgcactccagcctggatgacacagcgagcccctgcctcaaaattaagaataaaaataaataaaataaaattatggcgaatattcaatgtagcctgatacagggaaatgatatgatttgttccacaatccaatccaaaaactttgaaaatcatctgctaatttagatttttttttttgagacaaggtcttgctttgttgccaaggctggagtgcagtagtgcaatttcggctcactgcaacctccacctccccggttcaagcgattctcctgcctcagcctcccaagtagctgggatcacaggtgtatgccaccacacacagctaatttttgtatttttactagagacggggtttcaccatgttggccaggctggtctcaaactcctgacctcaggtgatccacccgcctcagcctcccagtgctggtaactcatgtctataatgagccgctatgcctggccactaatgtagatattatacaaggcagcctacatcctcttagagaagagagaacttggtggtaactgaaaacatctgtagtatggcctgtccttgcccccagagaggctgcatggacagtgccctctgcactgtcttccccagagctcctgtcag

SEQ ID NO: 21172 - DNA, 1086 bp, Homo sapiens
tgttacagggaagagaaaactcaggtcagaaaggtaggcctatttatacaccttccagaagcccatggctgagcagaccctcttagattgcagtacagagcagattttggacactctgtacaagaactcttgtctgcgtcgctgttagccatagagtagacccaggaggaagaaacattctctgaatttggctagaactcccttccgtcaaatctgacccaagtctgtgtggtttagaaagccccttcatccccctttgagggaagctgccggactcctttggctattttgtttctaccttaagagtgcgggccaggcgtggtgcctcacgcctgtaaccccagcactttgggaggccaaggcgggcagatcacgaggtcaagagatcaagaccatcctgaccaacatggtgaaaccccgtctctactaaaaatacaaaaattagccgggcttggtggcacacacctgtagtcctagctgctcgggaggctgaggcaggagaatcacctgaacccaggaggtggaggttgcagtgagccaagattgcaccactgcactccagcctggcaagagagtgagactgcatctcaaaaaaaaaaaaaaaaggagtatgcaaagtttgccttgcacagttggtatttgtaacccagcctgaacctaataaaacatgcgcctgtagttgggtttgtttgacagctccaggcctgagtctctgttggtctctttttttgtgttacaaattcaggttcccaaagatgtatactaagtctaagataagctgagaaatctcagctagatgtatagcttagactgggagaccagtgtgttcaaccattctatctcagggatgtagagaggaggtcagcgaattttttctataaagcgccagatagcaaatgttttcagcctcaggccatatgctgtctgttgcaactactcaattctgcagttgcagtgcaaatgcagtcatcgaccatgtatatctgcattgcagtacaattttattcacagaaacagacagcagacaggctttggcccacaggtgaagcttgcagtggattgatttcctcatttgcatgcttttaa

SEQ ID NO: 21173 - DNA, 1032 bp, Homo sapiens
gtctgccccgccccccccgcccactaccacagtgctttgtacaaagcaggcattcaactgcatgatcagtaaatacagtagtaatacattccataaggttttagaccctgagttggctgacaatcagattcataattctgaagtagtatctacttagttttcattaatccttaaaactgctaaatttttggttcggtgtatactgacctttttagtgaagcttgtgaaaaactgattgtagcatatgtgaaaattaatatgtaatatgtattgattgatggtagcatctgtgaaaattaagttggttaattgttgcaggctctatttctctgtgagctgtgatattttggagcttctaagtctagaggaaggtggggttaaggtgaagcctgaagaatgcatgatgggttttaaaagttgacacttgttgttattcagtttttaaataggggacaaagaataataaatgtgtttgcatttgtgtatattaatatactgccagtaaatagaaaagttcttgagaatttcaattatgagggtttttttttttagttacaactgagttataaaaatatacagaaagtaacaggacccaaacagtgagttgaaatcctgcctgttgggaaattctagctatgatacctatataactattagggtataattagagggtattttgaaaatgacagaacacaaaagtttcagaccctcttttaagcatcagttaaaaaaaaaacaacaacaacaacaaaaacaaaaaaacctcaaagaacatatgccccactgaagggacaaacaggttatttttaaaaagagaaggcacttattcagcaaacatttattcagcacctactatgtgccaggagccattagccttcgactgtaagataaataagagagtctttttcctgaaggagctcatagccaagtagaagagattcccaaggttaatttgcattgacttcttaccccagcataattctatttttctctctttttttttttttttttcaagacgaagtctcgctctgt

SEQ ID NO: 21174 - DNA, 1029 bp, Homo sapiens
agaaatcgaatttcagtagcccgtgtccttaatagaaaccaagtcaagtgctcaggagaagcacagcttttcctagcactgacaccagagaggaatttcagctgtaggaccctcatgaagggtgcactgtataagtgcttctcacacctgaatgtgcctgcaggtcacctgggaattttgttaagatgtaggctctgatgctgtcagtctggggtagggctcaagatcctacaacgctgctggctctcagagcaggcgttgagtagcaagtatatatgccatgcttaggggtctgaaattattctgtagatagagcagaactactgatgatttttcagcagaggatctcagtcaggtttgttttggaaagatcattggtagcaatgtagaagacattgcagagcaaagaaagatcagtggaagaaaaactgtaagatgtagctgatgttcttaagaatattcttaaaggaaaagcagtatcaagtttctcagagctattttgtataatgccgctcaatgtggactgatggcacacacctaaagcacatgcttccacctggaaccagatgatggttttatccatgaattaaaatttgaatattgatatggttttgcagtgtccctgcccaaatctcatcttgaattgtagctcctataattcccacgtgttgtgggagggacccagtgggagataattgaatcatgggggcagttcccccatacggttctcatggtagtgaataagtctcacgagatccgatggtttcataaggggaaacccctttcacttggctctcattctctctcttttctgcctccatgtaagatgtcccttgctcttccgccgtgattgtgaggctgccccagccatgtggaactgtgagtcaattaaacctctttcctttataaattatccagtctcaggtatgtctttatcagcagtgtgaaaccagactgatacaaatatctaagaattgttgtaacatatatattgcaaatctttattaatgttagttaattaaagtaatc

SEQ ID NO: 21175 - DNA, 1034 bp, Homo sapiens
ttgttataaattttctaaatatttttgctggtaggatggtgcggagttttaccaggctggccataactggattcatagtgttacatgaaaggggactccatccagaccccaagagagggttcttggatctcgcgcaagaaagaattcagggttgagtccgcaaagtaaaagcaaatttatcaaggaaatagaagaataaaagaatggttactccatagacagagcagcccctagggttgctggttgcccacttttatggttatttcttgattacatgctaaacaaggggtggattattcatgcctcccctttttagacaatatagggtaacttcctggcattgccttggcatttgtaaactgtcagggtgccagtgggagtgtagcagcaaggacgaccagaggtcactcttatcaccatcttggttttggtgggttttggctggcttctttactgcaacttgttttatcagcaaggtctgtatgacctgtatcttgtgcctacctcctctctcattctgtgacttcgactgccttaacctcctgggaatgtagctcagtaggtctccgcctcattttacccatcccctattcaagatggagttgctctggttcatacgcctctgacaatagtgttccaagaaggttcaaatagatgcctacaaagcttttgaatagaaagtagtagtgcataattatctgagctttatgccatgtttctaggatctgggaagcattcttgctttctttcagcctaaaacaactattttattcagaaacttatgctattatattttaaagatatttgaagattttaaagacatagctattatattttaaagctatcatagtaagatctgggcttgccttaaatataaatattttagacaaatctcctaattttcttctctccaaatcactttcctggaaatcatgaatgcctgaaccttcaccattaatgataggaaatggaaaatgaaggaatgaaggactttttaaaaattgaggcataatgcaaagaaaagggtagcacat

SEQ ID NO: 21176 - DNA, 1049 bp, Homo sapiens
gatgcatctatgtccagaagctaccattgtaatcagtggacatctcaacaatccctttgcagatgaatatcaacaagttgtgtccgggcttgggtggtgagtgtatgactccagatgttatgctgctccagcagaaccagtcactcttgtggaagccaaggaatgggaacagaagaatatgaaatctgtggtactgatcatcagtcttaatatccaaatgaatatcatggtacataccatgatggctatcaaagatgggttttgttgttgttgttgttgttgttgttgttgtttttgagacagagtcttactccatcactcaggctggtgtgcagtggcacaatcacagcttactccatcctcgacttccccaggctcaggtgttcctcctacctcaggctcccaagcagctggaactacaggtgtgcaccaccaagcccagctaattttttttcttgtctttttttttttttttttttttgtagagatggggttttaccatattgccaaggctgctcttgaactcctggactcaatcagtccacccacctcagcttcccaaagtgctgggattacaggcgtgagccaccatgcccaacccaagatattattaatataatgaatgaccaaggcaccaatattaaagacacatacatttttacaatattcgactttaactgatattttcaaactgtatgaggtgtttgaggcatttttgtttttgttttgcttttagagtcagggtcaatcagagctcactgcagccttgaattcctcagctcaagggatcttcccgcttcagtgaggttttttaaaaaatagagtttagtatctgatttctacgtagaagaaatttaaatgtttatattgcttaagtattgtttgctaatttttaaagtaatgatcaatgagtacaaaagaaaaataccctcatatacagagttgatgtattatcctacctgcaacagatgagccccaggccattctctcagttcattcggcaggctgcagtggttgattttgcacaaagaactgtgctaatcttataa

SEQ ID NO: 21177 - DNA, 1051 bp, Homo sapiens
acacatttataatcaatcaatttttgacaaaaatgtgctaagataatgaatgggggaaggatagtctttccacaaatagttctgaacaattgggtattcacatggagataaagaagacctcaacttttacctcacagttacacaaaagttaccttgaaattaattgtagacctcaacataaatgctgcaagtataaaacccttggaagaaacatagggcaccttagtgatgttgatttagacaaacatttcttcaattggactcagaaattatgaactatggaagaaaaaattgataaattagaaatcatcagaaataaaacttttactcttcagaagacactcttaagaaaataaaaagacaaactagtcttggagaaaatatttgcaaaatatatacctgaaaaagtatttttatacagcatatataaagaactcaataagaagaaaacatacttttaaaaatcagaaaatggtttaataggctcttcaccacagaagatagactgtggtaactgaaattttaactatgttggtagggcactgagtttgtttaaactaaaccatgaaaactgaaatttgtgccaattggaactgcctttatttagcaaacataatcacacaactactttcaaagtttattaattttataggtttgcaattcctctgagggtttgacaggggacacatcctgtgctatctttggggagagcaccactctgtgttggacatccagtattaaacactccttgccttaattatccttactaataatacaaatggccaacatttattgcactgtgtcaagcattgttgtaaaggtttattgtctcctcactacatctctgtaaattaagtgcttttattctttttggatgcttaaatcgtttgaataatttggagagacaagattcaaacagtttgacaccagaacctatgcttttaaccactcactccattatccacatggtaacaatatgcctgatgactgtgttgaaaagggaaatagagaaagctatgagagcatacagagcagacagcttggttttggg

SEQ ID NO: 21178 - DNA, 1023 bp, Homo sapiens
tagccctgtagtatagtttgaagttgagtaaggtgattcttccagctttgttctctttactttggattgcttggggtattcaggctctgttttggtttcatatgaatattgaaatagttttttctaattgtgtgaaaaatatcattggcagtttggtaggtatagcattgaatttataaattgctttggccattttaatgatattggttcttccaatccatgagcatgggatgtttttccatttgtttgtgtcttctctcatttcttcaagcactcttttgtaattttcattgtagagactttttacctccgtggttagctgtattcctaggtatattatgtattttattctttttgtggcattgtgaatggattgctttctgattgggctcttggcttggctgttgttggtgtacaggaatactagtgattttagtacattgattttacatcctaaaattttgctgaagttttttatcagctgaaggagctttggggccaaaactgtggggttttctagatatagaatcatgtctgcaaacagagaaagtttgacttcctcttttcttattcggatgtcctttatttctgtctcttgcctgattgctctggctaggacttccaatacagtggtgaataggagtggtgagagggaattcttgtcttgttttgtttttcaagggaaatgcttctggcttttacccattcagcataatattggtggtgggtttgttatagatggctcttattattttgaggtatggtcctttaatgcctggtttatcgagagtttttaacatgaaggggtgttgaattttattgaaagcctttttttgcatctactgagataatcatgtggtttttgtctttagttctgtttatgtgatgaattgcattcattgatttgtgtaggttgaaccaaccttgcattctggggatgacgtctacttgatcgtggtggattagctttttgatgtgctgctggattcagtttgccagtattttgttgaggatttttgcaac

SEQ ID NO: 21179 - DNA, 1091 bp, Homo sapiens
ttgcttgtgcttttgaagtcttaccaaaaaaaatctttgcctagaccaatatcttcttcaagtagtttcatactctcaggtcttacatttaagtcttcaatccatgttgattcaatttttgtatatggtgagagatagggtcctggtttcattcttctaaatatgggtatccagttttgccagtactgtttattgaagggactgtcctttctccaaggtatgttcttggcacctttgtcaaaaatgagttagctgtaaaggtgtggtgggttctctattctgttccattggtcagtgtgtatatttctctgccagtaccatgctgttttggttatgatagctttgcagtatattttgaagcctgatggtgcaattcctctagctttataacttttgcacaagatcactttggctatttggggtcttctgtggttccatacaaattttagaattgttttttatatttctctgaagaatctcattggtgttttgatacagattgcaatcaacccgtagattgttatgggtagtgtgggcattttatcattgttaattcttccaatccatgagcatggagtatctttccatttttgtgttctctttaatttctttgatcagtgttttaagttttcagtgtagaaacttttactacttttggttaaatttattcctagattttttttatcgctgctgtaaataggattgctttcttgattttttttcatgattgttcactgttggtgtatagaattgctacagatttttgcatgttgattttatgtcctgcaaccttactgaatttgtttactggttctaacattattttggtggagtctttaggtttttcttaatatatgatcatgttgtctgtgaataaggataatttgacttcttcctttctaatttggatgccccttatttttttctcttgcctaattgctctgactaggactcccaatactatctgtgttgaatagaaatggtgaaagtgagcatccttgtttaatttcagattttagagaaaaggctctcaatttttcccttttcactatgatgttagctctgggtttgtcatatatggcctttactgt

SEQ ID NO: 21180 - DNA, 1072 bp, Homo sapiens
cagtggccttgagagtgagtgggactgttaaagcaagggggaaagaggcagggagggagggagagagagggcaactgtgaaggaagaacttaggggtacagctccatttgagaggccagggaggaaacagttgaagaagggtcacgaaggtagaaggaacatgagaagaatgcatttttatggaaatagaggaaaagactatttggaaagggggattgtcaagaatgtgacccaaactcaggaaggatgagggttgaagaaaggtcactggatgtgaaaccacaaagtcattgatgatcttggacagtgcgctgaaaatgattgtgtgcccagaaacagggtttcaaaagataagtctggaagtggaagtgagggaacatcctgttgtttgggaaaatacgatgttaaaagaaagatgtagttccaaagagcagcaggagttaaagagaatatattttggggctgaacatgggttgagcattttgaagtacacaaagggactaatggagaggaacagcttaatgacgtgaagaatcagagatcattgatggcttgtgatctgtgaggtggtgcaggtgggaatggcatccccagcacagacgcagcacaggcctacctcagccctcggctacaaggctgcaagggtccattggtcttttcccagaatgtgccacactctcccctgcctccaggtctttgcagctgctgtcaccctcttccagaatgcttctccacatgattttttcaatggccaacctccttgacatcattctacactcctcagagcatccttccccgaccttttcatccaaagtctggcctacctatgccacctttttttgtcccattgtcttcatagctcatagcattacctgaaatcatccttttatttgttcgcttgtttcctcccacccactagaacataagctctgttagcaggaccttgtctagcttgtttacttctgtaccaccagtgcctagaaaacccagctcggggcaggtgccctccgggtatgacatgaatgagtgacaggaggcatgaccttcaccaatggaggaaggaagtcaagca

SEQ ID NO: 21181 - DNA, 1070 bp, Homo sapiens
taggaaaaaggactgtaaataggcaggagtgagcctgacttcttggcagaacagcagggaaagtggtgtgtctggaaatgatgagtgagaagaagagggaaagtgatgaggccagagaagaaacctcagggtgtgggtccaggtcacgtaggtctgagtaggccagtgagagggctttgctttgactctctatgagtagaggaagttggcagattttgagcataggagtgacatgatttgactcacacttgaataggatgtcatcatctgctgtgctgagaatagactgaattgatggcaaaggaggaagtagagagaacagttaaaacgctgttgcaaaaatatagaggaaaggtaatagagagctgggtctagccaatagcaatgaaggtagtaaaacctgatcagatttgggatatgttctgaaggtagacctgacagcattcactgttggttcgtggaatatgctggggggtgggaagtagggtggaacagtcacgggcagcaccaaggctattttcccaagccagtggacagatggaattcctctttgccgaaaggaagaagactacaagaccaataggttgggcctctcgggacatgttcaggctaagtgggatgttagtgataattccctcacagcaggataaaataataatgtctcgatgctaaaatatacagttcaggaattagggaaatattcttttttttttttttttttttttttgagacagagtctcactctgtcgcccaggctggagtgcagtggcatgatctcggctcactgcaacttccggcacctgggttcaagcaactctcctgcctcagcctcctgagtagctgggattataggcacccgccagcacgtctggctaatttttgtatttttagtagagatggggttttaccatgttggccaggatggtctcaaactcctgacttcggacaatccacccaactcgacctcccaaagtactgggattacaggcgtaagccaccgcgccaggccaggaaatattcttatatggtatagtctcagactttgacaatagcagataaaagagagactg

SEQ ID NO: 21182 - DNA, 1035 bp, Homo sapiens
cgtgctctcagaagcctgaatgaagcagttctgataatgcctgaccaaaggttagtcacttccatactgtatcactaactaattgtgtttgtgaccagctgaagaatgtcgaggaaggtggaagaatggcgtcagggctccagttattagggtccttgccctttcactgtgggaagaaatttccagtgatgaggaagtcaggagcttggactgcttctcttgaaatctaatccacatcttgaaaattctgcttccttgctacatcgtgggtataaacaaggctacagctcttctgaaagggacacttaggcacattaacatagacaacccagcatcttaaaatatgactcgaagaggtaatggatagttaggtggacacatggagtggcaaactgcccgaggatcaaaaatctgaaagatctgaaacctgtgtcaaatccagagttcccaggaggcactcactttttttttttttttgaggagtctcactctgtcgcccaggctggagtgtagtggcgcaatcttggctcactgcaacctctgcctcccgggttcaagcgattctcctgcctcagcctcccgagtagctgggactacaggtgcgtgccccctgtcaagctaatttttgtatttttagtagagacggggtttcaccatgttggccaggttggtctcgatctcttcacctcatgatctgcttgccttggcctcccaaagtgctgggattacaggcgtgagccactgtgcctggccgtggaggcactcatctttctaggaacacctctgcctcagactgtgctgaattaaaacctcctaatagtctgtcttctaccattttgtttcttttttttttctttttttttttgagacagagtcttgctctgtcacccaggctggaatgcagtggcgctcactgcaagctccacctcccagattcacgccattctcctgcctcggtctcccgagtagctgggactacaggcacccgccactgcacccggctaattttttttttgtatttttagtagagacggg

SEQ ID NO: 21183 - DNA, 1023 bp, Homo sapiens
acattcagacgtttaactgatgttgagcactggccacatgtgtccatactctggtcagaggtgtgagctagccccagcctcagagcacgtcttcacacctcacaattacaaggtggttcattgcctctgtcagttatgttctaactctaaatcaaggaacttagcagacaaggaactcagaaagcagacaatgctaccttctttagaagagaccatgagcctaacttagaaaggtctttgatagtaaatagtcatcacattttacaagaaagaagtcatagcttgcacagtcagttgaattaatggaaactgccttcagcacattgtctgcctccataagatagccccccccattttttaaatttgatgtttgttggtttttaacctgtttttaatacatatgttcttgaaaatagtatttgctcatagtaacagaaatcgtgatgatatccattatcatgactttatctcatattttaaagaagtccctgtctccatagtaagatgagaaaaaataaggtaagattggaaatcaagaaacagaactattgttattataggtcatctaaataatagtttgacagttcctaaatctattaacaattaggcaaaataactagatataaaatcaattctgtatacaaaatcaactgtatttttatacatgagtaacaatatacaacatattttttaaaaaataccgtttacaatagcacaaaaccacaaggttcccagaaataaatctaacaaaatatgtgggcttctaaagtttcattattgatgtgacttggtacaggttcctttccatgtctggaaaattcccctggatgatttctttgataatttttctatcctagctttgttgttgtttattgtcttttctgggcttctgtcagttgtatattgaacctcctggatttgcctgcatgactttttttttttttttgcaaattttttttttcattttgtcttttcactcaatgtttttttagatttgctttcccttatgtgctggaatcatat

SEQ ID NO: 21184 - DNA, 1029 bp, Homo sapiens
taactcatgaatgcattccaaaattcaaaatggataaatatatacagtaaaatggatacctgaatagataattcctgaacagtattaaaacttaaatgaataatgatatatggtaaaaaaaaaagatcatcttaaagatgaaattgaatcttctttcattgatctctttgttccttcatttgttgaacacctttgtgtagcagtcactgcgctaagaggaggtatacaaaaacaagacaaaggcctcccctgcaaggattcttagcagaaaatttagcaagtggatgtagcatgataagtaggataaaggctatctgccctgtaccccaagccagaagactgattgcctgaaggaaacgggggagtcttcatagcaaagggaagatctgaacaacattgaattgggcaggaaaatagctattgtacgtaccatattgtgaaattatttctaattaaattgctctcatcaagctgaaatccattacactcaagaaatgggagttctgatgtatggaaagactgtaaagggagaaggaagagtgatattgccggaagataacctcctggtgggatgccctgggggagtttttggaagacgtggacatctggaggtgggttggagcaaggcaagaaaaaaaacagggaagtgcaaacaagggggtagaaagacgcttaaggcaaactttacctgctttgaaattgtccccagtgttagtgatacaaaactatagtcacatagagacctgaaagaggaaacaccccctccatgaggaaggtaaaccccaagatgctcctgtttccagagaaagcctgaggggtggcaagaggactgcaggtcagcttcttcaggatcaggctgcagggctcctgcctgctgcaagatctgctctctctgggttgggggcactgcctactccacctctctgcttcctaggtctcttgcctgatcttgcgtgagaatattatctctctcctgcatccctgcctgagccctagcaccgcatttgctgagctgcttccatgggtgtg

SEQ ID NO: 21185 - DNA, 1102 bp, Homo sapiens
tcaccacattagaaaatctatactgaagaaaaaatattacagttaagcggaaattttagctctgcgcttgcctggaagccacagcaaagagggaaactttgctgtgaattgtataattctaattatgtaatgacaaaaatcatagcagttcttttttttctagttctcagttctgagagaaatttatgccattagacttaatataaaggacattgaccaatataattgatgatattttccatatgttaaaacattggaaataaaatctggtggggaaactttagattctttagtactttcataaaatgtaattactagattttattttaatgtgctaaaatttcattttaatttattgagaatattattattctcaaatcaaaaaacaaagtgctttaagaaatataattttgtagatattatgagtcataagaaagtatattttaagtcacagcctagcaaattctaggacagttgtttcatcactgtgccaggaatacttacaaagtgtctttaggaagtagaaattagaaacatagctgagattagaaattatttaggagttaatgcctaatattaatttccaagtgttattatctctttcttatatctgattttcttgtctctgaatttgttatgaaaaactataaaaagaaattataaaatcaaatgataattcactccaagagtaaaagatacttacacctgtattaaaatgattcatatcctacctgcataaccaaaatagtatttcatcactaatatttatccattaatgccatttgcttggtcctgaggtagtatatatttttgtttctttggatcaaactggactgattgcttggaaaaaccaagctatgtaaactctatttttcccccagcctaatgaagctgttgctgttaatgtaaccctgttttttgttcccctcttctccctagtgacacacatggtcacatcagagtggtggcctggtgttccagctgtgtacacaccaagctgtgctactcatcccctgatggactgagttatttgtattagagagggcagagtgtgttttaagtattaagtgggctttactgcaatgtacaaagtttaatgtta

SEQ ID NO: 21186 - DNA, 1030 bp, Homo sapiens
cacataaaggaacagggatttagtggaaaaactgttttgtttatcatgggattgcaatgattattgtcaccttcaggtagatggatacatgggatatgaaaagataaatagacacaaggtggtgtttaaaatgacaaataaacatgcacgatatgctctttcagcctgtcaacaaaaatgtgcctgtttgcggatcccaaatacaggggtggggatgggatatgggtgcgaggagagaacacacacacacacacacacacacacacacccctatctatatctatatctatatcgatatctatatatctatattgttgataacctcattgtaaagggacaagagagtcttgctgaagtagaaattaggtgacactttttttcttatcagtcttttgaccacttaagctttgaaagaggttttcaatttggtgggggagagggagaaagtttggtattttgatatatgatatgtacgttcttattgaaaagcctagaaatttttgtgtcttagagtggattttaaactcagatgagtaacctggaaaaactcgtattactttttgcccaagtcttaaaagattgcatcatcttgttttagaaatgtcttttctcccctttatgatatttctctaaaatttggtttgagtgagttaaattacccacccccgcccagcatccttcagtgttacagctaatagtaagaacatatttttcacttgtgtaagctttcccatttagggaaggtgagctaagttaatcttacctgtggcatctggaagatcaggaaagcagtgtggcatagcagccaacaacaggaactctagaagcacactttcaggactggaatcctggcttgacctgttgttactctaggtgtgtaaccttggaagtattctctaagccctagtttcctgttctgtgtaagtaaggatgtaataacactcttatactggtttactgtgagaataaatgagagaagacataaacttctgtattagtccattttcacactgctgataaagacatactg

SEQ ID NO: 21187 - DNA, 1063 bp, Homo sapiens
gttaggagtttgtgcctaggggacctgggctgttgaacagtcactctgatttggtgtcttttttggccaagttacagaacagagtttccaggactgagaatgatagactcacctctccctttgtctctggctatcctcaggaatatttctcccttcaggaactcacaatgtttcctgtggcttaaggcagagacaggtcctctgccagggaacccaatatgttggagaagctggttgtccaccttgatctttttctagtgtggaaactctgggtcgaggggaaattttctgtatgcctgggcagattggaggggagggacattgtatacatggaagtgtggttctcctactctctgctcagagttgttttttacttccctgtggtcctgggaactgcctcattctcatatttgagttctgtgatattgctggtgataatctcagtgctgtctgtttgtttttggttttctgtgtgggagagtgaagccagcttctatgccgccattttgaaaccagaaatctgaatcagatgtaattctctttttttctgtttgtgctaggatacagtaagacatcaacattttaaattttcccttaaaaagtttaagcttagtttatttctaatattgttttcctttttttagcatttattttccattttcacttttgtagctcttttatcattctttcatatttctagtttctttctcatattttcatgtgttgtttttgtcctctgagtatatgggatggtttacaacatcactgatttgcatttttgctctttgccacttccattatgaatttttattgtgctctgcatttttgcttcttttctatttttcatcttaatcatatccccttttaaatattattctgttctctttttgtcttagctaattcttaagattttaccttgtatttcatagagacggtcttctttacgattcctcatacttttctgatattttcttctggatattagattattttgatggtatatttttattctgtgtttataggatgttgttcttttcccctggttctacaatagcttttagtc

SEQ ID NO: 21188 - DNA, 1031 bp, Homo sapiens
attttggtagacagggaaagctaggttaaattggtcttgtatgggattttaaagtataactgaatagtataaatctgaatttagttttaaaattgccaaagtgaggaattgtgacttgatcattttgtttgtaaggttggtgaaaaatatctcaagaaattaatagtaatatttaaaatggaaaaaaaattgaattaaggagacatctagaaatagcctaaaaggaagcctgcaaacttgaatagtaaacacaaagatttctgtacctaatatgtaagtgaaaacacctttgtagggtctccttcataagaaattttattctgtttagaaaacaaattcgaactttcaaaaagtattcttgaaagattagttctaaatactattctaccagaatataaaagtaacctataacttatgatacttaataaagaagatatggtgctgtttttaactgatgcatatatatttaaagattaattaagtttgtaacttttgaatatattttttctattgctactattactaaaattaggaacacatgcaatttataacgtatcattcaaccaaaatatgtcagattttcatatatgagtataacgttacctctcacaacatagatactgtatagagttggggagcaagagggaaatatttgacatgtatgaaatcaacttggattccacttacctagaattcaatgaattatatcaaagttcgattaaaagtaaccagaaattgctgaattatattatagttaaattatttaaaaagtttattctttgtcgtggccactcaagttctagggtaatccaaaagagaattattttgtataccattgtaatagaaggttgtgataaaatgaacctatccagagttctgaagccaggacatctcagagcctgatgcccaaggtgtattatctgggtattgctgttggttattcagggaccagaggctctttagttagcaggtgatgaatcctgccagatctccgctgtgacagggcagcactgagttcaatgtgaagttcc

SEQ ID NO: 21189 - DNA, 1055 bp, Homo sapiens
ctgctttttattcttcttaaaatccttgtaggcatctagtatgattgaagaattagagcagaatgtctgtcaattaaaacagcagttacaggaatcagaacttcaaagaaagcaacaactaagggtgagtcttgtatttctacacagaagaacaatggtcaaacacagttttcttgattcagatgtatcattgagagtcaattaaaaaaataaaactcagaaatgcaggtcatcttttctgattcttttatcgcattgtataattttacattttatttatcttaatagagattgatgctttgagatgtagagaataaagtacaataatttgaattggaatgatctcttttgagattagttttaaaaataaattttatttaaatatatcattattttagaataatttccttcttttaaattacctgccaatcttcataatttctctctttctttccctctttctttctctgcctctctctctccctctgtctctctcttttgcaccttttagatctcttttctctcgtgatcaaaaaataccaaggactgttacatgatgtaacttcaaatttatcatttccatatttattgacttggtcatttttgaagtaatctcttaatcctaagggtcagaaagattttcttatactgtaaagcaagtgcttttgagaatagtaatatcttcaggtgactaagattttatgcctcgtaatacaaagctactccaatttctacctgtagggcttacttaatcatatgcaaaactctgaactgaagtttgacattaagtagattgattgatttaattaggttgctaattttattgactctagtataatttaaagtataataaatataaacatttatcattcacaggatcaagaaaataagtttcagatggagaaaagtcatttaaaacacatctatgaaaaaaaggtaatatgttttatggaagctataaaatatttaaaatagcaaatgaggcattaatgcagactgatttttatgaaaccatacattctcacctttaaagaacaacttgtttctttgtcttt

SEQ ID NO: 21190 - DNA, 1032 bp, Homo sapiens
tagatgattttgcccatctgtatgctaaagtaaatgttctgaacacatctaagataggccaggctaagctatgatgtttggtaggttaggtgtattaaatgcatttttgaattaatgatatttgaaacttaatgataggtttattgggacatgatctcattttaagtcaaggagcatctgtatgtaatatgacctcatagaatggtcaagtgttgtatcccaggcatgaactctgtctcatttaccattcacaacctccccaggccagcctggcttggtccaagtactttcttgaatttaaagctgtggaatttaaacaagagttgttacgcaggcgtatgacacatatatcttagagtgtgttaccttgcacccttggaccagcactaaggtctacctcacattgaaaaagaaatgagaagtggtatgcacagttgtttggaacctggactttagggtcagacagttgtgggttcaaattccaactccttaatagcttgagtgtcatgtaagctcttcagatgttaattgttcttatttgtggaatagaataacagtagtacaatataatgtaagttgttggaaatattaatatacataaattaagtatataatatatacatatattaatatacataaaatattatattaatatacacaataataaacactcagatcattgttaatattatgttcaaaaatgaaacatacaagaatgacaatcaagagagacacacaaacgaaaaagaaggactcagtttaagaagttcccagcactttgggagactgaggtagttagattgattgagcccaggaattcaagaccatccagggtaacatggtgagaccatgtctcttaaaaaaaaaaaaaattagctaggcccgggggggtgtgcttgtagtcccagttagttgggaggctgaggcaggaggattacttgagcccattaggtcaaggttgcagtgaggtgtgattgtgctactggatgccagcttgggcaatggatccaaaaaaaagaaaaaattaacaca

SEQ ID NO: 21191 - DNA, 1021 bp, Homo sapiens
aaatcactacaatgccaatttgcggcaatattcactagtcaaaaggaggaaagtctcacgatttcaggcaacttggaagcttccaagtgtggcagatcatatagattctacctcctagctgctgcaagagcaaaacgtgaacttctgactaggctagaattattaacatggacatacacaaaaacacacgcatctaactgaaacagcagacagtaaagctgtggataagagatactactttgtgtgtgtgtgtgtgtgtgtgtgtgtgtgtgtgtgtgtgtttataatttcacagtgtagtcatatttgttaaaatcactttttctatttatgttttagaattaaatatatcaggattcaaaaaagtgtcctatatgtaaagtagtacaatatactgaaatattttaaatttatttgcagattttagaaagaaagaataatgaaatagaagaactgaaaactttatacaggagtaaacaacatgaaactgaagagactattagaaagcttgaaaagaaaggtgatgttgtgttgttacatacatcttttaataacatttccattttattttagtgatgtggagaaaaaaatttgatttctgaccttttatagtatgagataggaatgtttatgtggggtttcatcagtggatatatttatataggcttccatatgaaggggcaaaaactgtgtttatttgtgtgtgtgtgtgtgtgtctgtgtgtgtgtttgtgtagtgacagtgatggagtagtactggtggttggtttagatacagagttggaagagtatgttgctttcactccctcttcttaactctagcctcattgggatacagctgccatagagtattgagggcagtcatagaattaggacttactggccttcatgaggaagtcaaaggaaattattcttctttatctagtaaaattcattacattaagtatctacttttatgtctgatagtatttgctggtattgtgattgacagaaaaaaattaaaatgtatttcctatttgca

SEQ ID NO: 21192 - DNA, 1042 bp, Homo sapiens
cttctttatggctattattatccagagatgggatcttgctatgttgctcaagctggaggaggacagtggctattcacaggcatgatccatgatcatggctcacttcagcctcgaattcttgggctcaagtgatctgtaagcctcctgagtagctgactatatgcatgtgctactgtgccccgttcttttctgttgttcttgttaagctgacttttgggtgtatgggaaatataccccagccataagaaaagtagatattcctttttccccttgattagcattttctcttacttgctatcttttttacattttggttatttctgtagtttttgtgagtatagatgtattttgaagtataaaatcacaaattttattaaatgattacatttaaaacttctgacataatataaattaacaatagattttaatgcaatttttgacatattttgagctgatttttctgattcacagtagcagagctagatataaaggaggctgattacatgtcatctcctcatgtatctgggaattcttttactgtgcactaggaggatagaacggtgcttgtgggcggatccagggacatgcccagctgaagaatattctatcccagtgcaatgtgatgaattatactctcccaacctggcaagtttctgatgacttctctctgccactttatgacagcttaatttctgaattatattttagggaatcactgaaattattatttatactgtccttaaaaattattatacaaaaatctcagataacgtatttctttcagataataattattcttgtatatttaataattttcttaatgcactataatataatttttacagtttggggggaaaccatttatgagattagctgagatagacttacaaaaatattatgctcattgaaaagttatatgattggttctttacgagtttctattaatgtatacctactaattcaccattcacttattatctgctggaatttgctagcagataaacaacagtagatatcgtaagtataagaaaaatatgtgaag

SEQ ID NO: 21193 - DNA, 1038 bp, Homo sapiens
gttatgtctccttggttttttatgttgcttgttgctttatgttggtgtctgcacatttgaagaagtaggaaattattatagtctttgtagactggcttcatttgagaaagccagtcatcattgagcctatccagagattctgggcaggctgtttggcctattggtgggctctctcctacagtccccaggcagggtcagaaagtgggtgggcctggtatcttggtcctcatgtttgagcttggagcctggatccactgggtagatgtgttgctttggtccatgggagtgagcttggagtttgggtctgcatggtaagcctgaaatatgtatccaccagggctagcctgaagcctaggtctgcaagggctgacctggttctagggtgggtttaagcctgaatctgcaggggccagacaggttctgggatggacctggttctttggtccactgggacaggccaggggcctgagtgtgcaggggtgggcctgggtcacgattctgtagggatggacctggaatcttattttctgagggctggcttggcaccacagtttattgggatgagcctggaccctgggtctgttagtcaggtctagaccctgagtctcctggtgtatgggaccacaggggttaatatggagattggggccccagtggccgacctggagtctgggccagaggtgttgactgggaggttgggtgggtctaaagcatggggttgtgttggctgacctggctctgaatcctgcgttatgcttggagcctggggccagatgggctggcctgacattgggtatgtctggagcctatattcacatgggccagcatggaggctgagtctgtgagtgctggcctgatgactagggattctggaggctggcctggttcctgggtaggcctgaaacctgaagttgtcggggccagcctcgtgctgtgaatagtctggagcccaaggtcactgggcccgcctggcaatgtggtgagtccagagactgagtctgctgggctggctttggaacctggggctgtgggatcttg

SEQ ID NO: 21194 - DNA, 1737 bp, Homo sapiens
aaatataaaacatgatgcatggtaggcagggttcatctttctgttttgttttttgtttttgtttttccagagatagagtctctatcttttgtccggctggagtgcagtggtgtgatcagagctcactgggatcaagcagtcctcccacctcagcctcctgagtagccaggactacagctgtgccaccatgtccagctaattaaaattttttttttttggtagagatgggatcttactgtttttcccaggctggtcttgagctgttggcctcaagtgatcctcctcctaccttgacttctcaaagcattaggattataggcatgagccaccacacctggacaaaattgtagatgtttattgtgtacaacatgatgttttgaaatatgtatacattgtcaaatggctaaattgagcttgatatatgaatcacctcacagacttatcattattttttgtaatgagaatacttaaaatgtactctcatagtgatttttgaaatacaatccattgttattaactaaagtcactatgctgtacaatagatctctagaacttatttctctcatctaacttaaattttgtatcctttgaccagtatctcccaactccactccttgtcgcctggcctcataaccaccatttctctacttttgtgagttcaccttttttagaatccacatataagtgagatcatgtggtatttgcctttctgtgcctggcttatttcacttaacatcgtgttctctaggttcatccatgttgtactaaatgacaagatttccttctttttaaaaactgaataacatttcattgtgtgtgtgtgtgtatgtgtgtgtgtgtatgtgtatatatatatcacatttttttcatttatttgttgatggacactttatattgattctatatcttggctattgctgcagtgaacatgggggtgcagatagctcttcaatatagcaatttcatttcctttggatttatacctaatagtgagattgctggatcatgtagtagttctatttttaatttttcaaggaaccctcgtactgtttttctataatggctgcactaatctacattactgccaacactgggcaagggttcttttttctccacatcccctccaatactgatcttttttctttttgttgatagccgttctaataggtgtgacgtgatatctcagtattgttttagtcagcatttctctgatgattaggattgttgggcagtttttcatatatctggtggctatttgcgtgtcttcttttgaggaatgtctattcagatcctttgcccattttaaaatcaggttatcagtgttcttaccattgagttgtttgagttccatatatattttggatgttaaccccttattagatatatggcttgcagatatttttctcattgtgtaggctgtctttttactctgttgattgtttcctttgctatgcagaagctttttagtttgatataatctcatttgtctattttttcttttgttgactatgcttttcggttcatatccaaaacatcattgcccagagcaatgtcatggagcttttcccctatttctcttatagtagttttaaaatgtcaggtctcacatttaagtctctgttttaaattgatttttgtatatggtgtgagataagggtctaatttcattcttctgcatgttggatatccagttttccaagcatcatttattgaagacactgtctttccccattgtgt

SEQ ID NO: 21195 - DNA, 1035 bp, Homo sapiens
caacatgcccggatggttttattatatctttataaattgccaattgccccaccttgatttttttcatcaggcatgtcttgactacttttgccctgtttttgtttatatacattttgtaaggtcattataagttttacaaaaaccctgttgaaattctggtttggatcacatttaattgctagatcaacttaagaattgacattttttgcaacatcgagactgtccaaaatggattctactctctatttttttttcagtctttagccctaatcttttgatgaagcttatttgctctataaaggtctagggtatcattttgtcagtttatctaggaattatgcagtatattagaaattatatctttgtaaactcttctcctagatgatttttactcatttcagaaatgcagttgattttttttttattattatactttaagttttagggtacatgttaaatgtaaaaaaaatttaaatttgtatgggagcatagtaggtatgtatatttatgaggtaaatgagatattttgataacaggcatatgatacataataatgacatcaggataaatgggtatctgtcatctcaaacatcgatccttcatttgtgttacaaacaatccaattacactcttatagttatttaaaaatgttcaataaattattcttgactgtatcaccctattgtgctatcaaatactaggtcttattcattctctctaacgatatttttgtacccattaaccatccccactttccccaaccccctctatccttcccaacctctgtgaaccatcatcctactgtcgatctgcagagttcaactgttttaatttttaactcccacaaataattgagaacatgtcaagtttgtctttctgttcctggcttattttgcagaacttaatgatctccagttccatccaggtttttgcaaatgacaggatctcattcttttttatggctgaatagtactgcattacgtgtaagtaacacattttctttttccattcatctgttgatggatacttagcgtg

SEQ ID NO: 21196 - DNA, 1050 bp, Homo sapiens
agtgagaacatacaatatttggttttctgttcctgtgtttttaatagtttgctaagtgtaatagcctctagctccattcatgttcttgcaaaagaaatgatctcatccttttttatcactgcatagtattccgtgggtatatgtacagtattttctttatccaatccgtcattggtgggcatttaggttgattcgatgtctttgctattgtgaatagtactgcaatgaacattcgcgtgtgtctctactgtagaatgatttatattcctctgggtatatatgcagtaatggggttgctgggtcaaatggtaattctgcttttagctgtttgagcaatggccatactgctttccacaatggttgaactaatttgcattcctatcaacagcgtataagtgttctcttctccacaaccttgccagcatctgttattttttgattttgtttatagtagccattctgactggtgtgagattttatctcattgtggttctgatttgcatttctctaatgatcagtgatattgagcttttttttccgtatgcttgttggccacgtgtatgtcttcttttgagaagtgtctgttcatgtcctttgctcactttttaatgggcttgtttttatcttgtaaatttgtttaagttccttattgatgcgggatattagaccctagtcagatgcaaacattttctcccattctgtaggttgtctgtttactctcttgatagtttcttttgctgtgcagatgtgcagaagctcttaagtttaactagatcccacttgtcaatttttgcttttgttgcaattgcttttggtgtctttgtcataaaatctttgctaggactatgtccaggatgtattgcctaggttctcttccagggtttttatagttttgggttttacatttaagtctttaatccatcttgagttgattttttgtatttatgcttttttttttttcatttcttgtttggcaaatcttttctagattgaggccataacatcattcttctaaattgtcttctgaaagtttttgtagttctgctttta

SEQ ID NO: 21197 - DNA, 1032 bp, Homo sapiens
tacccaggctggagtgcaatggtgtgatctcagctcactgcaacgtctacctcccaggttcaagtgattctcctgcctcagcctcctgagtagctgggattatgagacagggtttcactctggcacccaggctggagtgcaatgacatgatcttggctcactgaaacctccgcttctcgggttcaagcgattctcctgcctcagcctctgaagtagctaggattacaggtgtgcaccaccatgctctgctgatttttttatatttttagtagagacagggttttgccatgttggccttgctggtctcgaacgcctgacctcgagtgatccacctgcctcggcctcccaaagtgctgagattacaggcgtgagccaccatgcctggctggcactgtgttatttactgaagaatatgcgcatttctctggtaccatgttgaggtagattgtattattatcttaataattgtttccctgagtaaaagtaccaattcatgtacccactagtagtgtttcacatcttgaacatttttattgtaaatttttaatttatgccaatctataaaattgtaaaatatcaccgcattgtgatattactttatattttttatatttctaagtatattgaccatattttatatgtttatgagccattcataattcctcatcagtgaaatgtgccccaagtttttttcctcaattttctcaagtgtattgacatctttttttcattgtttttttaatttttttatttttttgagacaaagtctcactctcatcccccaggctggagtgcgatggccccatcttggctcactgcaacctccgcctcccgagttcaagtgattctcctgcctcagcctcccgagtagctgggactacaggtgcctgccaccatgcctggctaatttttgtattttcggtagagatggggttttaccatgttggccaggctggtctcaagctcctgacctcaggtgatctgcccgcctcagcctcccaaagtgctgggattacaggtgtgagccaccgc

SEQ ID NO: 21198 - DNA, 1024 bp, Homo sapiens
ttcatgggtctttattgtaattttacttaaggttacagagaagggaaatgtgttcattaatggggtactttgtggtatgattagttgggacaattctcattaagtaagcatctaatttcagctgtcttatctagttttattttaggcaatttcatgctttttttttcatgtaggttagaaacctgcccattttcttattttttcttttttttagagacagggtcttgctctgtcaccaaggctaaagtgcagtggcatgatcatagtgctcactgcagccttgaactcatgggttcaagtgatcgtcttgcctcagcctcttgagtagctggtggtgcacaccaccatgcctgactcctgtccatttcatactacgcaatggtctgggagagaaactgagctgaaaattctgatattttaggcttctcatttggctgtagttttccacaaatgagtgaaagtgtcagattttgagactaggacaaagttacccaaatgaagaagagttatgagagtggtttacataaaaaattaatactttgataagacaaattctctttgtctttctctagagtttaaaaatatctggaagtatctactcaaaatggtagctgataattccacatggtaaaatatcagcacttattttcttaacattttaagtgtttttttaaatagtaaatatttattattcataaaaaacaaacaaagccgtaacagtatttatagcattttccccaaagcttgcttttggggagtgtaactatattcagagttttatttgagaagttgacatttatttcttttaaaagtgaatgtaaacttctggccatgagtaaatctattacagccaggttctcccacaaccaagaattctggacaaaatacaaaaagcaaaccaactggggactctgaaaagtcaataataacaggccgattgagagggaagttggaatatgaagaatcactgatatagtggcaggaagtttcctggttttctgtttgtgttttttttcttccttaa

SEQ ID NO: 21199 - DNA, 1045 bp, Homo sapiens
gagctgagagatcacaccactgtactccagcctaggagacagagtgagactccatctcaaaaaaaaaaaaaaaaaaaaacaaacaaacaaaaaaaaaaaccctaaatttacaccttaaggaactagaaaaagaacaaactaaacctaaagctaacagaaggaaggaaataaaatatgaaacagaaaaacagtagagaaaatgaaactaagagttgggtttttgaaaagatcagcaaaatgagcaaacttttaactacatgggtaagaaaaaaagaaacaagactcattaactaaaatcagagagaaatttaacacaaagaaaaagggttgtaagagaggactatgagcaaccatatgtcaatatatttgataacctaggtgaaatgaacaaatttctcacaacacatgacctaccaagactaaattatgaagaatagaatatctgaacagacctttagtaagcagattgaatcaataatcaaaaacctctcaacagacaaaaactcaggaccaggtggcttcattggtgaatttaccaaacatttaaagaagaattaatgccaatccctcttcaaacttttcaaaaacattgaagaggaaacacttctaaatttatcacgtgaggccagcattaagttgatactaaaactagacaaatgtggtacaaggaaagaaaactataggccaatatcctgacaaatatttgctgcaaaggcctcaggaaaatacttgtaaactgaattcaacagcacattaaaggtttacacatcatgaccaaatgagatttattcgtaacttgcaagaatggttccaaatatgaaaatcagtaaatgtgatatactacattagcattaacagaatcaaaggagaaaaccctcacacaatcatcttaattgaggtagaaaaatcttttcacaaagtttaactcccttttttgataagaagaaacttaaattgggaagataaggaaattacctcagcaaaataaacgccatctatttaaagcctatagacattattcttatagtgaaagactgaaagcttt

SEQ ID NO: 21200 - DNA, 1051 bp, Homo sapiens
tctgtggatgaatgcatagtactctgagatataccatcttttatcttttcgatcttcacaaaatattttacatttatacccttggctttatgtctatgcagtgtccaaagtttgcttggactttcttaatttaggatattttgccatctagagaggctgagaatttttaaaaccatgaagtcttagttccattttctttaactttccttgactcaattttactctactcttgcacctaagagcgacagcacttaaagcaatagcaaatactttgtaaatcttcttagctatattactcacttagttcctcaagcatattttctaatttttgtgttactgaagatgatggtatagctttctatctctatgtaaaaaggatcccccttcttctcatttccgataacagatttcttacttcctcttgagccccactggcaatatcctcaaattccagattcctactaatgacctcttcaaatcaactttgtctttagcacactacacacaaagatgtttccatattcttaggctgtactttactttcagataccaaaatctgtattatctataatacagatatctgcagttatctattgcatgtctttctagctatacctagctatacgtgttttcattatatgcttagtatttgttctaagtatgtgctaggcaacatctaagagaaattccattacaaattactctaaatcttagcagcttaaagcaacatttattttttaatttttttaaaattttttaatttttttctcatggacatggcttagctgggttttctggcttaggttctcctataaggttgcaaacaaagtattgactggggttgtggtcccagctgaagtctagattgggggagaatccacttctattctcactcatatggttaataggattcaggtccttgctggggtattgctctgagggcgtcagtctttgctggctgtcatccaaaagtttctctcagttttttcctatttgggcctctctataggatagcctacagcatggcagctggcttccatcaaagtggaca

SEQ ID NO: 21201 - DNA, 1033 bp, Homo sapiens
taaccaaaccatcatggtactggcgtaaaaacaatcacatggacctatggagcagaattaaaaactcagatacaaatccgtacatttacaggaatttcatttttgacaaaggtgtgaaggacttacactggggaaatgacagtctcttcaataaatggtgccatttacttaagtttatcagtttcacttttgtatcttcttgtacaaagtaatcctgatatttcattagtttgttctgtgattacgtaattttcacagcaaaaatgcaaacatttttaaaggcattcttctgtatacggatatcaagttttcaatatccgtatacagaagaatgaaactagacccttgtctcccaccatatacaaaaataaaaatggattaaagactgaaatctaagacctcaaacaaggaaactgctaaaagaaaacattggggaaaatctccagggtagtggtctgggcagagatttcttgagtaatactccaaaagcacaggcaaccaaagcgacaatggacaaatgggatctcatcatgttaaaaagcttctgcaaaggaaacgatcaacaaagtgaagagacaatccagagaatgagagaaaatcttttcaaactattcatctgacaagggaataaccagaatatataaggagctcaaacaactctatacaaaaaaatcaaataatctgatttaaaaatgggcaaaagatctaaatagacatttctcaatagaagacatacaaatggcaaacaggcatgtgacaagatgttcaacatcactgatcatcagagcaacgcagataaaaactgcagtgagatattatttcaccccagttaaaatggcttttatccaaagacaggcaataacaaacactggcaaggatgtggagaaaaggtaactctcctacacttttggtgttaatgcaaattagtggagtgactacggagaagagtttgaggttcctcagaaaaactagaaaatagagctaccatgtgatccagcaatcccactgctagttatataccccaaagaaagga

SEQ ID NO: 21202 - DNA, 1038 bp, Homo sapiens
tcactgttctctgcttttagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaagtttgtctaaaatgtatttaaaaagaaaaaaaaattgtaagtagcatttacatttattcaataatattaccacatgctgggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgtt

SEQ ID NO: 21203 - DNA, 1038 bp, Homo sapiens
agagtcaactgatgcggcaaactttattattgtcttattttaagaaattgccacagccacctcagccttcagcaaccaccaccctggtcagtgagcattttttagcaatacagtatgtattttttgtgattaagttttttagccagagaatcacaagcaatacattattttaaaattaagccatatacattttaaaaaatgtcttaaagagtgtctcactatgttgcacaggctggaatgcagtggctattcatgggtgtgatcataactcacttaagcctcaaactcatgggctcaaatgatcctccctcttcagcctcccaagtagctgggcctacaggcatgtgacaccatgcttgcctttatacattgtgtttttttaaacatacaatgctattgcacacttaatagattatagtatagtataaatataatttttatatgcactggaaaaccaaaaaatttacgtgactcacattattgcagtattagctgtattgcagtagtttggaaccaaacctgcaatatctccaaggtgtgtctgtatctctctgtctctctcaccaaacctgcaatatctccaaggtatgtctgtatctctctctctctctctctcaccaaacctgcaatatctccaaggtatgcctgtatctctctctctctctctctcttttttttttttcaagaccaggtctccctctgtcacccaggcgcaaggtgcagtatatgatctcagctcactgcaacctctgccttccaggctcaagcgatcatcccacctcagccccctaagtagctgggactacagatgcatgccaccacacccagctaaattttgtattttttggtggagatggggttttcctgtgtcacccagctggtcttgaactcttgaacttaagcactctgcccacctcggcctccaaaagtgctgggactacatgctgtttccagcttttatcttaggttcagtggagtatgcgtgcaggtttgttatatgggtaaattacatgttgcgggagtttggtctgtatcttt

SEQ ID NO: 21204 - DNA, 1050 bp, Homo sapiens
taataaaccatctaatgcatgtaacagtgatcagcaaattaataaattagacctctattcatgcttaaattatcaaagctaatcatttaaatgagatgttctattttaattaaaatttctggcaccatcgttaatgagacttagaatttcaactagtgtatttagctcttacttggtgattagctttgatggcataattataaatagagcccttattaattaagttgctgacctttccccagttatctatttatatacacacaggtgaaatggcttgataacgtcatatattagaggtatatcttataagacagtggtaagcaaattaggagtttttactcaaactaaaactatctttaacagtaaaaatttatacatgagttttgtagtttagttttttccttctttcttagatttcctgtattaaatggcttttgaaatgttagcattacattttaatatttggaaagaaatattagcagaatttgaaaatcgtgattatatgtgtagtaccataatctcacagtaaaacatgaagcatatttataaacacacaatcatatatggagttgatactgaacttcacagaatctctttaagaatctctctggcagggtaaatgagcctttaaacaacattaatgaaattatttaagacctgaggactctaaaattaaacctgagcatcagtcattggtagggttgccatccgaaaataaaggaacaatctgattggctgaagatgtatgtagaaggaatactcacttcccgaaacagaactgggcgaaagcaataggaaacaaagtcaagaaataagaaaagaaaataaaagataagaatagaaacaagaataaataagaaatgagaacagaaaggaaggaaagtatgtttaaacagcctaggggcccacaaagctacagtgttgatagagatgtaaagggatttctctgtcagaaatatttttcttttgtaggctacagatgtttttctaaaattttggtttgggggcctttactgtataggaagtaccctctggcagaggaaaaaagga

SEQ ID NO: 21205 - DNA, 1077 bp, Homo sapiens
tccatggattttccttccccacctcaaacgcagcaaaagccatggcccttggctgcttggctaaggctggacattgtggtctggcagtactgcctgcatcctttcccacttccggtccttacaggtgtgatgggatgaggaggacaacaaagggcaaagtgccatcttctcctgagccaggcagtagaccatccccaattgccaatagattgataaattgctccaatttgattttaaatgccagtgtaagcttgggattagtgtttacattttctctagacgtttagccagttgtcttcctgtctttttggaattattacattctcactaaagagatgtcactttccaaattctttgcaatagcactgtatcatacttgctccgaggggtgggggtagtgcaaaatgaaatgcagagagaaacaacagaagttaattcttgacctctgagcttccaaaagttcagtttttagtaattttggcatgattaaggatttttcaaaggtaatttttatctgtgtgggatttttcactttgcatgataatttaatactctaacctctgagtaagatgtatttcttcattacatattgtgatctatttctggactttgtgtttttcttcatctataagtttctgtgctagaattatactgttttaagttttgagattttgtggcattctaacccagtagtttaaagtctcccttattactttttcccttccagtttctatatgtggggcatggagtggatgggggaggagggtcattctgtggttttactactaaaaaaaaatttaaaataactttatgaactctttcctcctcctctgtcccacctctacacacccttcttggctttttatttgaaatacattaaacttgtagcttaaattgagggaaattttatctttacaaatacttctcatttaatttatttccttctttcctccctccctttttctctcttcttctatttttccttttttttttttttttctgagacggagtctcgctctgtcacccaggctgcagtgcagtggcgctatctgggctcactgcaagctccgcctcccg

SEQ ID NO: 21206 - DNA, 1026 bp, Homo sapiens
ttttatatacatagtatatatatgtatgtagtaagtatgcctagaagtacaaattttgtgtgaaatgagttgccatcagttttgaaaacttattatatgggtaataaaaaagatcattttgaattagtgtggataggtgagtactgaccatattacttgcattgttgagccagaattaatggagagcctgttttatatgtactataatacaaggtatgactgtagtttcaaaatcaaacttctggagtcttgtgatctggtagaaagattttatctcaatcatagatgactattgggtttaaggatttgaggttgggggtggaatttgagattatctttagttatttatattcatttctgtgatctcatccattgaattgtaatctgatcttgtaaatcttttctgtaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggtaaagcctctgttaatgaaattgaagaggttaaagggagaaaacttcgcagaagtgccaaaggtttattgggatgcaagttactttaagtgttggaattgaaggttacatttggcggcaagcggtttctgcaaggagcttgtttagtgtggacatgtaagtgaaaatacagtatggtgtttagtcatgcttaatgttatgatcattctcaaacaatttttaatactgataacttctggtatcatttatataaaataaccttctaatcctctctactgatagagttgttttagtgagatgtgaataaaacaaagaagtttaaaagattatcacacttactaaaacatgtccttatattctttataaggaataatgttataataacgatatttgtataaagcaaataattctg

SEQ ID NO: 21207 - DNA, 1061 bp, Homo sapiens
ttgagctagaggctgcgtacagtagctcatgcccataatcctagcactttgagaggtcaaggtgggaggattacttgaggccaggagtttgaaaccagccctggcatcatagcgagaccccatctctacaaaaaaatttaaaaatttagccaggtgtggtggcacacaactacagtcccagctactctggaggctgaggcgagaggcttgagcccaggagttcaaggttacaatgagctgtgatcatgccactgccctcctgcccttcactctgagtgacagcacaaccctgtctctgaaaaaacaaataactgaactagacagagtaaaagtcaatccattctttccttagcgttttgctttgtcttgaagtccaacgcaaacctgaaatgccactctgtgaaactgatactttatcaattagactaaaaagacctttcttttgaatgtagtatgtaatagaattgtattgataaatatgcagttgaatattgtggctattcttattaaaagggtgggaaagtggatggattttagatcctgagtgctatataagatagtccttccctatattttctcatgttatgatgagaaaaaaagcacaattccttcattggtgttcttaaaaataaaaataaaggacagcttttcagcatgtatttcctggcaacacacatttccagcaactgcatgactgtcttattagccttagtcttatagtcagaagtacatatttaatattttgtagcatttttactttttctgttgtttacatataggtctaaaattttttctgaacccatttgcttattttttatttattcattccatttaaaatttttaattttttttattaaaattcttttttcgacagctttatgggtacaagtggtttttgtttacatggataagttgtatagtaatcaagtctggacttttagtgtacccctcacctgagtagtgtacattgtacccaacagatagtttttcattccttacccctctcccaccccgctaccttctgaatctccagtatctcaattgatttcttaaactcatct

SEQ ID NO: 21208 - DNA, 1032 bp, Homo sapiens
gtgcctcactttttcacttaattgttctaatttttgatgaatttccttctgtagtcttgctctctcaaggcttctcaatgtagataattctttgtatctggttaatccagaagatcttaacattagggggttagacgtggtcattacttgtctttcggtagcattattagtattcattagactttagttttaaggaacagtttctactaaatatggttaaaatatcaacctacacaccaaaatctttctttatacacttgtgacttataccagttaattggaattttaactgtacaaagccagtaatagaagatttggccttttgagtgttgaagaactgtgctagcattaaaaaaaaaaaaagcagtcgaacagttatttataatattcttttgtgaaaaagaaagaaatacactagggattacttaaaattttataagtgtgctagtacctgtcataggaagttcagaatagtaaaaagagatgtaggtagtcctgaatctgccttgggtaattatttctttttgatatgttagaattaaagtagacaaaactattaggacatggcactctttaaatcaggtttttttttcttacaatatagataatgacagcactttattatctatttttgtgttctagcaggaagaaaaattctgggaagggagactatttgggacctttaagaataagtttcatatattagaatttaagacccctcaaaaagttaatatcctttataggggaaagctatcatcaaaggaatcaagtagagttttaatttatgaaaaaaaaatttcttttttaaaaaacaaagcttgaagggtctgtaacttatttatctgtaaacaattctgttgtaacatctttaatttcatactttaaaaatatattgccatgcatttgtagtcactaatgacaaattggagaggggagagtatctttttttttttttgagacagagtttcactcttgttgcccaggctggaatgcaatggtgcagtctcggctcaccgcaacctctgcctcttg

SEQ ID NO: 21209 - DNA, 1046 bp, Homo sapiens
atagttaaaatatgagtcaatgtatttttgtaagaacgttctagaaaaagataattccagaatgggaatgttttgaacttaaaaaattgtagtgcttataaatcttacgtttatgtgccattctgttgcaagattactctgaacacttaaaaataattaggtgtttattttgtggtactgcatatactttctatgtctgtcatttttttggtagagagtcacagtggttatagtggcaattgtgtgttaaattctaattcaatagagtgctaacggttaccagattcatttgtaacttttcagatattaccatcttaaaataacaatgtcagtgttttaataactagatactgttaagaaattagtaaatgtaaatcagaaatattttcttcttttccagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctggtatgctgactcaagacacagtctcacaagtttagggcttatgaattcagtttagactgggattggcaaactacagtgtgtgggccaaatctggctcactgactgtttttgtaaataaagttttactggctcatttatttacctatttattgtctatagatgcttttgtgttacagtggctgagttgagttgttgcagcagagattcattatatggtccacaaaatctaaaatatatactgtttggctctttactgaagaaaaatttgccagcctctagttcagacattttagtgactgctattccatttattctctagttggtcagatgatgtttattattgatcatatgaagaattccaatttggagagtgttggtgttttccttttcttttacacttttctcagatttttgttataaaatgcttttgcattatatactgtagagatgataattatgataggttt

SEQ ID NO: 21210 - DNA, 1072 bp, Homo sapiens
agcagtgagccaagatcgtgccactgtactccagcctaggcgacagagtgagactccgtctcaaaaaaacaaaaaaaaaaatttttttttgttgtttccagcttgtattaaaggcagaaaaatacagtttttagctcaatgaagtggaattgatataatggtttaatttttggtatgtttatatttgatttactttgtttcactcttctagtttttatatatttttgatgtaaaatattcaaactagttttctacttctggtttaggttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggtatgtttgaaggttgcagcttaaccatagtggtctgtagcctcattatcagctcgtagtcttcctctggtttagtttttcttctgccgtaaacaaaagcaaagctgactttgaagtctacagtggtgggttgaaaattgcacctgtagtaactcccagagaaaagtgattcttttaaatataagtaacatttagaatgttccagtgttatacaaggttgagctttctgattagagttttaaatcagcaatggaagaaaagatgaaaagaaactatgtaagctacctcctgggacatctctcatctgcagttgtatctgttcctgttctatctttatgggtttttaggtgaattatgtcttcagtctgccatatttaactggaagactaatcttttctctttttaaacataaaacttggtgaacattatttattaattgtaaattgatagagtatcagggctaatcatctct

SEQ ID NO: 21211 - DNA, 1311 bp, Homo sapiens
ctttagctgaagctattgtgtccattaaactgtgcatgcctcattgggtcattgtgcctggcttctcagtgctaacagctggcatgacaggcctagtatggggtgcacatttcatcgttagatgggtgctgcttctgttggtgacaggcctagtgtggggtgcacatttcatcgttagatgggtgtggggtgcacatttcatcgttagatgggtgctgcttctgttggtgacaggtctagtgtggggtgcacatttcatcattagatgggtgctgcttctattggtgacacctcagttctgtcgctctgctttagtaaactcagggattgttttattactttgttagatttttattgttcatatagtcagaaatcacatgaaatgaaaaccctatataggtttgaaattttttgaaagttgcactcaagagatggaattgttactaaggttgatagagccatatttctcattagcatggaagtatctttttcagtctattgagtgttcagttggctgtaattctgtcattccctaaaaggttagggaattatgtaaactttaaggatgattttaaaatgtagcatgcaacaatggaaagatggtttttcttcttattaagaaatatctttcttaattgtaggatatattttctagtttaggtatttctgagttactaaatttcaaaaagtacatattttaatatttaagattactaacataattttagttttagcctgttaatcttttatacaaattaattattagtatagctataacctttactagaaagtctataatgtctgcatcttgaacatgtgatgaattttctgtgggaaaagctgcatttcttaggacttttattttattttatttcttagcacttctggtgcctctacctcaagaattttgttgcaagacacaaccaatgtcacaagaggattctcttgttgctctaaactgtgagattaacttttcatgcctgctaaattgtgatcaagtgttttgggatggtgattctcaaatagacatgagtgaaactttaatatatggcctaaggcctgggcgcagtggctcacacctataatcttagcacttcgggaggcccaggtgggcaggtcttttgagcccaggagtttgagaccagcctcggcaacatggcgagaccccatctctacaaaaaatacaaaaattagctgggcgtgatggtgtgcacctgtggtccctgctactcaggaggctgaggggaggatcgcttgagctcaggaggtcaaggctgcagtgagctaagattgtgctactgcactccagcc

SEQ ID NO: 21212 - DNA, 1051 bp, Homo sapiens
atatttatatgcattttaatgttgccttgaatttaatttacatttgattgttaattctttataaataaaataactaagatatatttttgaaaattttgggggaggtgtctatgcagctactaagctatggtgtagtgcagggctcagtaactttttctgtaaagggtcagataataaatattttaggctttgagaatttcatacaggcctggttgcatttcttcttctttttttgtttttgtaaaatccactgtcagttaagggctatacggaaacagtttgaaggttggctttgggcacatctttgggctgtgctctagtgtgtgtgactgggccattttgcttgtctgttcaatcaataccagtcatcagagcaaacccaaatcaccattagaatcatgaagaatgttttgttgtggtttgagacccaatttaaaggtaggagacaatggtatgcttatatagactcatctctctaaatgacttggacatgtattgacaataataagtgtgttctgaacacattgaagtttgcctctttgtgacatcgtggtcagatctgctgccacacaattagtaggatatttcccaaggtcccgagaatgtatgagtcctctgtgaactttgacagtttaagcagaatatttctttttttcttttcttttcttttaaatggagtttcgttcttgttgcccaggctggagtgcaatggtgcagtctcgctcaccagaacctccgcctcctgggttcaagcgattctcctgcctcagccttctgagtagctgggattacaggcaagtgtcaccatgcccagctaattttgtatttttggtagagatggggtttcaccatgttggccaggctggtcttgaactcctgacctcaggtgatctgcccgcctcggcctaccaaagtgctgggattacaggcgcgagctaccatgcctggccaaagcagaatatttctaatcacgaaagtagtatcaaggggcttcatactagtttcttacattttgatggtaagggttgcaagagactgaggcaggaggatc

SEQ ID NO: 21213 - DNA, 1098 bp, Homo sapiens
atggcttttcaaggagcaaaggttagaaattactaagattatttggataagctatttgccactattgagacattaatcttggtgaatgactaggctcatgtttataatatatatgtaacatttaaatgttgccaaatctctcactaaaaaagacatggcaattgtgcattatgttgtcatttcaaagatagtttaggataatttgtactttggagactgatctttgtctaacttttaattatttcttcctaaaattttaatctgagttgtgaaaccgtttttccaattatgttatgtcaaagtcttggtgtaatgtatcagtaaggttacattttttttttcttttggttaagttttcttttttaggtatatgtatgtttcactcaatagaaaagtaatacgcactacatatagagtgagccaacccagtgctcagagtttatgttactatggatttcatcttgtgctggtattgtgctactttttttcccctggtatgtcagaacttgaacagtcatttgttttgacattgtgccctacttacagtataatttaacgaaggctaacctggattttttggaaatgacatttgaatggcattgtactgcattttaataaggacttagcagtgttttacattaatattttcgaaaagatttttgtttatagtaagttgacttaaagatactgtagtttcattgtgctttatcacacaagaaaagatttaaccttttacagtttttgatcttctctttctataatgggatgggtattggtagtaggaagagaaagtgattatcatctgataaaacctatgaagaatttatcatatctttttcacgcagattcaaatttctcttgactgaagagttaagttctaaatgttaatctgtattttaaaaatgttaatttctagtatgtcctagcctgataaaaagttttttttttaaacatggatttatactaatgttattttgttttgttttgttttttgatatgggggaaatagtcaatgggtatttgcattgttttgtttttaagaatttgagctctagcatatacaattctcatacaaaaatatgtaatatagttaagaat

SEQ ID NO: 21214 - DNA, 1042 bp, Homo sapiens
tgaccaaggaagctacttttcagtgcctcttttggagggccgacgtgaatacctatgccttaggatcccctaattccagagaaagtcagtgaataatatggggagctgatgttttggttaactgttgtaaatgttctctaaacctcttctccctcctttgtacaagacagtacgataaatatggcctttcagcacatgaagttttgtttttattgaagaatcagagggcaaatgctgggagtttatttttaaatggttcaacaaagtatatgataaaacagtctttcctattctacttagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtggtgaggaaaataagctacattattttttgtttgtcttaaacaatgaacttgagtcttgactttattgtgtgctctattttggtttatttccttatcttctttgcaaagaacttgattctgatagaatgatgtttttagtagctatagtagacccatttgttaaaatgaagagcagaactaaaccacttgtttggagatttgcctgtactgtattaattaccttcattcaggcagtttttgagtgccatttttgtggtggtggttaattttcttttctctcttattttagctttactatattttgttcttgtcaaaattactgaaaatgaaggtataaaatactttggtctgtaaacagttccatcatcatcttaactgttgacatttattttccatgctaaaagattttgtttgtgcccttagcaataaaaacataacataaattgctgtctgttttcagcttagtgaatgtatagaaggagtaaaggtagagcacaatcctgacctgtcagttactgtcagcaccaaaaaatcccaccagac

SEQ ID NO: 21215 - DNA, 1729 bp, Homo sapiens
attatgtgccagatactttgagaggtgcaagaatatagaaaggcagttacagactgctgacagcagatgtgtatatcgctgataacgatctagcatgtaaaatactacagaatagtttagaaaaagtgctatggttggcgctttgttgaaattggaagtgtagagcttagggtaaagttagagccaaatgcgctgattggtggtttatctgaggatgttagagtgaatggatccctagccttggactcctctgtgggagaagggctcatctcagagtgagtggggtacctagcagtaagtgctcccaggctccaaagtggtagcatgccattagctgcaagaaaaaggaacctctagccgggcgtggtggctcacgcctataattctagcactttaggaggccgaggcgggcggatcacctgaggtcaggagttggagaccagcctggccaacatggtgaaaccccatctctactaaaaatataaaaattagtcaggcgtggtggtgggcatctgtaattccagctactcagaaggctgaggcaggagaatcacttgaacccggggggtggaggttgcagtgagctgagtttgcgccacttcactccagcctgggcaaaagagcaagactttgtcccaaaaaaaaaaaaaaaaagaaaaaaaaaaaaaggaaaagaaacctctgtaatcagacattttctaggtgttatgaagaggagagtaaagtgaataaatggatggaaggtgctagcctgtgaggttcaagactggggacttggacttctcttctgctgccagctaatttctatgtaggaggcctctatcagcttccttaatgagagcctcacaaatatgttttccatatttaattatagtttaacgtagaaaaaaacaaaaatcattggcaacatattaatgttattaaaaatttctgagtattccaacttcacctttgttttaatattgaaaatgttcaagtttagttcagcatcaacgttattcttgtttaaaaaattctttcatttggaaaattgcagacagcaactagtaacgccctctctggatatcacgtggaagacttagatgagggtaagtgccaaatgctgtgtaacttctggtagctgtgaataagggctttgcttttattaattattgggagaaaatttactgagttacagtacatataagtggagatgtaggagagaatataagattttaattttaagaagtaggtgtagttgaaagcaattttctccctggcaccttttcatagaataatggagtaatggaggtaggaggtaacttcagaggtcatttagtttattttcttgcctccgtgtaggactaaatttaaacatcattcttaacaatctatagagggaagacttttcttctctctctgtcctaagctagtacagttattactttttggaagttttgatctgtgagctgagttgttcctgccctaatgaaactctgtgatctcctctcctctcaccagaggaaagggaaaagaagaacattcattgagtgcctgctgaatgctgtgtactatgggcattggctttcacaaaacatgtactgacttagagtccttctgcatctttttgacaggtgatgaaactgacattaaggtttatgagttgccctaaagtcacacagctagtatagagatgaagcacagctttaaactcaacctggctgaatatctttcttttccttttctgggg

SEQ ID NO: 21216 - DNA, 1583 bp, Homo sapiens
catcatggaattaaaaaacagtcttttctttcccttcccttaccttcccccttcccttccccttttcttctttttttgagacagttttgttctgtcgctcaggctggagtgcagtggcgtaatcttggctcactgcaacctctgccttacgggctcaagcaattctcctgtctcagccccctgagtaactgggattacaggcgcctgctaccacgcccagctaatttttgtatttttagtagagaaggggtttcaccatgttggccaggctggtctcaaactcctgacctcaagtggtccacctgccttggcctcccaaagtgctgggattataggcgtgaaccaccgtgcccagcccattatttcttttttaatatgaaaaatgtaagacacacaggaaagtagagtaaatgatataataaacattcatattctcaaaactttggttgaacaactaatgttttgccatatttacttcattttttctgaaatatttaagaataattaaagacatcatgacatttatccctaaatacttcagtatgcctctctaaaaaataagatcaagactgcataaccacaatattattattagcataatagaattgatataattctctaataattccctaacctatctaaagtccagtccataatcaaatttacctgtttttctgtccccaaagttttttttttaaatagctgatttgtttaaaccaggaactgattaaaggttataaaattttaaagttggaattctgcttcaataagagtaaacatactctgagtgaggactcaagggcacctttgtaagttcctgggtttcagttccaagttcattgttgtattctggatagtgaagattgccaagccagcgaccaatggataagtgaggtagttaagtcacttttcattgtctgaacatcagttgtatttggcataacacaaaaactttgatgaaataatggttctatttttgcctttcgaatagtcattatataggaaacttacttttttttttgagtcttgttctgttgctgggctagaatgcagtggcgtgatcacagctcactgcaacctctgcctcctgggttcaagcgattctcctgcctcagcctcccaagtagctgggactacaggcatgcgccaccacgcccagctaatttttgtatttttagtagagacagggtttcaccatgttggccaggatggtctccatctcttgaccttgtgatctgcctgccttggcctcccaaggtgctaggattacaggtgtgagtcactgtgcccggccatttttttacactaaaaaaatgaatgaggtaaatggagaaagtaaaatcaaaagaacgtaatcttatcaactaagagtattgtaccacttgtaatatgtaggttaaacttaaccatcataaacatcaatgaaaattttttatgaggctgtaagatttgtaaagcctagctaagagttttgttaatgtaagaagtcatcattgcaaacaaaggggcttgggtcatctactgatgtttgttgttgtgagacttggcctgtgaagtaaatgattcagtaatcagcaacccct

SEQ ID NO: 21217 - DNA, 1842 bp, Homo sapiens
tacaaaaaattagccgggcgtggtggcaggtgcctgtagtcccagctactcgggagtctgaggcaggagaatggtgtgaacccgggaggtggagcttgcagtgagccgagatagagatagcaccactgcgtacagcctgggcaaaagagggagactccgtctcaaaaaaaaaaaaaaaaaaaaaaaagagtgtgtggtcaaaatggtaaatgatcttgggaagagtgtttgaaggggaacagatggattattccaggattcagttcagcaagtatttattgggcatctgctgtgagcccctttgtatcactgctcctctgagtggttctcaagttcttgtgatggcatgtgctgggttgaagcaggacactgcttgaggcttgaccatttgtgggttctggcttctgttgtctctctcttttttttttttttgtgagggagtctcgctctgttgcccaggctggagtacagtgacacgatctcgactcactgcagcctccgcctccctggttcaagtgattttcctgcctcagcctcctgagtatctgggattacaggtgcgcactaccatgccctgctaatttttgtatttttagtagagacggggtttcaccatgttgttcaggctggtcttgaacttctgacctcgtgatccacccgccttggcctcccaaagtgctgggattacaggtgtgagccaccgcgcccggccttctgttgtctctttgtggctgcttggattgctgagaagaccaccactgtctaggccatctttaactcattcagggcataccagtgtgccatggcacaccctttgagaagctctgttctgagggatccaaacatgaaggaaacattgttccgttgacaaggaactaattatctgtagagagaatggggcaccccaaaatgaaaggactaataggaatttcataggtgccattgaagggggccatacaaggtacttcgggattaagtggagggagcgatactgccttcttggggatatcagggaacacttccactgaagaggtggcatttaaatcacaccaccaggaagccgagaagcaaagggaagagggcattctggagggaagtctgggggttatgtcagaaatgtgggtgtcaggaaattgcatatccaagtttcctgggtcctaggatacataaaggaatataatggaaggtaagactgccaataggtcaggactgggttttggggagttttttttttaatatttaactttttgttatttttattttttataaagttaggggtcttgctatgttccccaggctgtcttgaactcctggcctgaagcacttggcctcccaaagtgctgggattacaggcctgagccaccacgcttggccttggaatttcttgaatgttagagtaaggatgagtatgatggattgtagggaagagaactgagagacagggcctttagttgggttcatagtagtctaagtgagggcgatgagaacctgaattgagttggtggccatggaaaggattcaagagttatcttggaggttgaatggagagatgtggtgactaattagatggggtagggtgggaacaattaattctgtatctctgtgtttttttttttcttttttctttcttttttttttttttttggagtacagtggctccatctcggctctttgtaacctctgcctcctaggttcaagcaattttcctgcttcagcctccctagtagctgggattagaggcacaagctaccacgcccacctaatttttgtattttttgtagagatgggggtctcccacgttgcccagctggtcttgaactcctgagctcaagccatccacct

SEQ ID NO: 21218 - DNA, 1032 bp, Homo sapiens
tctcgaattcctgggctcaagtgtcctcccacctcagcctcccaaagtgctgggattacagtgcgtgagacaccatgcctggccaatgagtgcagtttttgtgctgtatgttggttttggttttatcaaaatgtgtggttcctaataggataacttgttttactcctggtgtattatcatttatgtttatattatttgagttttattgttccaatctctaaatatatagcctagggagaatgttttatttttacatctgagttagagatgtggagaggttagtgtaagttgtcagaaactgtatttcagttgaatcagtatctgctcaagagcatgactttaaggatagcatgtgtgggtgttctcagatgccttcatttccggtaagcatgattactaatttattcttaaagtcattgaaaaattaaaccatagtttcctgtcttttagctccaagcattctttttatttctccttggaactctgtattttaaaatatctgttagggtgacggtaacttcataaaggaatcatttattttcctactttttttttcttttttttcttttctttttttttttttttttttgagacaggttctcactctgtcgcccatgctagagtgcagtggtgcgatcttggcttactgcagccttcacctccatggctcaagccagcctcccacttcagcctccagagtagctgggactacaggtatgcaccacaatgcccagctaatttttgtatttttttgtagagacaggtttcgccatgtagcccagcctggtctcgaactcctgagttcaagatatctgcccccttcggtctcctaaaatgctgtcattacaggcatgagccactgcacctggcctctgtttttattctttaaagacacatgtgactaccacttagagtctctgatcagaacaggatccaccagatgcagtggctcaggcctgtaatcccagcactttgggaggccgaggtgggatgatcgcttgaggtcaggagttcaagaccagcctggccaac

SEQ ID NO: 21219 - DNA, 1053 bp, Homo sapiens
attgtcaacggtatagtttgtcacatcctgcttattgtgacagtaagaatcaggaatcgtaagccattgagatcaactgaatacagatcaggtgagtgccaatccattcaacacgtattatatggaggttggtgcaaagagaagtgacaagtaaacgaggatccagccctaaaggaacttgtagaccacttaggaggtaagctatgtgcatcagtaactgatacaaggatggaaggatggaccatagtgtctgcagaagcagtggcatgtgcttggtgtgatgcagctcactgaactgcagtgatgaacagtatagacatggcatccctgctcttacagagttcgcattctactgagattggaaagacagtaaacaccaaaatagaatatagtttggggtaattgcagagtagagtcagtatggttgagtatgaaaggaagaggtactaagtgactactgatttttagagagtgttatccaaaaatgcctttgtaagaaaatgacgtttaatgttttgttgatactccagactgtggctttaggccaatgtgtgattctctcacatgtatgatgcaatttaatacccatgcttctgaattagaataccatatattaaaccacactttattgatcacagtcacgtgactaatagtaattgcaaatgtgatgggtgactgtcattaaatagtattttgcattttaactatttttgcccttcattttgttgccagatagtaaccatagagatgactttgatcaaagcgaaaggtgagatttaaactagtacagtaggggaagcgctgcactctagtggagagagctttggagcttgaggcaggagccccggatctagtgctgctcatttccttttgtggctaagcaagtcattttaagctgtttagtcctcagtctttttaatctctaaaatgaaatgattgaattaaataatgcctagccgtctttctagttctaagattctttcatcttttaggatttattagccttcaactttggagaatttatagatttgttcattgtttttttcctctgat

SEQ ID NO: 21220 - DNA, 1055 bp, Homo sapiens
agtcccagctgcttgggaggctgaggcaggagaattgcctgaacctgggaggcagaggtttcagggagctgagatcgtgccactgcactccagccagtctcacacacatacaaaaaataataaaacttcatgtatgaagaattatcacaatttgatgattccagaaagtccacatcagtggcttctaacatactttgtgtcacaaaaccctattagaaatggataaatactgtgatcctctaccaaggaaaaaagtatgtatataaacttttgtaatctatttcaatggttcttggactccttgaagtttatataacagaataaaaagactgaagaaaaataatgaagtgcaatgtgtggccttgtttggacctggtttactgctaacagtaaaaaggtatctctaagaaaactagggcaagtggaatatggactgagaatcagatgattaatttgttaattacagttaatttattgagtgtgataatgacatgatggttatggaaaaaatgtctacatagagatacatactgaacttctggtgaaacgtgatttctgggatttgttttaaaacactataggatttcaaaaagtggtcagtgacaactgaaccaagagtgataaatttggctgggagcagtgactcaacgcctgtaatcccagcactttgggaggccaaggcaggcagatcacttgaggtcaggagttcgagaccagcctggccaacatggcgaaaccctgtgtctattaaaaatacaaaaattagctgggcgtggtggcaggtacttgtaatcccagctatttgggaggctgaggcaggagacttgcttgaacccaaaaggtggaggttgcagtcagctgagaccatgccactgcactctagcctgggtgacagagcaaaagtccatctcaaaaaaaaaaaagtgataaactttgataattgtcacagctgaatgatggttgcttgggagttcattattctcttcgtatttgtgtagttttaaatttcccatagtaattaaaaaaaatcaagcctcccaaaacagaactactgt

SEQ ID NO: 21221 - DNA, 1024 bp, Homo sapiens
aagaggtcagaaagtttaccatttagcacaataaaattgccacagctgtaagggaaatcatgctaaataaacttcagggatgaagatgtggtactgtttgatccatgcagttatttcacagttccaaagggaatttagatttttaactatagcatgaaatgtcagacatacagtgtttccaattatttaactacgctttaataaactgggctttaaaaatatatagtgtagtcatcttcattaatctgtatcaatgggtaaattaactttaaaaatagctgagacttttctgttgaaccaataactacacatttccattggagatgctagatttttaggaggatgctttttgtcacacagacactataacatactatttctaaaatttattaaacaattttttttacataaccacaaaatcttttcaaactaagatcccttcctctatcccttctattctttgtcagaaaaatgttcaatcccagttatggatttcaggcctctggccttcagcatactggtgtggacaggctctggtggacattccattatacttcttgattctcttttcaatacatttaatttactacttcatatttctgggattccagctttcatgggaactcatgtttgttttggtaagtgatcattttttccacaagccaattataatagtagaatcaaaatgaaaattcattttcatgaatgttttgtcattagcaaaaggcatgtaatatgcaagaaaataagaaaattgccttaggcagctttatgacctgattatctcccctcctctttccctctatgacctgccatttctaatcttgccattgatcctcattatttgcaggtggtatgcataattggttgtgcagtttctcttatattcctcacatatgtgctttcattcatctttcgcaagtggagaaaaaataatggcttttggtcttttggcttttttattgtaagtatatatacatgcgtgcacatttatattaaatttccttgaagtttttttaaatgc

SEQ ID NO: 21222 - DNA, 1034 bp, Homo sapiens
ttttttttttctttttttgagatggagtttcgctcttgttgcccaggctggagtgcaatggcacgatcttgtctcactgcaacctccacttctggggttcaagtgattctcctgcctcagcctccctagtagttgggattacaggtgcccgccacctcacccagctaattttttgtatttttagtagagatggggttttactatgttggccaggctgttctcgaactcctgactcaggcaatccacctgcctcaacctcccaaagtgctgggattacaggcgtgagccaccgtgcctggcatcataatacctttccttttattttagtttcacatttcttaatagcactatggtattctgattcttaaaaataatacattgtctaatgtccatagccatacaaggataaaaaatgaaatgagctttacttaaattggaaagatttctgttaaacattcagaagaatggtataccttagaaagctttagtataaggaagtttaaaggggagattgtcgttgtttttccactgacattttatatagtcatttaactgaaagaataaaagtatatttaattatattaaatataaaatttgttctacagctatagaggtaattatagtaatggctactttctgtgccacatgctaaactaacatcttcaaaagcattatctcatttatttctcagaacaaccatatgaatagctaccatgaaaaactccattttacagatgagagtgagagaagataaataacttgctaatagtcacaaaatgtgtatggccacccatttagaataaatttagtcctgatttcagagcttttactcttaaccatttcgcacattacctctccaaacatttatgtttgtgacagttgaactaacaccttgtttctactataggctctcctggggattgacatacatttgcttcatcttcattatgtccatttttatggctctggtcataacatcaatcccaattgtatttcatactggcttcatggtgatattcacactctatagctta

SEQ ID NO: 21223 - DNA, 1024 bp, Homo sapiens
cagggactattcttcctgtatgcacagtgtaagctaatagccactttctgtcttagtctcacggaccactggactctgtctctttcttatataaaatatctcattccagctaccatgctcgcctgttccaaccacagctcctctctcactgtcttattctacatttatctaactcttgctttttagcataaatattcatggtttggccttgacagtattttttatacccctagagaaaatcagtgatgttagcactgtcctcataaaagtttcaccgcctgactctatattgggaaggatgaggagttttgaaaggtatggctacagcataaaataaacagctttttcatcttaatgtagatttcaccctgagtgagatacaaagttaataaaatttttagaacataatacataaacgtgaaaaaggaggcactaattggaccagtgattttcaaagcttctgttagtaatagatctattaaacacttagtgggtggattactcctgcagattgtaaactcattcatttatgcactgattactatacacttaattcttagagagtgttcttgacctcagagaatctgtaggtagactatattttttatttttgtactctgattttttgtatacaatttacctctagtgtactattttcatgtgatatcagtttataatcttggcagaaaaagagaaaacaccaaattctgagtatttgtattgcttactttaaatatttttccttttaattcttaaattattttagtcactaaagtaatatctactttaaaaaaagttgaatagtacaaacttgtatgaagcaaaaatatgagagcttttcctttcatcttcaccactacttcctctcctcccctaccccctctcctcccctacccctcattcaaattgtgtatatccttcaaggcaaatatgcacatggtcatatatagagtatgtttctatgcttacataggcacataaattcagttttctttaccaaaatgagatcacactaaaagcaata

SEQ ID NO: 21224 - DNA, 1088 bp, Homo sapiens
gaggttgcagtgagccgagattgcaccactgcattccagtctgggcaacagagggagactctgcctcaaaataaataaataaataaataaatagttaaaaaaatttatactttgtataatagtagaatttccttttttaataataacgttattcttactagcatgttttatgctgataagtccatgatgagcaaaatatacttcaaaagttgaaaaaccctctttacaaagagttgtagtacataatatttatacaggtatgtgtctgcatagaagtgttttaattcttcaaggacagtctgaagaattagttaaaactaagaaaaataagacttaaatataaatatctctaattgaatatattagatttgtaatggatatttttggctttgctattagtattcttaccatgtagttgtcaaatatgaaaaaaatttaaacatacagacttgagcaaagctcaaaacaaaaaactgacatagtgttctgattttcaaaatattaaaagctaatacaaactttattcatatgtgatcagttgttcctataacatctcctattctgtagcagactctttggggtttaacctttctaacacttcacctacattctagtatcattcctttttgattcactaattcaaaaaagactttgcccagtattaaaataataagcatggctaggaatgattataaattagtattaaaataatcactgttaaaatctggtgcgtgttatattacataaccttcattctttctggtaaagatgtatttattgatggataaatgagtgagaacatggaaaattacctggagcatggaaaattaatggaaaattactcgaatggaaaatgttaggttttgcaattttttttctttcattaggaaatttcattatgaattctcgttttggttttaaaatacattttatattgctaatatataatccttacactgtgctaatcttgacattttttatatgtgtccagggaattgtacatgtatctcaaatatttcttttttttttaaaggaacttggattcaaatcatatctttttgctttgagttaattctcattgatctgca

SEQ ID NO: 21225 - DNA, 1081 bp, Homo sapiens
ttaatttgactttaaataagtatattttgtaccttaggctatagccactagtgaacataaagagatcgtgtaaaaagagagcagttttgaaagccttaagtctctagttgatcttaccttggtccttctttatatcagtcttttttaattgaagtattttattttaccctctaaggtctaaaactatgaagtgatcttgtaactcctaccattttctttatctcctgtccacatctatagccaatatagcaaactcctgtagattcaatagtaatattaagtattgagcatatttccttttccacttgtattcctcattacctgtgtctgtattctacacctgtactgtcctgtatggtaactactagccatgtgtggcttttaaaatttaaattgattacaattaaatcaattaacaatttatttttttcagtagcacaggccacattccaagtgctcagtagccatatatggctgttagttactaaattgcatggtgcaatctagatgttctgtagaacattttgaccattataaaagttgtattgtgtaatactagtctagactagaggttcccaacccccaggacacagatcttactagctgcctgtgaggaactgggctgcacagtaggaggcatgtgagtgaagcttcatctgtattcacagctgctcctcattgcttgcattaccacctgagctccacctcctgtcagatcagtggcagcattcaattctcataggagtatgaaccctattgcgaaccgcgcatgtgaaggatctaggttgcatgcttcttatgagaatctaatgcctgatgatctgtcactgtctcccatcacccccagatgggaccgcctagttgcagaaaaacaagctcagggctcccactgattctaccttatagtgagttgtataattgtttcattatatattacaatgtaataataatagaaataaaattcacaataaatgtaatgcatttgaatcatcctgaaactatccttgctccctgtctgtggaaaaattttctatcacaaaaccagtccctggtgccaaaaaggctggggaccactagtcta

SEQ ID NO: 21226 - DNA, 1034 bp, Homo sapiens
aggtgaccacgtttcttatcaggatggctctaaacatcaggatgactcaacttatttattttatagggtataatcttaatttgtttctcacagaaataaacatggatatgtttttaatcaggtctctatgaaaataatttaaaaaatttaaagttattttacctgctacataataaatggattgtttattccacaggtatttagtacctcctctgctgtgcagtgagttgttttactagctgaaaatatttgaaggagataatggtatcattagataagtgatggattttgcgggggaggtgggggaagagagaggctcttctaaggaaagcactgcttttaacaaaggcagtaggtataatagtagaactaccttagattttaaaaaatactttatagctttcaaatttcttattttaattaattaaattcatgcatcctaaataatttttctctaacaattatttctaaaggttatgtacatttttattacttttagtgatgtggaatatgtttcgtaggacttggaacgtagtaaccagcacttttttttttttttttttttttttgagacggaatcttgctctgttgccaggctggattggcacagtgtcagctgactgcaactttcacctcccgggttcgagtgattctcctgcctcagcctcctgagtagctgggattacaggtgcccgccaccacacccagctaatttttgtatttttagtagagacagggtttcaccatgttggccgggatagtttctgtctcctgacctcgtgatcttcccgcctcagcctcccaaagtgctgggattacaggcgtgaaccactgtgcctggccgtagtaaccagtactttaagataaattaagaagtgaatttttgatattgaactttggattatgcaactcctggtctttaagtcaattaatacattagaaaaggaagatgggctttagtaggctttccattttcttgcaacttattggatttagtataaattattttatctagtaaattatttatctaggaa

SEQ ID NO: 21227 - DNA, 1123 bp, Homo sapiens
acagctctgcggctcgggccctgaggtgaggcgggcgtcgcgggcggcggcggcgcttgaggctagcctgggacagccgtccctgggggagttgaggggacgaggaggggctggccagcgagggacggcggggagagaaggggagttcggcgtctgaggtgtggggtgaagcgggctcggaagcgggcagaggcggcgagctgagggaaacagacctccctcagctcccgggaagcgcgggttgccagcctcggggatgcggtgggagcgcccaggatgcggacgtgagggggtcggggccctgcggcgggggctccgcgaggctcccctgggaccgggtccggccgtgggacttcgggacactgcctttgcctggacgctgtcgttccaccctcagcaacctcagggaaagaaggaaaacaaatattgatgtaaatttccgtctgaacagctgggtaatgagcgcttgctcttccctgcgaggttacgcgcggatcattaccttgcgtgttaaaaggagtttcagtgagaagaaaatgcgcagatctcatgacacagtttgggagggaaattccctgatcctaaaacacgaataggagctccaggcatggaaatacttaattggatcggaaagctgggcaggctggagctattaagctgaaggaggttttcccctgggctcctcaggcttcgatttacgttttaaataaataagtccgaaaataatgaagataataaccacgtttactttctacaagggcgttctgaaggaatctaagggaagaggagtatttgctggactacagctttaagccaggctcggtattagctcttttcattctgacagcaaccctgtaggattggagggggttattccagttgggcaggtgtggagaatgggcctcaaagaggttaagtaacttattaaggtctcagctagtaaaaggatggagttgagattccaacccgggctgccagaccctaattctggtgctttatttagtatattttgtgtttgccgggagagcaatattgtatgtgttttagggaagactccatagtagggaacattattagggcagttagggctttgtgggtatttgtgttaaaatcaaactaaaga

SEQ ID NO: 21228 - DNA, 1035 bp, Homo sapiens
acaacatttattagctcacagtttctgtggagcagggatctagatgtggcttagttggggttgctggcctggggtctctcctaaggctgcagtgaaggtggtggccggggctgcagtcatctgaaggctctagtggggcaggatccacttccaggctcactcaatggctgttggctaggtttagttccttgcagtctattggattggggccctagttcctggtatatggcctctctatagggcaggtcaccttgtggcagtagacaccatcaaagtcagagagagagagagagaaagaaagaaagaaagaaagaaagaaagaaaagaggggccagcaagatggaaatcacagccttttataagccagtcttgaaagtggtagctcatcacatttgtcctactctctgtgttacatgttaatttctaggtcgagcccacactccaggggagaggagtatacaaggcatgaatgccaggaggtggtgaccagtggggtcatcttagaaggctgccagttacatttgtattgactcattgaattcttgcaacaatgttaaaagtgggcaatattagccccattttacagatgaagaaactgaggtagagagaagttgaatcagctctcaaggccacagcaccaatgagtagtggcactgggattcaaacccaggcccctggctccaggattccacccttagccatgacctgaacccttgtctgtaggcccttataggtcatactgtggaccacctcactccttgaggccagagccaattgaatagatggctcttggtgcctgcgtttctggaatgctttgtagccagactggacattgaaggttcaccttttgatggctttaaatttatttttattattttattttttttttgagacagggtcttgctttgcctcccaggctggagtgcagtggtgtaatcatacctcactgcagcctcgaccttccaggcttgagtgatcatccagcctcagcctcccaaagtgttgggattacaagtgtgagccattgtgcctggc

SEQ ID NO: 21229 - DNA, 1022 bp, Homo sapiens
ctccctctcttcaggcgaaattccaggtctttaacctcctggaaggcattgttggcagtgccaaaaccatgccaaacatctgggtgagaactgcaaaatgagaccagttcttccaaagtttcccagctctgccactgggatggaatgtgatggaaggtgaatgtggcccccaagcacgtcgtcccatctgagcttggtggagcttcaggctgcaggttgtgcagggcccacgtgtaccacgtgtgtcagcctgatatggcttggctatgttcccacccaaatctcatcttgaattgtagctcccctaattcccttatgttgtgggaggggcccagtgggagataattgaatcatgggggtggtttcccatatgctgttctcatggtagtggataagtctcaggagatctgatggttttataaggggaaacccgtttcgcttggctgtcactcttctcttgtctgccgccatgtgagatgtgcctttcaccttctgccatgactgtgaggcctccccatccacgtggaattgtgagtccattaaatctctttcttttgtacattgcccagtcttgggtatgtctttatgaacagcgtgaaaacggactaatacacagccccacctctgtcttacccctttcttgcccttgccttggattgcttgttctgtctccttcattaaggcctggggaccctgggggcagggctgtgcattctgactcctgtgtcccttccctggcagtccccagccccgcctttcatggcggtgtatcttggagatgttcagaaaccactgaatacatccagatgttggctgttgtatataaaaatagttaaatgtcctcctggcattttaggtttccttcaaactgtatgtgattcagaagcagctgtacttactgcccaaagattagatagaaatgactttatgattctgagatttaaaatgaccgctccaccccaactgttaatggaaaactattaaaaaataaaattgcagtcaagttctttgtcctggtagaa

SEQ ID NO: 21230 - DNA, 1157 bp, Homo sapiens
gcatgccaaactctgcaagcatgtctcttgcagtggccctcatttggcctgagtatagaggaactcctccatcctcagggtgagctctgacaactctccaaggccgttcttggtatggtcgttcttgtctctccgccttccatgggaccactgggggccgagggcaccatttgggaggaactactccttctccagttctgcaagagggtcaggtacttctcagtagagtaacactgtcctgtagaactttctgcagtgatagaaatactcagtatctgcacggtccagtatggtagccatgaatcccctggggcttttgagtacttgaaaggtggctgctatgactgaggaaatggtgtgtaatcttgtttaattaatttaagtgtaaaaagccgcatgtggctactgtattagacatgccgtgttgttctagaatgtagaatgagagggtaatgtcaacagtttttctcagcaacagttctgagaccggataagtcccattatatatcttgctcagctctctcaagaaagcggttctcatggcctcctaacccatcagtgagtagcgctgtcagtgtcacgttttaaatgttgcttcacaaaagcactcttacggaggtagactctagccttcattagtggaatatgcaggtccttctctgccgcctccctctgccccatcctgccttaactaaaggcgttttactcttttgagggtaatatttgaagtcttagctcctggcgtacttttgtaccacctgctaaaaagctcattgctttcctggcagaagtgcccctggcagtgctatgatgggcttttggctgagaggcagagtgatcaacttctgcttttctctccggagaacacttggtagattggatgctgccaagagttccacagcattctgatgatgacatccatgattatagaggaggatagaactagtcccagggtctgatccatgaatgtatttgcccttagttcaggctcagcttcataaagaaccatggtattttaccaggttaatcaagtacagtctaaggtagcagaaaattaatattatgctttagaatgtgcagtagctctgcttattctaattagagaaaatgggtgtcttaattagacaaaaatatcgaaatttttagagcactttaaa

SEQ ID NO: 21231 - DNA, 1046 bp, Homo sapiens
atcttttattttattttattttattttattttattgttttgtttatggagttggagtctcactctgtggcccaggctggagtgcagtggcgcaatctcagctcactgcaacctccgcctcccaggttcaacctattctcctgccttagcttcctcaatagctggaattacaggcgtgtgtcaccatgcgcaggtaatttttgtattttaggtagagatggggtttcaccatattggccaggctggtctcaaactcatgacctcaggtgatccacccgcctcagcttcccaaagtgctgggattataggcgtgagccaccgtgcccagcctagtaagatcttttagacttgctgtgtccaattccatagtccctggccacctgtagttctctaaatttacatgagttaaactggaataaaatgcaaactttagctccttagcatgacttagccacacatcaaatacttgtatctagtggctactgtgttggacaacacaagatgtagaacgcttccatgatcacaggaagttctactggatgacactgcactagacccttagcaaaaaaaagtaacttcacaaattgtttgttgtgtagtgcctacccaagcttgccttgggaggagttccatttctggaagacagtgtaagagagctgttctcagtcatggggtatgtcctacatatattgtgaataaaataatttaaatgtcagccttttcacattgtttctgataaattcaggatgctgcagagtcatcctgtgataccattctcttgctcctgttggttctgagtttttttcttatttcctgagttggggactgaagtgggttgcgagttgtgccgggacttgtgtagcaggctcgagagcatcatgatgtctgatgtcgggggatggaaggagctgcacaagggctgaaatagtagctcatcatcttgtcctctggtgttatgtgttatctgccagtagacaacctctcctcaccccagcccaagccaacatcattggtctatgtcagcttagcccctctcacagaacagcc

SEQ ID NO: 21232 - DNA, 1034 bp, Homo sapiens
cccaggtagctgggattacaggcacctgcccccacgcccggctaacttttgtatttttagtagagacggggtttcgccattttggccaggctgtcctcaaactcgtgacctcaagtgatccgtccaccttggcctcccaaagtgctgggattacaggcatgagccaccgtgcccggcccctgctgtcgttctctccctcagcattctgctacatgagtttttccttgctgctgtctcctttccccagttcgttgatttgcccattgctataatcctgatgatgagaatagcactttataagtggtgaatgtggccggagaggaattgtggtgttagagtaatgaggggaaatgagacaggccatcaagtctatccgacccttgcctttccataagattccttcgctccccacttcaaatgatgatgaaacacaaagaaaatgggacttaagagggtaaaaaaacaatgtaaataattacgattgttggtttcaggataggaaatttaaagtgggcttcagtctgtagttgggtttggcaggtggactccttagggccttttttcttaccctgtatttccaccccagcaagagtggtggcaggggaggggcaaggtggggtacagcaggggcttggggtgggggttgctgctggggaaatggagctgcccttttaccgagcctggagacctgggcaggatctagcccaggcatccttcagcgcagcacagctaatgtccacctctgaaagtcatcacgttttcttttgttcctatttgggtttattaagagccagcggagttcctgcataaagcttaggagagtgcagccgaattacttgggctgatgggggtcggtcaagtggcttttacttaaacagttctgaacacttggcacccacttcaggctgagtcttgcatagtccccgaagggtctcctcctgctccagcaagagcatctgcttcctcttggcagtcgcctccctgagcaactgctgcaggggaaagagtgagggttctgaagtcaggagacgtgg

SEQ ID NO: 21233 - DNA, 1035 bp, Homo sapiens
ctgtttgttgtttctggggaggaaagcgagaaaggatgactatttcagaacttctgtgaggcaggaagatctttcaggttcccacttaagttctgcccgctccacatgggcaggaggtctcataccatcttcctgattcactcatttatttttgtttgtttgtttgagttggagtctcgctccgtcactctgtcacgtggactggagtgccatggtgtgatatcggctcactgcaatctccgcctcctgggttcaagtgattcttgtgcctcagcctcccgagtagctgggattataggcacgtgccactgtgcctggctaatttttgtatttttagtagagacagggtttcatcatgttggccaggctggtctcgaactcctgagctcaaatgatgcgcccgcctcggcctcccgaagtgcaggtattacagttctgagcccccgcacccagcgcgtgactcattcatttctgatggtgttttccttgtgctctccagcaggacaggaagagatatgagcaggagggactcgctgtgtgaaaacacaggaaatatctcactgcttcctaaatgccagctctctcttcccacttatctcctctggtgattgtgggactttaatcagcccattttccttcttctgggatggtcagtgccttatgctttagtggaattggctgttggagccttccaggaaggagcagatgctttgattaggcagccctgatctccggtgcaagagctggcccaggagcactgctggcaggatttgtgacttgaagggtggtctccatgttctcgtacactttaacaaggcaggtttccaggtgagtgtaagcaggtggaagataagacacatcatagtgatctatgaagtttgctgtccagggaaagcatcatttgaaacctaagtgtattttgattttgggcctttaatcggatttgtttaaggaaattctgccagtggatgttatgctgatttgtccattaaagccctgtttcattaaacaaggtctgtttcaggtgagttgcct

SEQ ID NO: 21234 - DNA, 1061 bp, Homo sapiens
gtctgaagcccagcttaagaacccctggaccagttctttcttcgtaattttccagtttgctttctccagagcgtgttgcatggagacccgtctgatgggtgctaataatgagtggtcaagtgagcttggaaaatgggattcaagtcaatgtgtttctgaagtgcaagacccctctaaggttaatttgctaacaggcaacgtgactctccccagaatcgcattcttcatacctactggaccagttagaattttccagaatgggtgggatgcaatggctgacgcctgtaatctcaacactttgggaggccaaggtgggaggatcgcttgagcccaggaggttgaggccacagtgagccataactgccccactttactccagcctcggtgacagaacaagactctgactcccaaaaaacaacaaaacaaaaagatttttccagaatgcactctgaggcaacctgctcttaggaaacggttctctgagattatttctgttgtctgaaaggtatggttttgagatacctctgtttagctttggggttccgtttgaatgtggatgttgttggttaatctttatatcctgtgagatgaccaggcttggctcccgtgccttggagagggagtggaaacatccctggtcatagtataagatctggaaccttctctggccagcatccttgtttgactggggagatacagtcatgcgtcagcgtggggcagttaaaggtaatttctacccatccaattgggatttgccaccctggcagtttggggtgaaggcctcacccatataatgacaccatgctggggtcctttgccctctggtatttggcatgcacctagcatcacccctacagcatgcccgtctcctcccttactgactggtggtcaccccatgggctgtagacgcttcctcagaatcctcctaaagaaacccatccgcctcgatggcctgtgtgacctgttttcatggagaaccagcctggcaagccggggctctctggacagttctcctgcccttggcagagacggcacggtagtgtcctgtcgcaagtcacata

SEQ ID NO: 21235 - DNA, 1089 bp, Homo sapiens
aggggtggtggggcggtatcagatgtatttggtcagctgtctgaatgtagggattttctctgggcggtgtaaacagtcattggctaatttgcactatgcagcagtaatttttttttgtgtgtgtgtgacggcgtctcactctgtcacccaggctggagtgcaatggcgtgatcttggctcaccgcaacctccacctcctgggttcaagtgattctcctgcctcagcctcctgagtagctgggattacaggcacctgctgccatgcctggctaatttttgtatttttagttgagatggggtttcaccatgttggccaggctggtcttgaactcctgacctcaagtgatcctcccaccttagcctcccaaagtgctgggattatagacatgagccaccgtgcccggctgcagcagtgtttttttttttttttttaaaccttttggttcatatttgttctaatatatgctttgaatatggaggagatcccagagggaagccctggatagaatcagtaatggtttgggagcagctggtgaatgtctggggagggattgcagcagctcagaaacagacatcatcaccacaaatgcccagaacctcactacttggcagaaaggtcagcctgacagtaaacatctgttctaggagatttaaaaagaaatgaattcttgctgtcgatgtgagagggggaatttgtcttagaaggtctcatacatggatgagaattacttatgattgctacagtcagtgaatacaaatgttgttgaaagagttgtgcttggaaacagtctgttgaccttcactctgaggctggccaaaggtttcctttggtttcactattaatttgctcaccagacctgaaaagggcagcagcttggatctatcgaagatgctctgtggggtcggagttaatgggttttgatcttgagtcgttgcggttggccaacatcgactgagcacccacgcgtttatagtctaacagggtaggagcagggctagaatttgtgttcaggatgtttgcccttcttgggatctatgaaccagtggcttttgaggctgtgggaagttttgtgggtaaattcagcccca

SEQ ID NO: 21236 - DNA, 1044 bp, Homo sapiens
taaggggtgttgcattgtggttttgatttgcatttccctgatcattagtgatgttgagcgttttttcttatgtttgttggccatttgtatatcttcatttgagaattgtccattcatgtccttaggccacttgttgatgggattgtttgtttttttcttgctgatttgtttgagttccttgtagattctggatattggtcctttgtcagatgtataggttgcaaaggttttctcccactctgtgggttgcctgtttgctgattatttcttttgctgtgaagaagctttttattatttatttatttatttatttatttatttattttattgttttttgacatggagcctcactctgtcgcccaggctggagtgtggtggtgcggtctcagctcactgcatcctctgtcaccagggttcaagcgattctcctgcctcagcctcccaagtagctgggactacaggcgcccaccaccatgcctggctattttttgtattttcagtagagacggagtttcaccatgttggccaggctggtcttaaacgctggacctcaaattatctgcctgtctcagcctcccagagtgctgggaccacaggtgtgagccactgtgcctgacctacagaagctttttagtttaaaagtcttatctgtttatcgttgtttttgttgcatttgcttttgggttcttggtcatgaaatctttgcctaagtcaatgtctagaagggtttttccagtgttatcttctagaatttttatggtttcaggtcttacatttaagtctttgatccatcttaagttgatttttgtataaggtgagagatgaggatccagttttgttcttctatatgtggctttccaatgatcccagcaccatttgttgaataggacgtcctttctccactttgtttttgtttgctttgtagaagatcagttggctgtaagtatttacctttatttctgggttctctattctattccattggtctacatgtctatttttataccagtaccatgctgttttggtgactgtagtcttaaagta

SEQ ID NO: 21237 - DNA, 1106 bp, Homo sapiens
gtatgcttatcaagatagctcctagacaagtacaaaagaaaaaaagaaaaggggccgggaacggtggctcacgtctgtaatcccaacactttgggaggccgaggcaggtggatcacctgaggtcaggagttagagaccagcctggccaacatggtgaaaccccgtgtctactaaaaatacaaagattagccgggtgtggtggcaggtacctgtaatcccagttacttggaaggctgaggcaggagaattgcttgaacccgggaagtggaggttgcagtgagtcaagatcatgccattgcactccagcctgggaaataagagtgaaactccgtctcaaaaaaaaaaaaaaggggaaaaagtagctaacacactgccactctcccctcctatgtccctggcagacatcactaatcaatcttagcactctttcctattgagccaggtagccatctcagaactcatctgacatcagccctccaggcagccctttaccgactgatcagagcggatacttgaggtgaaactgtccttacagaggttctgcctcattcggagggtacagaccctgccttcccatagattgtagcagttagtagggtcccaactggagcaggagatttggagggaggagggggctgagcaccctatatacctgactatctgtgctccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcgggtgagtgagctggcaccagccatgctggctggacttgagttttatgtatctcctttttggccagaacaggggtgatcaggtccctctcctggctcctggcagcgcacctgctctggtgggtggggcagcctagggtttctacacacaatctcaatctcttattttggtctcaactctaccaagagaaagaggggataacccagccaggtggagagtggtatgggagaggggaggccacacagtctaaagggtgtcaatctcccgccgacttcagggaacagtgccaagtctgga

SEQ ID NO: 21238 - DNA, 1050 bp, Homo sapiens
aatccctgggatcccaggtctctggacaggggctcccctggctccctgctgcatcctcccacagctctcagaaaagcagaggccccctgccttgtctcatttccccaccagtccctcccttcacccatttctcaccagattccacaccaggcaatggtatctgtgattcaggggaaaatttcccactgtcgcccagagggtccaccttggattccagcgtgtggaagggttggttgggaggtggcagagcacggtggggctactcctaggcctggcacagagagcaagccgaggtccactctcagctctgcttctgccaagccctacaaccttgagcaagttctgtgtcccctctgtgcctcagtttccccatctgtatatatgggaagttggaccagataaccatgtggtcccatccagatcagtcaggcagtgcttgtttgacctgccagcatccctccacctgctgcgtagatggctgggctgcctgagtctcagccaaagcccagtgataattacagccatgctggcaaataggtatgtagtgttcacggggcatggtgctgggagctttgctcacgttgactcatttaatcctcacaacaaccctgagggaggtgttgctattatcctcttcattaccaaggaggacatggaggcacagagagttggataacttgtgcaaagacacacagcctgtaagtagtggagttagatttaaactcattctgactccagaatctgtgttctttctgttgttcctgagctccaagagccccaggattcctggccagaaaataagcttccccctgtccccacccatcctctcaccttcctgagctgtaattaggcgtaggaggtgtgcaggggtctgggcggatggaagggaggatcggtcccgtttggtttctttctcagcacagcttggttttaatgcagcttttagctgccttatgattacctcactcacatccagaactgccaggaagaaggcggcatcccggcccctgtttcctggccctgagagcctcctctcagccctaggagatc

SEQ ID NO: 21239 - DNA, 1075 bp, Homo sapiens
tttgagaggccaaggcaggcagatcacttgaggtcaggagtttgagaccagcctggccaacatagcaaaaccctgtctttactaaaaatataagaattagccgggtgtggtggcatgcacctgtaatcccagctactcaggaggctgaggcaggaaaatcacttgaaccgggaaggcggaggttgcagtaagccaagatcgtaccattgcacttcagcctgggtaacaagagcaaaactctgtctcaaaaaaaaaaaaaagactgggcacagtggctcacgcctgtaatcccaacactttcggaggccaaggcgggcagatcacaaggtcaggagatcgagaccatcctggctaacaaagtgaaaccctgtccctactaaaaatacaaaaaattagccaggggtagtggcgcgcacctgtagtcctagctactcgggaggctgaggcaggagaatcgcttgaacccgggaggcagaggctgcagtgagccaagatcatgccactgtactccagcctgggcaacagatcgagactgtctcaaaaaaaaaagaggtagaaactgatacccagaaaggggactgaagggagacaggacttccagaagttgatgtcaccaggtgacctgtggcctttgagtccatcaatcctgaacagatttaggattagggttaaggcatggactctggaatggccctgcatttctaaattcattagcattcatttgtcatttacttattcattcaccgacattcactaatccatgctgagaacatttcttcagtgtctggatgtacatcatgcagaaataaccacacacagccatggaggctgtgacctgggaaagggcagaattccaaggggatacctggaagccccttgcccagtcttggggtaggggccagggaagcttcctttgggtggcctcggcgtctgggcatgaacgtgctgtctctgggtctggttgacagcatcagcaccgtgtttagcattctctgcaaactaaacgtggcgggatgtaggcagtaagaggttggggagggggtggcaggaggggccctgggaggctggggactgg

SEQ ID NO: 21240 - DNA, 1070 bp, Homo sapiens
gaagctgctgcacctctctgggccccaggggtctcgtctgtgaagcgagcggttgaacttgtgggtccctgttgctgcttttgcacccccccactactcccaataagttctgaggagagacgggactccctgtggtagagacaaagggccactgctgattggaggggaggaggtccagaagctccttctaaaacggaaagaaagagaggggaagtggccttgaccttggtccagcaaggggcagtgggccaccagacctcgtgggttctctgccaaccatgagagccagtaaaagggataaagaaggtgaccagggcaggagcagagcccagtgtccaggggtgcacaacggcctgcttccctccagattgggtgcagccccagatgggtgacaccaggatggccgtgggccctaggagtgactggggaggaggccgcgtgtgtgtggtgtgtgctggccggcaggcatgtgcaggcttctgtgtataatctggcttgtaaattgctcggggactgtaactgcggaaagggccatagagccgcgtggtgttattatttatgataaagcacagaggtgcctgccagggactagaatgggctgagcactgcgtgcaggatggacggcaaattgaactccaattttctgctcggcagtctttgttacacgccacaaagcgctggtacaccggggtcaccagcctgatgaatgtgtgttcttcctcagcggtggctccatctctcagcctccgtgcagagagcgactcgtgctttgttttttcctccctgcggggcccagccttggaatctgttcctgggctccaaacgcagcctggacagaggggaggtcagaggccttgcatggaggcaggcggctatgggttcaaaacccagctctgccactgacacacatgtgactgggtacctctctcatctgagcttcagatgagagaaataaaagagaagtcctcatagcactcccctaaggaggctgggaggattaaatgggtaaacatgcgctgctcagtgtggagtaggcctttaacaaatacccatctttccttcttgtccct

SEQ ID NO: 21241 - DNA, 1059 bp, Homo sapiens
atctgggtgttgcttgtggggccccggtgcaggcaggagagtccagttgaaatcagtatttaggtttttctttctccccatagagaagagagaaaaggggaggagatggtgcattctttccttcccatgggtggttttcccatctcagctaactttcgtttgtttctcagctacctttttagtctttgaaatgaggccacgtcctgggagccaggctgcagacagagccagggaggcaggcgttttctctccaggccgctactgcagtgagtgagagtacctctcattctgtagggactggtggcccacagttccagaagccaggcaaagagctcctatctagggggagggttgagaccccatttgagagcccatcctccaggatcttgtaggagagacacatggcttggtgcgggggccctgaagttctgttaacttgggcactgacttcccatgtgaggtgggaaaggcactccatctcattgggccttggtttcttcatctgtctaatgaagctggatttgaacctggctgtgtgtgggtcctccatagtccactgcctaataatgctgagctgtgaacttcacaggctggatgataaaaggagatacagtcaatgcaaaagtgcttgaacattttaaagtgccatgaaaaagtgcttgaatattattctgttcctccctcccttcctcccttccttcctttcttcctccctctcccctccctcccttcctccctccctccttcccttccttcctaactgaagttaatttcagaataaggcatccgagtctctttccatctctacctgggcatggtcgttgtcattaatggagaaattctggaaggttccacaggaaatctggcagaaccctaggcagagctagtcacagccacatcttttcagatttgccagcccctctgacatgtgctcagtgaggctgtggggtcagagtctttactccccatcaatctactggcagaactttggggctgcccctttacagcagacctgcacccctcctgcctcagcagaaggcgcttcactcccaggtggca

SEQ ID NO: 21242 - DNA, 1627 bp, Homo sapiens
attacatttcttcaacaagtattgattttactttttgttttagggggaactaacttaattgattcaaactgcaaactctcccttggggcagtagctcaaatctcagttcagtacatttatcctcagctgggttacttgcagtctgccctgagtacatatagttcaggggtcagccagagatttaggcatcatctatacaaagaatttgatgttcccctcactggctctccactttccaggatccatcctcactttctggtgcctgtggttgccctgaattctagactgtgagtttcctcttggaggtttttcttatgttgtaattgaggtgaaattcacatgacataaaattaaccattataaaatgaataattcagtagcgttgagtacattcacaatattgtgcaaccatcacctctatctagtttcaagacattttatcaccccaaaaggaaaccccttacccattaagcagttgctccccactcctttccagcccctggcaacaactcagccacaatctgtatctgtggatttacctattctggatgtttcacataaatggagtcatacaatatgtgaccttttgtatctggcttcttttactgagcataatgttttcaaggtccatccgtgttgaagcttgtagcagtacttcattcctttttaattgctaattactatttcattgcatgtatatgccacgtgcacttgttaatggacttttgtgccatttccccctgttggctgttgttcacagtgcatgaataggtgtgtgcatgtgtttgtttgagaccttgttctcagttcttttgggtctatacctaggagtggaactattgaatcatgtggtaattctatgtttaactttttgaggaacgaacaaactattttccacagttactgaaccattttacaatctcaccagcaatgtacaaaggttttgatttcttcacaccaacacttgttatttttcatttgtttaattatagctgacctggtgggtgtgaagtgttaccttatgggggttttgatttgtatttccctgatgactaatggtgctgaccatcttttcatgtgcttgttggccgtttgtatatcttctctggagaaatttctgttcaagtccattgtctttttttttttttttgagacaggatctcactttgttgcccaggatggagagcagaggtacagacacagttcactgcagcctcaaccccctgggcttaagcaatcctcctacctcagccccccacatagctgggactatgggcacatgccaccacacccagctaatttttgtacgttttgtagagacagggtttcaccatgttgcccaggctggtcttgaactcctgggctcaagcaaactgcctgcctcagtgtcccaaagtgctgagattactggcatgagccagccaccacatccagcctaatttttaattatgttttgttgttgttgttgttgttgttcagttgtaaggtttcattacatattctggatactagacccttgtcagatgtatgatttgcaaatattttctttcattctatagattgcctttcactttcctgatcatgccctttgatacacaaaagattttaattttgatgaagtccacct

SEQ ID NO: 21243 - DNA, 1046 bp, Homo sapiens
cgatgctgagctgagccagttttctcatctgtaaaatgagtaaagttaaaaatagttgtgtctaccagccaggcacagtggctcacgcctgtaatcccagcactttgggaggccgaggccggcagatcacttgaggtcaggagttcgagaccagcctggccaacgtggggaaaccccatctctattaaaaatgaaaaaattagccaggcgtggtagtgggagcctatagtccaaactacttgggagactgaggcaggagaatctcttgaacctgggaggcggaggtggcagtgagctgagatcgtgccactgtactccagcctacacaacagagcgagaccctgtctcattaaaaaaaaaaaaaaaaaagactgttatctaccttttagagttgtcttggataatcaaatgagattgtccagatcactttgaaaatgccctttgtaaatgttaagttcttataatgtgtccattacagtccaggagggtgtcctgatcactgcccctctactccccagacatgaacctcccctcccacctcatctcctcactccccctgcattcactcctgtccccacactgactgcctgttgttcctggaatttaccaggcctccaacctggcacttgaagttcctgcctttccatcagtggtgcccacaccacccagatgtctacaaagttcacccttgtttcctccaggacttcctcctaatatgtcttatccatctcggagcaccctataacgtggcatcttccagcacccactccctcgctctccatcattttctccattgcactcagctccagctgacatatattgacttgtttgtttattattggtgtctctggagggcaggggctttgtttcattcactggtatatttctagccactagggcagtgcctggcacgtaggaggagtcagcataatatgaagactgaatgaatgaatgaatgcttactggaggcatacagcccacggtcatctggcccctcccagctctccagcttcctgccaggcctctcgccccatctccagagctga

SEQ ID NO: 21244 - DNA, 1025 bp, Homo sapiens
acttaacccttggtttggggtagattcaagtatggttagtcccatagttggggtgggctggggaccctcagaaaaaggtctctggagcatgttgtcatattacaggaggaggccctcctgtttctgctccttcatggtcctcagtttcccccaagtggctactgactatccccatgaggcagcatactgactccatgaggtaaagaggtcagctttgaagtcaggttgctgggttgcaagctgtgaggcctttcacacttctttgtgcctgtttcctcgtctgcagaatggtaatgatagtagcaacttcagagttgttgagaattaaatgagatggtgtctgccaagtgcccgcactggagcctggcacacggcgtcagcgccgctcctgttgtctctcctagagcccagctgcaggggtaagggccttggcactgaggccgttctcgcgatgctgtcttacggtaagaaagtgtgagcagacaatgcgggaagtgggcaggccccaggtgaactttgttcaggtgtgagggttgggggcaggtgaaggttcctcctctgcagcttgggacaggagggtgggggcaggcgcctccttacttgcccctgtctcatctcctctgcgaggagtgaccacgctaggtctgaccaagtttgaggctaaaattgggcaaggaaatgaaccaagcatccggatgttccagaaacttcactttgagcaggtaaggatgtcctggggcagagtggggcttagacctgggtggtgggcctggtggtggtaatactgtaacttagcaggctttgttctctctggctcacgtaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccag

SEQ ID NO: 21245 - DNA, 1098 bp, Homo sapiens
cttttcatactaagttttcaaaatccagtgtgtatttgtcttggttccgatcagccacattccaagggctcgacagctccttgtggcttgaggctgctgtgtgggactctgcagcttagagaccgggtcggggagtgtgtgacaaatacctcgaagggcagggaggcccagcccacatggggcactcatggactgtgggggacacgtgagcacggggtggggggagggtgtcacacgtgccacgtggcagagttgagtatttgagcaggtagctcccactgggagctgtgttggctgcatagggtctgtgcccggcaggtggcggtcgacctccgccttccagactctggtccctacatgacacgccttattcttcaggtttcctagccttctgttcaaccttccaccctactccagaagagaagggagccaggcgaccccctccaccagccacagtccgaggctggccagagttttctttctcaccagccttatcaggcaaactgccaccctttgtccctcacttaacctctctgggtctcagcttcctcatctgtaagctgagcagcttgaaccctgacatctcttgagtctgagtggagtcattctgtggcttgggagctggttggctgagcgtgggctctgctccctgaggggaagcccaccttctccacaggcctccattcccatctctgaggacccaagggagggtatctgccccttaagaccctaaggggtatgaatgtgtcctaatcatggctctgggcttcccacacccactctttccaagccactccctgacgtggtgctaaaatgcttgttgaatgaggctgaccttcccacgtggccagagaggtgtggccagggggctgggccccagtgcagcctctgcagccttgtccctctcctgctgcagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactg

SEQ ID NO: 21246 - DNA, 1170 bp, Homo sapiens
tgcggctgggtggcagcgtcgcagggtcccacgcaggcggcgcggcttccggggcggcctggaggccagggcagtgccccgggggcccggcaggtggcgcgggcgagccgacccttccccggcgccgcgcgaggagatgagctcacggcgggccccgcagcgccggacgctggttgcgcgctcccaggcgccgagcggccccgggcacgcgcgcgcgccaccggcccggcaggtgggtcccggctcccacgccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccgggg

SEQ ID NO: 21247 - DNA, 1111 bp, Homo sapiens
gaaaatagttttcccatacgagggcatatggttgtcctcacaagcagcagtgttctggagctgtttggtgggtgacccgtacttgcggtaacccagagaagccatgaggggatccaggactgtatcactgtagattctggaggtcggttggaagatctctagaggagtctaataaaaggttctgttgctgcttagttctgctgtgacacctctctctcccagaaagtagactttgtcttcgtcaggctcccttattctcctatgtgtttgccattttccagaacctcttctccaggtttctctcttagaaaaaccaaaccaaacaaaaaaactggccgggcacagtggctcacacctataatcccagcaatttgagaggccaaggtgggcagatcacctgaggccaggagttcaagaccagcctggccaacatggtgaaaccccatctctactaaaaatacaaaaattagctgggcaacgtggcatgcgcctgtaatcccagctactcgggaggctgtggcaggagaatcgcctgaacccaggaggtggaggttgcagtgagccaagatcgcgccactgcacttcagcctgggcgacagagcaagactccgtcttaaaaaaaaaaaacaactaatacttgccattcttctttctccttccttactgagggtttcattccagatgtttgggagcctgaattttcattttcagagataatttctgtttcattttaacagagtttaacataatgctggttgtttgaagttaaaaggagtcttatatccgtataactgataatacttcgagtgaaaccgttcacagacctaaaagatagcataattgtcttgtaactatctttttaaagggaaaaggaaatgattgggtttttttgttgtcttatttcttttcaggttttgaacgaagaatgtgatcagaactggtacaaggcagagcttaatggaaaagacggcttcattcccaagaactacatagaaatgaaaccacatccgtaagttaagctccattagtcttggaagggttggacccacctccttgtttcaaacactctttttaaaattgagatcactgggatggatgtcatactttttat

SEQ ID NO: 21248 - DNA, 1029 bp, Homo sapiens
tctggaagtttgaataatagctgtcacatcttttggaagactgcagtgggctcttccagcaattcttgaatccagcagtccccaacctttttgctaccagggactggtttcatggaagacaatttttccatggaagtggggggtcgagatggttcaggatgactgttcaacctcagatcatcaggcattagattcttacaaggagcgggcaacctagatccctcgcgtgagcagtttacagtagggtttgtgttcctacgagaagcactggcaatgtggtgaaaccccatctctactaaaaatagaaaaattagccggttgtggtggcaggcacctgtaatcccagctactcaggaggctgaggcaggagaatcgcttgaacatgggaagtggaggttgttgcagtgagcagagatcgcaccattgcactgcagcctgggagacaagagtgaaactccatctcccccccccccccaaaaaaaaagaccatgaataaactttgcttgtacaactctgaataccagaaaacaatgtctcttccaagttctgagggaaaatgctgttcagcccaggattctgttgaaatctatacccagccgaaatagccttcaagtataaacatagaatcaagacatttccagacatgcaaggactcaaaacatttgcccctcacgcaccctttcgtttttgttttttttttgagacagagtctcgctctgtcacccaggctggagtacagtggtgtgatctcggctcactgcaacctccgcctcccgggtccaagcaattctcctgcctcagcctcccaagtagctgggattacaggcatgcaccaccatgcttggctaattttttgtatttttagtagagacggagtttctccatgttggccaggctggtcttgaactcctgacctcagatgatccgcctgcctcggcctcccaaagtgctgggattacaggcatgagccactgtacctggccagaattttttttgttgttgcccaggctggagtgcagtggcgcagtc

SEQ ID NO: 21249 - DNA, 1094 bp, Homo sapiens
cacagggagggaagtttacatagtggttacagacatggactctggaattggtcagacctgggttccgatcctgcctcttccacttgtaagctctgtctccttgggcaaggtatctggtttttctgggtggaccttagattcttcatctgtaaaatggttatagtacctatacaccttacagagttgtgaagatgaaatggcctaatttgtcatgaattctggtacataataaatctttactaaatgtaagctgctgtttgctaaaggagagactaactcatttctcaaacatgttgagtgtctacataggtatgtaataaaaccacagccactactgtgaaggatatgggctggcgatttaagcccagttggtttgagttcactagtagaggcaatgtacaaggcagcttggtggctatgcgtactattaattgggcaaggtaatatgggagatagaatattttttggaacatactgagttccatttggttatggttaagtttgtggttcttgtgagacatagagggaaagagatgtattgggctgttagatatgctggtttaggctgcagagatttgggcatatccaaatagaatacaggcagcaatgaagtttgtgcagaggttggctctttctaaagtgaaactgtagagttagaacaatatcaaaaagcaaaccttgaggaatgccaaactttttttttttttttttttttttttttttttttttttttgagacggagtcttgctctgtcgcccaggctggagtgcagtggggcgatctccgcttgctgcaatctccacctcccgggttcacgccattctcctgcctcagcctcccgagtagctgggactacaggcacctgctaccatgcccggctaatttttttgtatttttagtagagatggggtttcgccatgttggccaggatggtctcgatctcttgacttggtgatccaccctcctcggcctcccaaagtgctgggattacaggcgtgagccaccatgcccggcccgctagtttgctcttaagctcagcaaaaattcagagttgtgatttaataagcgtgagacttagtaaagcattttgtaaa

SEQ ID NO: 21250 - DNA, 1049 bp, Homo sapiens
catcaactgacatttcagttcttccaggcctggaatagtgggtttcagtcaacaaggcaccaatatctttttaaatttgcccatagtagccagcttttggggtgtatgaatattagtggcagccttggagcttgaacgttgcatcaatgacctctgttaacagctaaccatatgatatccacaaaataatgaatttacatttctcatgggccctggctttagccattacctcgagagtcagtctgagcatcacttttaagcattcattcattgagtgtccctgtctcttagtactgtgatggtccatgttttgagtaagtaatgccatccttcaagcaaaggaacatatatatgctttgagttgtttttctggtagtggtaggtacatttgcatcagagtcagtaagttcttaaataccatcagccatagtcaaaaacagttttttttttttgagacggagtctctgttgcccaggctggagtgcagtggcacgatcttggctcactgcagcctctgcctctctggttcaagcaattatcctgtctcggcctcctgagtagctggggactacaggcatgcacccccacacccggctaatttttttttttttttttttggtggagacggtttcaccatgttgcccagactggtcttgaacccctgacctcaagtgatcagcccgcctcggcctcccaaagtgctgggattacaggtgtaagctactgcgcctggcccagaaacagtttttaaccagtgcaactcatacccatccatccagagtccttgtctcagtctcacattctgatctaacagctgagctcagagcagcaaaggaataaatgggagtttttctcaatataaggttgactatgccttcttatattttgccttcttaaattttcatatctttggctcatggactgtggtgtaaagaaaccttcaattttcctataacattgtgctgctactcctgttccagcttaaaatcatttaaatacgttacttttgatatgtcgcattgtgaactcctaggttaggaatgtctagg

SEQ ID NO: 21251 - DNA, 1116 bp, Homo sapiens
tcagcctcctgagtagctgggattacaagcatctaccaccatgcccagctaatttttgtatttttagtagagacagtgtttcaccatgttggccgggctggtctcaaaatcctgaacgcaggtaatatgcctgcctcagcctcccaaagtgttgggattatagaagtgagccaccacggtcagccttattttcatttttgaaacagggtcttgctctgtcacccaggctgggatgcggtggcatgatcttgactcattgcaaccttgacctctcagtctcaaggaatcctcctacttcagcctcctgaataggtgggactacagctgtgcactaccacacctggataatttaagggtttttttgtttgtttgtttgtttgctttttttttttttttttttttttttttttggtagagccaggaggtctcactgttgcccacgctggtctcgaactcctgggctcaagcgatccgcctgcctcccaaagtgctgggattaccgacatgagctaccgcgcccggcctctgtaaataaagcctttctatacacaaatgaggtcaaactagagagagaggccatttaggaaaaattgctgtcttttcctctttttttatcatatacatagatctctttctgaatggtctcccaaggagtaattgttgtctccaagtaactgaatttcaggtgacttttactcttcatactcttgaattagttaccatatgtatcagttttattatttattttattttatgttatgttatgttattttgagacaagagtctctgttgcccaggctggagtacagtggtgtgatctcacctcactgcaacctccacctcccgggttcaagcgattctcctgccttagcctcttgagtagctgggattataggcatgtgccaccacgcccggcttattttttgtatttttagtagagacagggtttcaccatgtcggccaggctggtctcaaactcccgacctcaggcgatccacccgccttggcctcccaaagtgctgggattacaggggtgagccaccatgcccagctatcagttttattaaaagaaaaaagttacattcagatagtaagcagtttacattctgcatctag

SEQ ID NO: 21252 - DNA, 1050 bp, Homo sapiens
agataggggcattttaataagtctcctaagaaaggaatgccctttgattatgatcctcaatggagaagatcagtggagagccaatccctagtttggttggttagagttttcacaagttataagtcctgagtttcagtgcacaagtcccatttcaggggttcaaattacctaatctaaataaaaagccaggcatgctcgtgcaagcctgaaggccccacctgctcatgaagctgagagaggaagattgcttgagcccaggagttggagcccaacctgggcaacaaagcgagaccccatctccaaattaaaaaaaaaaaaaagtgtttttcttccccccccccactattttaaagtcctagtatcagtatactctgtagaaccatttattttttcctcccaaagtgctgggattacaggtgtgagccattgcacccagcctttgccttttggtaagaattcttatcaatcttgttgactaaaccagaatattgcatttaatctttaagaaggaggttagtttgtggtcaggcgtggtggctcacgcctgaatcccaacactttggggaggccgaggcgcatggatcatttgaggtcaggagttcgagaccagcctggccaacatggtgaaaccccatctctactaaaaatacaaaaaacagccgggcccggtggtgcgcgtgcgtacctgtaatcccagctactcgggaggctgagggaggagaatcgcttgaacccgggatgtggaggttccagtgagccaagattgtgccattccactccagcctgggcaaccgagagagactccatctcaaaaaaacaaaaacaaaaaaggaagggagcagtttgttgtttgagtgctcttaaagcaaataatctgcttgctttttattatattcattttgtcagctgaatggactatttccaaataggtgctgagaatgaactttcatttcctataaaagattctttttgggagactggctgaagatgattcttcctcctgtttggagaaagaaatgagtaaggaaatgtagtattccttcagaatct

SEQ ID NO: 21253 - DNA, 1043 bp, Homo sapiens
ggtcatggccgtgggttgctctgggggtcagggcagggtcctgctctcttttttttttttttttatctctgtcgcccaggctggagtgcagtggtgcgatttcagctcactgcaacctccgcctcccgggttcacgccattctcctgcctcagcctcccgagtagctgggactacaggcacccgccaccacgcctggctaatttttggtatttttagtagagtcagggtttcaccgtgttagccaggatggtctcgatctcctgacctcatgatccgcccgcctcggcctcccaaagtgctgggattacaggcgtgagccactgcgcccggccaccaagggtcctgctctctgcttctcttctccctctcccttccaggagttgtttaaaggctttgcccgccacctctcacacttgctgactcagaagacctctcctggaaggagcggtgagcgctggcattgccagggccaggaggcacttgggagggtggtctacagggaggaggctaacgctcacctcctcatgcccccaccctgaatctgtagtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccaccc

SEQ ID NO: 21254 - DNA, 1063 bp, Homo sapiens
ggacacagccaaaccatatcagaggtgaagggtaaagagaacaaggggatgtgcctttccaggcaggataggagcaggacgctgcctggaactgaggctttgagtagcatcaagctggaaggtagaagacaatggagccagcccttgagatcctgggggactggatttccatcctaggattccatgcccagccaaactgtcagtcagggatgaagcccgaacagagacacttgcagacacgtcagcctccatcctcaggaagcacccagagggcagacttttcaaaaatgaagaagtaaatcagtgaagggaaaagggaggtctgggatccaggaaacggggaattcaacacaaaggagaagtaatcaagcatctgcagtctccagaaacatgagcacaaacaagctggctgggcgcggtggctcccgcctgcaatcgcagcacttcgggaggctgcaaacctccctaggaaatgtggtaacacacctctctaccaaaaatacaaaaattagttggccatggtggtgcacacctgtggtcccagctacttgggaggctgaactgggaggattgctggagcccaggatgttaaggctgtagtgagctgtgatctcaccagcctgggtgacagaacaagaccctttctttaactaaataaataaatatttaaaaattaaaaagttacacaaggcttagcaatgtcttgagttaaaaaagggaacctggggctggacacagtggctcacgcctgtaatcccagcactttgggaggccgaggcaggtggatcacgaggtcaggagttcgagaccaacctggccaatatggtgaaaccccgtctctactaaaaatacaaaaattagctgggtgtggtgggcacctatagtcccagctgaggctgaggcagaagaatcgctttaacccgggaggcagaggttgcagtgagccaagattgcaccactgcactcccgcctgggtcacagagcaagactctgtctcaaaaaaaaaaaaaaaaggaactcaagtggggcgaggtggctcacacctgtaatcccaacactttgg

SEQ ID NO: 21255 - DNA, 1033 bp, Homo sapiens
cctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaagggagggctgtctgctttttgtaacttgaaaaactggacatctatgttatatgtactcatggataaatatttcacaataaaactttttaaaaggataatacgtgtaatatacatacccccaatatatataatgtttttatatttgtaaaaaaaaaaaacctcccacgacgaccccaccccgatcactgccgtcattgcagcctccatcttgtggccctgctcctagcctgtggctgtttgttcaagagcagggcagggccttggattggcacagcccaggcaaggactttccagcaagatcctcaggtgggagctccccagacatgggaagggaatctgacatgtgcagccccacagccaggaggcgggcaggaccttgctgaccagctaggggcaatggtgggagctgaaagcccagccaggcaggatgtattggcctggccagatggctgtcattgctgtccccacctcatagtccctcctaatccaaggctgcagcagaagcacccaacgggctgagccgcgctctgaaaggggcagagagaggaagagttggcccctt

SEQ ID NO: 21256 - DNA, 1887 bp, Homo sapiens
ctggccccagccctgccgcgcgctgaccccgccccgggcagctgctggagctcttctgccagaccaagggctgttgtgtttgcagcttgtgcaccatgagtgagggtcacctcctcaagtgggtgctgccgccaggagcaggagggggccggaccccccgcagcctggccaccaccgggtgcagtggctcacgcctgtaatcccagcactttgggaggcggaggccggtggatcacgaggtcaggagattgagaccatcctggctaacatggtgaaaccctgtctctactaaaaatacaaaaaattagccaggcctggtggcgggcgcctgtagtcccagctcctctggtggctgaggctggagaatggcgtgaacccgggaggcggagcttgctgtgagctccaaagctcaggagcggggagctggaagtcgagagctgggaatcattagcgctaggaggaagagaaggttccaagctggagctcccagggagatggggaaggtcgggggaatggcagccctgtgtggcacctggagacaggggtgccaggaagagaacgggcaggatgcccatgctgatcagaggctcagtacgaggacagaaatgaccttcagcatcggtactgtggaggtggtccgtgcccttgacaaaacccatttcagcagcgaagacaggatgtggaatcattcggggacagaggaggcctggggctaaggcgtggatggaggatggcgcagggacgctggatgggacaggaagggaaggggtggccaggaggcctgatgggcagggagggatgggagagtgcacggctgggggtcggtgaggtgggaggactgagacagaggtggctggaacaggagagggcacgaaggcagtggtcagagaaggaagaatcgatgcctagaatggagattttagagctggtgacagggccagggtgagttcacaggagcggctgagatgaggtgaaggaaaagggctccagagtgttgcgggacattccttgtagctgctgaagccgccgaggaggatgagacgagatgtactgctcatgggcgggtgcagaagactgagctaggcacggaagtttgagttggaggccggtagatgagggccatgtggaggaagggagcgacaggggcagccagtagcaccaggggagccaggattttgcaagagagagggaaagggacatgggggtgcctgtccctgggggagggttgggtgccctgggagagcctgccctccggcctcctgtgttcctgtgtgaaatgctggaggctgggggcccggaggagctctgggcttaggaagatctgaggactttgaccaaattatcaacttctctgagcccgtttcctcctctgtgatgtggggatagtaatggtccccatctcagtgcattgcgggaggagcagaaacaaggtggtgaagcttttgaccaggtgctgggaatggagcccctgggacctgcgtggtttgtcctgctctcatgagagcacggtgttttgattcccaagggactcagggagcgcaaccgaataggggtcccttcctcccctctcagtctcaaaactagggccagggactggccggatccccagaagaatctagtttatccagcaagtaactgcccacttgtcagacagctttggtgctttgggaggtccctgcagtcagcttctcaagccccagggcctcctgggccactgacccctctgcagtgagacagggaccaacggctttagtgtttggggtcctccctgcgaggcctcctgagccagcattatcgctttcctgtattgatgggtggggggttaggcccagagaggacaggtgcttggcctcagcttgctcagcatgcaagaggtagaaatgggaa

SEQ ID NO: 21257 - DNA, 1099 bp, Homo sapiens
tcctatttgaacgacctgcccagtcagcgcatccagccacagcaggtagcagtctggccaaccatggtggatatcaacagccccgaaagcctaaccgaagcatataaactccgtgcagccaggtgagctctccctcaagagctagaatacgcagcagtggggctggggccctgacagatggcaagaaggcatgagtactgttgatcatttcctcagacctccaatctatgtcttaacagattagtagaaattgctgcaaaaaaccttcaaaaagaagtgattcacagaaaaagcaaggaggtagcttggaacctaacttctgttgaccttgttcgagcaagtgaggtcagtggtagttctctctttttccccttccctgccctcagcatcccgcattttctggtacagaaaccctagtcactgtatattgaatctttttccaaggttctcaaactctggtgttttctttttaatcttaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggtcagtattttctaagtataagtcttttttgttgttgttttaagaaaaataattgttggctgggcacggtggctcatgcctgtaatcccagcactttgggagcccaaggcgggtacggtgatcacttgaggtcaggagttcaagaccagcctggcctggtgaaaccctgtctctactaaaaatacaaaaattagccaggtgcagtggcacatgcctgtaatcccagctactagggaggctgaggcacgagaatcatttgaaccctggaggcagaggttgcagtgagccaagatgaaaccactgcattccagcctgggtgacagagcaatactctgtctcaaaaaaaaaaaaaaagaaaaagaaaaatagccaggcacagtggctcatgcctgtaatcccaacactttggccaaggcgggcagatcacctgaggtcgggagttcgagaccagcctgaccaacatggagaaaccccat

SEQ ID NO: 21258 - DNA, 1034 bp, Homo sapiens
gtggctcatgcctgtaatcccaccactgtgggaggctgaggcaagagaatcgcttgaacttgggaggcggagcttgcagtgagccaagatcgcaccactgcactaaagcctgggtgacagagggagactccatcacaaaaaaaaaaaaaaaaaaaaaaaagcctcaatttaaatctaagacctgccacatacgagctgtgtgacctcaggcagattcttaacctctcagtttcccatttgtaaaatggagatagtaatagtaactacctcacagtgcccttaagaggactaaataagttaaaataccaagtgcttagattagaacctggcatatagaaagttctgtataaacatttacttactactttttttctttttctatgtcacgtagtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgaggtatgagtttggtctcattcactcatgggcacccttctgtttcgtggttgcctgttggatgaggtccagagataactaaatgttggtatttcctgaaaagaagtatgtattctgagaacttcttctggttgaaagtagatcagatatgaagatctgtggggtttgttgttcagtatttttagtgttatcagaaatactgtaccatgttgattatttgtcaatcaaggaaatgtaagtggtgaatgtttagccaagtagaacagcttagatgggcatgggtagtgttctgtattcttctggccagtcggacagctgtgcttcttcagtttgcatgtgtggcagctgtgttttgacagtggccaagatgttagaggaggggtgtgttttctcattggttctcgggctctcagcaccacagatgtcctgacagatctgtgcttgtcctctcagcttcatgccctcaccgctggactgaaggct

SEQ ID NO: 21259 - DNA, 1038 bp, Homo sapiens
acattatatattttatttatttataatttatatgtaagaagccacatgtagctagtgattactgttttggacagcactgccttaagggataacaaggaagtagtttaaattaatattcttatttttatcctaaaattttctctacgtaaatgtatgagaaataagtagaaaagaaagtaataactattagcttaagggaatttctttctgaaagctaggtgtgatgctgtcagcagaaaggctttctggacacatactattggtttagtctagtgttagatttaacatattctttcttcttttttctaccctttaaaaatgtatgaacgtttgcccacccctcccttgttctctttgatattacagttggaaagacttcaaatcatgcaatagttcttgcccagctcatcactaaggggaaatgctatggattacatgcctttatcgtacctattcgtgaaatcgggacccataagcctttgccaggtaagaactgttcatctgatgttgagatgaaaatgaaactgagcactttcttctgcaaaaggtagaatgcccaactgaagaggcggagcaaaagccagaaattccagagcataaacatctcgtgactgtcctttcatctgtggtaggaattaccgttggtgacatcggccccaaatttggttatgatgagatagacaatggctacctcaaaatggacaaccatcgtattcccagagaaaacatgctgatgaagtatgcccaggtatgttttgatagaaaataaagcagaggcatcaaacagtggagttgagtggctgttactcacaatagggttagaatggtctgttcttttagaaggtaataacagcagggcacactggcatattcctgttatcccagcactttgggaggctgagtgcgtggatgacttgagcccaggagctcaagatcagtctgggcaacatagtgagaacccatctctacaaaaagtaaaaaaatctagctgggtatggtggcacacgtgtgtagtcccagctacttgggagactgggg

SEQ ID NO: 21260 - DNA, 1023 bp, Homo sapiens
ttgaactcctgacctcaggcgatctgcccacctcggcctcccaaagtgctgggattagaagtgtaagccactgcacccggcctctttctcgctctctttctgtcttcttcccttcctccattcctttcgttcctttctttctttattcctcacccatggactggggtcacattgccttgtttcgtattaccatctatttaggaatatagagattgtatgatacatagttatccttgaagctgatgcagtatcctggcaaattgccatcattaacacttaaatatgaaataatgcacctttctttgaaactggaaagaggtagtaaacttgatttttaagtcatcagtctttaccgcactccgttgccctctctccctaggcttaacagtctcctcttccctctgcccaagtgattctcttccctgttggacttctcatgagacttgcttccctggggatttgggctaaatttcaccaatattagtgataataatataaactttatgaaagctgtgttctggccaggcacggtggctcacgcctgtaatcccagcactttgggaggccagcgtgggtggatcacctgaggtcgggagttcgagaccagcctgaccaacatggagaaaccccgtccgtactaaaaatacaaaattacctgggtgtgatggtgcgtgcctgtaatcccagctactagggaggctgaggcaggagaagcttttgaacctgggaggtggaagttgtggtgagctgagattgcgccattgcgctctagcctgggtaacaacagtgagactccgtctcaaaaaataaataaataaataaataaataagacgctgtattctttggggtcatacttctggaatacctctcagaaatgaattactatattgagggacatgagcattttagagcttttgctgcatagtttgaggcttttcctgaaacacagaaccagttgacaatatattgagcaagctctgtacctgtatttccacagctccatcaacgtggtcactttaatt

SEQ ID NO: 21261 - DNA, 1055 bp, Homo sapiens
aaatctatgacacagcacagccaaggccaactactgtggattctgttttgtaagaagagagttgaggactaaatttcaatgtgatgtagagttaatccgtagtaatgttcattgaccattggggataaatttttacatgcccacattacttattgtaaaccctgaagacctttagcgatgtatgattctgccctggaatatgtatttactcttttggatatttgcttatattatctagggaaacatagttgaaattatttcttccttggagctcttgttaacagcgctataaataagtgttctatggagttatttttgctctttgaaacaaacaggtaaaacctaaataaagcaaaaaaaaaaaaccacacacattctaaaaaattcaaccaatcaaaccagcaaataacaccaacaacctccccttccaaaaattagagaagtttttatgctaaaacttaggtagaatttgcttagtggattaaatgtaaatacgaaatgaactgtgggaactgtggccttgaaataattagaagaagagagatcatcaggttctgctgctggctttttaggtagtaaaatggtaaatcttatatttaatttcataagaagggggtttacattttcctgaccttctccttgaaggccaaagctgtttggcaagaaggggttgtaggatgcagtttctaaaggaaggctgagatccttttctcttctctcctgtagactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggttagtccacattgagggtctgtgggtaacccacctcaggacatcagttaacagtgattgctggcatttgacttttttctgctgctacctgtttgggattctatttttaagttgttaagtcaaaattcaacttcttgttttctcctagacattttccctggaaactgg

SEQ ID NO: 21262 - DNA, 1036 bp, Homo sapiens
gtggtgggtcatgcttgtaatcccagcactttgggaggctgaggcggggaggtcaccttaggtcaggagtttaagaccagcctggccagcgtggtgaaaccccgtctctacaaaaatacaaaaattagccaggcatgatggcgggttcccgtaatcccaactactcaggaagctgaggcaggagaattgcttaaacccaggaggcagaggttgcagcgagctgagattgcgccattgcactccagcctgggtgacaagagcaagactccatctcaaaaaaaaaaaaaaaaagtttttacttttccttctatggcagtaaaggtcatagtcatgaatggctttgccactgactgactttgtcatgttggttaagacgatggccaatcagtgagtctcaatttccccatctataaaattaccttgcaggaatattttaaggactcaaaaaatgatggcgggacctgatggctgacgcctgtagtcgcagcattttgggagactgaggtgggtggattgcttgaggccaggagtttgagaccagcctggccaacatggcgaaaccctgtctctactaaaaatacaaaaattagccaggcatggtggtgcatgcctgtaatcccagccgcttgggaggctgaggcataagaatcgcttgaacccagaaggcggaggttgcagcgagcggagatcatgccactgcactccagcctgggctggacgagaccctctctcaaaaaaaaagataactattacaatctaatttgcattttagaaaattaattctataaattaattcacagtataggtaatgaatcagagagacagaaaataagaagaccagttaggaagtaatttattttaagaaaaaatacatgaaataactgaataggattaacagcattgcaaataaacatggtgcagactttctaccctagaaccatggaccaatttataaccttgcagagaaggccccagggctgatgatcattgttgtgacttgtttgaagcctcgattggccactttttggtactatgc

SEQ ID NO: 21263 - DNA, 1070 bp, Homo sapiens
tgaagggggaagattgcttgagcccaggagttaaaggttgcagtgagctgtgatcatgccactgcactccagactgagtgacagagtgagaccctgtctctaaagtgtgtgcttgtgtgtgtgtagccataataactgttttaatatccatctctgctaattctaacacatatgccagtgttgagttggtctcagttggttgagttatctcctcattatgggtcatgtcttcctgcctctttgtatgcctggcaatctttgatcaggtgccagccattgtgacttttcctgcattggatggtacatatttttgtattttttttttcttttgagatggagtcttgctgtgtcgcccaggccggagtgcagtggcacaatctctgctcactgcaatctccgcctcctgggttcaagcgattctcctgcctcagcctcctgagtagctgggattacaggtgtgtgccaccatgcctggctaatttttgtatttttagtagagacggggtttcaccatgttggccaggctggttccgaactcctgcactcaggtgatcctcccgcgttggcctcccaaagtgttgggattaccggtgtgggacaccacacccggccatatttttgtattcttatacattttattgagcctgtttcccccaggacacagctacttaaaaacagtttgattgcttcaggccttgcttttatgattttatgatttgttaggtgggtccataggtgtgttcagtctagggctgattattctccatttctgaggcaacacttttctgagtacactctgctctgtgctacttgaatgatgagtttttccaaactggttgataagaacaggcaccatttccagccccatggcaggcagggcactgcttcttcaagccctgcaggtggttctttccccaatcttgggacgtctccccacatgcatgtactcatcaaatgcgtgctcatcactcggaggggatcctccacagacctctggagtgggagtgggctttctgtcatctcccttctttctggttatttttttttttttttttttttgagacagagcc

SEQ ID NO: 21264 - DNA, 1097 bp, Homo sapiens
tgtatttttagcagaggggtttcactatgttggctaggctggccttgaaccccttacctcaggtgatccacccgcctcggcctcccaaagtgctgggattacaggtgtgagccaccaagcctggccgtttttttgagatcaattaatttatggcaggctgggcgcggtggcttacacctgtaatcccagcactttgggaggccgaggtgggtcgatcacttgaggtcgggagttcaagaccagcctggccaacatagtgaaaccccgtctctgctaaaaatacaaaaaattagccgggcatggtaccacgcatctgtaatcccagctactcgggaggctgaggcaggagaatcatgtcaacccgggaggcagaggttgcagtgagccgagatcgtgccattgcactacagcctgggcgacagagcaagactccctctcaaaagtaaaaaaaaaattatggcagcacagaaaagggacaattagccaccagttagtcatctagtggctaattggaactgcctgaatagtgagtgggttgtcttttccaagttgcttcacctttgattgaacaaaatatgtggactgtctgaggggaccagggccccaggactgcatcccttagacatggggccatagacatggggccaccactctggaatggacgcagctgatgacacaaagcatggttgccaggaaaccctcaagtctttccttatgtggccccgccaagagtgagtgaatcctggcctttctaggttaaggggatggatggagtctagctggatcttaggaggcctcctcagcccgttgccaaggctccccttgtgatccttgtggtggcctttacttccccccgcccccgtggctcgcagggaggcgtgttgttacgtggaatcttcagggcacgcgggggcccccacgtttcaaacgtccgccggcgcggggactgggagtccagggctccagctcggggacccgaggccagcgacagacagcggaggggtggccatcgcggaccccgccggggagcggaggcgcagattccctggaggcaggagctctgtccagtgactcggccggacccggggcaggggcgc

SEQ ID NO: 21265 - DNA, 1029 bp, Homo sapiens
ctacttaaaatattttcaacttataatgatgcgtttatccagacataaccctgtcataagttgagagttatgttgagggtctgtatatgtctatttgcataacggtttgcttgggtactttaatttgacaccctaggagcatttctcttgaggctggaattcttcccttatgatctgagagttttgcatagcactggggctcactgtgtttctgcatggagaccatgccattcctaagatttttgtcttgtgttctgaggccatgtaacttttcctttgcataaaattagttaattttggtttataaaaactatactcggtggaacaaggttttgtagtttggaacttaggctgtgggaactcaatgttagataagcttttctgtgtaaccagcttggagaacagacttcagtaacagcgtttgttttccatcactgtgtgactaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctct

SEQ ID NO: 21266 - DNA, 1092 bp, Homo sapiens
gaggcgggcggatcacgaggtcaggagatcgagaccatcctggctaacatggtgaaaccccgtctccactaaaaaatacaaaaaaattagccgggcgtggtggcgggcacctatagtcccagctacttaggaggctgagataggagaaaggcgtgaacccaggaggcagagcttgcagtgagccgagatcgcgccactgcactccagcctgggctacagagcaagactccatctcaaaaaaaaacaaaataaatgaataaaaaacaaaagttagctgggcatggtggcatgcgcctgtagtccagctgtttgagaggctaaggcaggagaagtgcttgaacccaggaggcagaggtgagctgagatcgcgccactgcactctagcctgggcgacagagtgagactgtctcaccaaagaaaaaaaaaagttatacattcgtttgcatgttaaactaaatgcttccccaaatacaattactgtcttctggaattcctaccatttgtcacactgtactgttacctgtttacttctctccaggctttttttggggacagtctcactctgtcaccccggctggagtgcagtggcacagtcttggctcactgcagcctctacctcctgggttcaagtgattctcctgcctcagcctccctagtaggtgggattacaggtgcccaccaccatgcccagttaatttttgtatttttagtagagacagggtttcactatgttggccaggctggtcttgaactcctgacctcaagtgatccatgcacctcagcctcccaaagttttgggatttcaggcgtgagccaccactccccaagctttaaactcctcaaggacaaagggttttcccatggtttgcactgaccccaggccagtgtccgtcagctcagctctgctgaaaagcttctagttgttacgtgtggtgcataaactgctcctggttcatacccatcaagagaggtttttgcactgcattttatcttgcaccgtggcctgtttctagcctatctctgtttcagagatcgtcgcccttgcttccctcagggcagggggctgacacctggggaatcctggcctgcttg

SEQ ID NO: 21267 - DNA, 1038 bp, Homo sapiens
ctaccatagacatgcagagctagatcgtatacctcctcggaggcggacatgttgggtcctggccaaaaagttggaaacacctggggccactaccgaggtaggctgctcctcccaagaaagtgagaccgaaagagctcccgtggaagcggtcaaagcaggggcggggcgaacctgtgacatgcccctcggaagaacaggcttttagagagtcgccaggctccctgccctcatccgagatggcggcctgagggcgctctagccgacgctcttcggatgcccggagggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagtaagggggcggtgggagggccgggccgggggcggcggcgcctagctctccttcgcgcccggagggacccgctcccctccacccgccccacctcctgcacctggggcgggaggcgcgggccttcccagccggacaaagcttggaggtgacggataccgccccccgctccccggttttgcagctgggaggcttggggcggactctcggtgacctcagccccccgccccgtgactgggtccgcggcctgcctgcctttcgtctccgcagtcccacaccccggggcgggccgagctttctggagccccggagtgcgtgtcttggggaaaggggctcagggcttggcttcctttcccacggc

SEQ ID NO: 21268 - DNA, 1056 bp, Homo sapiens
catagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctgtgagtcagcccttgcctggtcttcgccttcccccgccttctcggggctcctgtttgtgtcaccagatctgggtgcagggtggttagtcccctcgccagaccccagctactgccccagggcaaaccatttccctgtgtggtcacagtgctgaggccagcagcggcgagtgggaagtctgtgggtgtgctcacctgtccagccaggttggcagatggagctccagggcctctccatgagggactgactattctcttcccccctctagcaaatcattcttttaagaaaattgagttccagcctccagaagccaagaagttcttcagcacagtgcggaaggagatggcgctgctggctacctcactgcctgagggc

SEQ ID NO: 21269 - DNA, 1026 bp, Homo sapiens
acatgattgggcctggtccctgcgtcccctctctggaaggaggaggccggcattaatgagcaatgtctccctgtggcctattatcatggtatagatggggaaatgggtatgtgctttgcggaatatcacggtgtggaggctggggggcttcgaggagctgggtggatcagtgtgggggtgcctggggccctagcctggctcctcacgctcccgtcatcccctgcttctgctcatctggtcactgggctccagccaggggcctcacaggcagatccgccccccacctccctgtaggcacgcgggcacacacgtgccatcaccccttccacacactcaggtgcacaggcgtagacaagcgtatgcccacctgtcccttgtctgcttccgcaggggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaaggtgggatccatggggaaaggaggcaggggtggggaccctaatggctctgcttaccgcccccctcccttccagattgtggatccgctggcccggggccgggccttccgccacccggaggagatggacaggccccacgccccgcacccaccgctgacccccggagtcctgtccctcacctccttcaccagtgtccgttctggctactcccacctgccacgccgcaagagaatgtctgtggcccacatgagcttgcaagctgccgctgccctcctcaaggtgcggggctccctcctgcagggcccccacctctgcccggcctcccttccttgcccctcccttccactcctcatagtagcatcccctaaagctcacctgggcatctgcctacggtgccaaggacagtggatgtgctgggatccctgggcaaagagggaccccga

SEQ ID NO: 21270 - DNA, 1049 bp, Homo sapiens
atcgtgctttgcagtttgtgaaacacttttttacccagtttatgtcacaagacagacattattcacattttagagaaaaagatccggagctcccatgggccagtagacttgcctgagatcacacagcacgttcgtagcaggacggagactagaacttgggtctcacggttgctttcaactgcactgtgccggatctcttggcaggaagtgagcctcgccagccccaggtcctccccctttcccccgagggtccttccctgcctctggtaacgtttgtccttcccttcctatctcgtccacagcccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggc

SEQ ID NO: 21271 - DNA, 1068 bp, Homo sapiens
ggtccagagaactaaaggtcacagggacaggcagggttgggctggcagaactaggccaccgaggctggggccttcctataggaccaaccagcagggcagggtctgtctctcctcgagtgtcactcctgacacctgatacagggtttgtacattgcaggttcccaggacacgcttgttaaataaatgaccaaatgaacacattaatttattttaatgcttagttcaaatggcttctgcctctgcatatgatactgtgtgtatttgtgtatgtgtatgtctctctgtgtgtatgtatgtttatgtgtatctgtgtgtgtgactgtgtgtatgtgtatgctatgtgtgtctataagtgtatatgtctgtatgtgtgtaaatgtgtatgtgtcggtgtatatgtgtgtgtgtatgtgtgaatgtgtatgtctgtgtatgcatgtgtatctgtgattatgtgtgtgtgtttctgtgtgtctgttttatttgtgtgtgtacatgtatgtctgtgtgtatgtgtgtgaatgttcgtatatgtgtatgtctgtgtatgcatgtgtatgtgtgaatgtgtgtgtgaatgtgtatgtatgtgtatgtttatgtgtatgtgtgtgtatatgtgtgtgaatatgtttgtatatgtgtatgtgtgtgtgaatgtgttatgtgtgtctgtgtgtatgtgtatgtgtgtgaatatgtatatgtgtatgtctgtgtgtgtgtgaatgtgtgttgtgtgtgtgtgtgtgaatgtgtgtctctgtgaatgtgtgtatgtctgtgtgtgtattatatgtttgtataggtatatgactgtgtttgtgtatgtgtgtgtgtgaatgtatgtgtctctgtgtgtgtgtgtctgtgtgtgtgaatgtgggtgtctctgtgtgtgaatatgtgtgtgtgtgtgtgtgtgaatgtgtgtgtgttcacatagggacaggattggcctctcctccccaggtgcacaggctgagtctgttagtaaatttttaaaaattttctcagtcccccactacagtcatcatccccactagggggcacatgtgtcacacagag

SEQ ID NO: 21272 - DNA, 1059 bp, Homo sapiens
cttctgagtgttatttttcaggcaaacaccttggcttcatttttttttgtttctgggtttttttggtttgtttttgagataaggtttcaccctggcacgcaggctggagtgcagtggtgcaatcataacttattgtagcctggacctcccgggctcaagtgatcctcccgcctcagcctcctgagtggccgggacgacaggcgagcgccaccacgcccagctgattatttttattttgcagagatgaggtctcactatgttgcccgggttggtctcaaactcctggcctcaagcagtcctcctgttttggcctcccaaagtgctgggattacaaaggtgagccactgcgcccggtctggcttcgtttttgaaataaaaataaggcaaaaacgacatcaacaatcagggccagaatttgcacctatttgaaagctagtttaagtttgcaagaccgagagccttttctccattccagtctccctgttctcatccacccattaacagtgatctctgtggccttcggtgtgggttatattgtcctgcagatggtaatatgttgcagatacttatcttcaaattaccacatttgcttatgtttacctcctttcatttgattgtaagctcttcaagagcagaagtctctttttattattattattatttttttttttttttttttttgagatggacttttgctcttgttgcccaggctggaatgcaatggcacgatctcggctcacggcaacctccgcctcccaagctcaagtgattctcctgcctcagcctcctgagtagctgggattacaggcatgcgccaccacgcccagctaattttgtatttttagtagagatggggtttctccatgttaggctgttctcaaactcctgacctcaggtgatccacccgtctcagcctcccaaagtgctgggattacaggcgtgagccaccacgcccagcctctttttatttttatttttttctttttaatttcttaacagtgcagggtttggtatttacctgctatgctcacagtaagtcttcagcaaataatcattaat

SEQ ID NO: 21273 - DNA, 1112 bp, Homo sapiens
accctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaattactgtgtgttttttcagtttgctttgttttaaaacaaaatcccttttgaacccattgaagtttgacctttctttcattttgatgc

SEQ ID NO: 21274 - DNA, 1033 bp, Homo sapiens
tcgccttggcctcccaaagtactgggattacaggcataagccactgcgcccggccctcaagagattttaaaaactgaccacttgtcttcttcttcttcttcttcttttatttatttatttacttatttatttagagaaccaggctggggtgcattggcacaatcatagctcactgcagccttgacctcttgggctcaagggatcctcatgcctcggcctcctaagtagctgggactacaggtgcacaccaccacagccagctaattgttaaactttttgtagagatggtgtcttgctatgttgcctaggcctggtctcgaactcctggcctcaatccaacctcctgcctctgcctcctgaggctgtgtgattacagatgtgaattgctgtgcccagcccttatcttctattactatatttcaagctggtcatggtcaaaattgttcaacctggttttcccccataaaattaagtcactttcttcaaccctcttccatcagattttattcatctcttagttttcttctctgtcctatattttctctatctcaaaatgtagcacctagaattcgacctgatattccctgataggggttgcggagagtacagattgctgcccaagagtgttttgttgttattgttgttttccttttttgttttttaaatgaagcttttggtgtcctctaaatcctctttgtaggaacttgccagaaactgttaaatctgataggattgaatctggcatgctccagtcatctgagcaagagtttgtttagggcttgtgaatgtgcccttgatcgggatgtgaggttggaatgcaggacgatgcttttggtctggacattggaacgcagcagtcggccctgggcaggggttggggcccggatggggtcggctcctcgcaggaacagtgatcctgtctctccccagacaccccccacccacaacatactccctccttgtctgcggcttacccagcacactccctctgctctttgccctgctggaagagctcatgcccataatatcaact

SEQ ID NO: 21275 - DNA, 1070 bp, Homo sapiens
aatgtaaaaaatgctgtgtaggaggaaggcgtataaggatgccccagctgtaggttctttagattgtctgtagtatttccacgagtaagttgtttttgatgtgtgtactggtattgctggtagatttgaagtggagtctggcggcttcttccacactcccctcccactagcttgtgtcaagatgtgacatcctatgcagcaaaactaggtgagcttgcacccccaggcggtggctctcaactttgtctcattgttcagaaatttcggccaggcgccgtagctcacccctgtaatcccagcactttgggaggccatggcaggtggatcacttgaggtcaggagttcaagaccagcctggccaacacggtgaaaccccgtctctactaaaaatacaaaaattagccaggtgtggtggcacatgcctgtagtcccagctacttggtcaactcaggcaggagaatcacttgaacccaggaggcagaggttgcagtgagctgagatcaagccactccagcctgggtgacagaccgagactctgtctttaaaaaaaaagaaatgtcatctaagccccagtgaacctcctgggaggagagctagccctggccagctgtctccaaagtgactggatgctacagaagaactgggactgtcttctgcacactcgtgcctcctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttggagttgtgtttttggcattgttttgtccttattttctttcttactcatttgaaagtcaacaatgtactttgtcagcagaacaggactttaaaaaaatgtatttacactttaaaacaatgggatggagcacaaaattaaggccctgggccaggagcattgatgcacacctgtaatcccagctgcccaagaggctaaggcaggaggatcacttgagcccaggatgtcgaggctgcagaaagctatga

SEQ ID NO: 21276 - DNA, 1209 bp, Homo sapiens
gaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcagaatatgtctcggtctttttttcccccatttatttgaaggacctattcaattttgtgattgtggctgactgcatagtatggaagtggaatgtttagtgcctatcatttcctaagttaaagtggaaatgccagttgaacacctaaaagcaatgctttaagtggcacttttcttgaggttgtgatacccccttctcaacctaatttatatcctatttaatgactaaggaacaatccaagtacttgtaatacgtattttaatttttgtttcatatgagtttaagtgttgtctaggtgacatcaaaatctaaggcaaacagacttgaccatcttcagacccactgcattctcaagctgaagtggtctgctcatagtttgtgtgccaggttgctcatcagtattgatactgtcccagaacaggttgtaggtataattcagagactgtcctttgcaaaggaaatgaccagc

SEQ ID NO: 21277 - DNA, 1562 bp, Homo sapiens
attaaccccgctgtgcttgctcgtcccgcccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacga

SEQ ID NO: 21278 - DNA, 1015 bp, Homo sapiens
tggctggagtgcaatggtaccatctcggctcaccgacacctccacctccccggttcaagcgattctcctgcctcaacctcccgagtagctgcgattacaggcacgtaccaccacgccagttcattttgtatttttagtagagacgggtttctccatgttggtcatgctgctctcgaactcccgacctcaggtgatccacctgcctcggcctcccaaagtgctgggattacaggtgtgagccaccgcacctggtccacaacacatttttttaacctttccaccatgtggtaataatgcagtcaaaatatacatcatgttactttgcacagatctaaattacacccagaagaaattgaagacactgtcattcctattttccattctcatctcagccttaccagtcaatatcaacttcaattaaaatggctgtcaaatcagtactaatttgattccttgcactgaagggttgcccatatttaaaaatacttgagccacaataaggagccaatggggcgaagctaccatctgtgggattatgactgaacgcctttaagtcagaatcccacccaggcagacggatacagcagtgcccgtggggcctcggttggcctccaatggcctcagagagccggtccctcccccgccgagcgccaggactggggtccggtgcagaaagcccctcgtcctgggaaaggcagtcgcccccttgcccgttgggccacccatgttcgtggggaacctggctctaaaccattcatagacgacctgcagaattctgggtcggggatttgtatgtagcagagcacctccctcactgcgatctattgaaagtcagccctcaacacaagggtttgtttaaaaaaaaaaaaagaagaagaagaaagaagaaaagaagagaaagaaagagagaaagagaggaaggaaggaagggaggggaggggaggggagggaagggaaacaaacaaaaattaaaatatagtacttgagccaaccaggcactcatgttaaacacaaa

SEQ ID NO: 21279 - DNA, 1041 bp, Homo sapiens
cacacagtgtctcgctgtgttacccaggctggtctcgaactcctgagttcaagtgatcctcccgtcttggcctccccaaagattacgggcatgagctgctgtgtctggccagaatacaggattttaaaaatttatgttttgcaacataattaatataaagacaaatataacccaggcccagttctagttattcattcttctgaattttaaaaggaaacatttggctggcccctaatggtatcatgggccctggtacctgatgaagttggcctagtctgcccccagctcctgaacagtggaagagtttttagtctcattgagctttgtactggacattactaatttctaatccaaagcatcaagtgaagtggcttgtataaataactggttttcctctgggaggctaaggcgggtggatcacttaaaagttaggagtctgagaccagcctggccaacatggtgaaaccccatgtctgctaaaaatacaaaaattagctgggtgtgatggtgtgtgccagtagtcccagctactcttgtggctgaggtgggagaatcgcttgagacccttgagaattgggaggtagagattgcagggagccgagatggcgccactgcactccagcctgggtgacagagcaagactctgtttcataaaaaataaataaataactggttttctggacgagggcctttcccataggtgctaacttctcaaagcccggctgggtgaacactgagcctgctttgcaggtagcaggtggtcacgacagtgccattccctggcccctgcattgtggcttctggcctccctggccctgctcacgctctggctttctcttcccaggaacaccatggaggcactgcccgcctgcctgctccgagacgtggcccaggaggccctgggcgtggctgtcataggcatcgacgaggggcagtttgtaagttggcttgtcttggcatcactcttcctgccagcttccgctctgtcctcccgttttccctcgctgacttggaagttatctgatcttttagtaaaataac

SEQ ID NO: 21280 - DNA, 1068 bp, Homo sapiens
ccctgatccctgatccctgggtgaggcctccctccctgttcctccttgtcttcctgctcttctctccttgacgtcagtcacttgtctccctgtccctgtggccggcccaacccatcgccctcctgtcacctgccatggcctagggagtggtgacatgtggagggtggtggcggatgtgactgatgtctgtgatgtggaaaattccatgccagccaagtgtccggccagaggcccacaggctggacccttctgctattgtttgagatcactcccaccgccagtcacatggggaagctcaccagaagtgatgttttaaaaggcagaggccgcatggacccagtttcctaaaaaggaactcggacatacacatacaggaaatgtcctcaaccgtgtctttaaagctccttttccctgaatggaggattgtggggagttttcctagatggtttttcagtgagtgcgtattacttgtaccatgaggaagaaaggaatgtgaatgttttcagagcctcgcacagtctagggcaagcagctctctgcgggctgcagacacgcacagtgaacagttagcttcccatcacccaggcctccttcgcctcagccatggttggggggtgtaaactcacctgtgtgtctccagagcaaacgtgatccagagaagggttcagcctggtggttcataaaaggcatccagggccgggcgcagcggctcactcctgtaatcccagcactttgggaggccaaggcgggctgatcacctgagatcaggagtttgagaccagcctgaccaacatggtgaaaccctgtctctactaaaagtacaaaaattagccgggtgtggtcatgggcgcctgtaatcccagctacttgggaagctaaggcaagagaatcacttgaaccctgaggcagaggttgcagtgagctgagatcacaccactgcactccagcctcggtgacaagagtgaaactccatctcaaaaaaaaaaaaaccatccaggcccacccatggtcctgaggctagtggggcaggatgtgccaggaacatggagtcacacgtgagtgaccccc

SEQ ID NO: 21281 - DNA, 1025 bp, Homo sapiens
aatctgaaaattcatgcaatgaaaacagacaggaaccagctggagagaggatggatttggcgccaggtcacgctgcgctgagactcctcgctctgtctctctgagcgcagtgcctggtaggtgggtaacctacctcttctgtgtgatagaggtcatttctgcctcatggggctcttttgaggattaaatgagattgtgtagtgggcatggggtttggcagcttccctggcatgacagccatcatgggaagtgtggccctgagcgggggccagcccaccctccattgagcagacgcggtgccacggtgttttcagagtcccctaccagtaatggcaccagccctgtgttctggggaagaaaacagcagtgttgtgggggaccggtatccttttttttaacatactgaaaaaaaaatttattgaatcattatgaaatgtattttttatataagatttgaagtaagggtttaagtttgttctcatgaatgaatagctgatggtccggacaccatttatggattcattggcatcgcccccactgacttcatatgctctccttagagtgtacccagctcccccaccacgcttcatgcacctgttgctccaccgcgcctcccagcgtgagcgccgcccgcccctccccctgtggcatcgtggtgtcctttgactgtgctggctggcgagttccctgtcctccctcactggtctttcaaaacagttttggctggttttgtacatgtgtctttcatatggtttttacttctatagtcagaaaaactaagcatttttcaaagtcacatttagaatcattcaatcctttcatgagcgtgagtgccaagttctcctgtgggcttgctggactcctctgctctgtcccggagcgggctggcctcagcctcgggatctgcagacaccccctttggcactctgcaggcacactgtcctcaaaccttcttgcacccagtgcgaggtgggaccattaggattatccccatttcacagatgagggacactgaggcacagcaa

SEQ ID NO: 21282 - DNA, 1033 bp, Homo sapiens
ctttccacgtggaaatgttccccgtgggcccacagtgatgctttatggtagaggtctctgtaatgcaacaaattgtccaggcataataaccaagcttttgtaatcaggcagagaatttcttctggctttgctttttctccttgatttctttccatcttgtttcttttagcatctgactcgctttttccatgatctcctatgtccgaagggttccccgggtagtgtcctgtgatggagcgcatgggaggtcagcatgggttgatgttccctttgtgccgagcctccgtgggcaaccaatggcccgccaggctggaagaccaaagttctcagactctgaattggtggagggggttcctttttaagaacaaattggcttcaatcctgaatatagtccttgccttctttatcctccttatttaattctgcccgggctttcctgttttccacatgcatgtcatagtatccatttatggttttctcttaattcatgccatctaacctttagggaccagtggcaagggctcacatgaaacttagaagttactggagggagagtctcaatttgcttgatatagcacaggatgggcaggtggagggcacgtgcttgcttacagcaaattccctcgcataacctagatctgtgtcatttggaatcttggcaattaatgatcagtcacgtaagcccgcctagggttcagcatccaagcagggtgctaaaaactggcctgaaagtccagtggtccttttacttgtctgccaggacctacgctggacattttcttttcataacattatttgcatactccccttaggtttctctggtgtgagcatgcaggcaggtcctggcagttagaataatccctgtaaaaccattctcctctttgctcagctatttgtgatgagggcaagagagaaagcatgatcggaggtatgagatttatgccccatgatccttgctatttaggaagattggagaagcggtattgtctgtaggttaagtcttagcaaaagagcaggcacaagaagtgtttct

SEQ ID NO: 21283 - DNA, 1014 bp, Homo sapiens
tgttggtgcctgactcctgctttctctcccattttttgtcttttctcgatagagatgagtttaatatccaggttcttcatgcatttgtggagctgcatgagttcactgatcttaatctcgtccaggcactacggtgagtattcttgaggtgagcccctttggaaggagtgggaggctagcctttgatcatgagtctgtcctggggggcattttattgaaattatatctttgggtatgatttgaatattttgaagtattttggagggaagaaatctattggtctctgactgggaatgactggatggtcaaggggaattcaattctgttacgttctggaggccgattctgtaacactcttccttgagtcttatatttgaggttttagaaattgatgaatacttaaattttgaaatttttcagtttagaaaatcctttaatttcttgccctggaataagtagttatacatttcattttggaaagaaaaaagtaaaccttaattttttattaaatctgttacctcatgccttttaagaaactgtcattctgtattttcactgctgtaggtgtaaataatgacttcatcttttgtgctatcatttagctggatggaaacaatccacaattaaacctgtcagctgtgggtctttctttctttgacttaaagggatcgattgttaatgctttgacaagacaatcttctctttttctgccacccatattgtttccggaaatagcgtttgtttaaaatgagcattatctatgtttcagtcttgtatattattctgaggagggaaaccactcctcagtagggattgtttccctcctaatttttcactttttcctaagaaaaattttacttttgattaaggtaacagtggtgtggatggcaactttgcatctgttcagagttacagtaacagaaggctgcagcccagcagggttccctttgcactttgatgttaaaaaatcattggcagtggtcaggcaccgtggctcacacctgtactcccagc

SEQ ID NO: 21284 - DNA, 1022 bp, Homo sapiens
taggcagaggggtctggtgccagctggatgacctcaaagagacatcctggtcctaaagcatgccttggacacgttcatttgacggtacccacggggatttaggacagtgtggtcctggcagctgctatgtgtctgccaagcagaacctgctgtcagagagctgcgttttccgtggaactttatggcatatccccgggcatctgcctgtggccggtggagcgcgggttgcaggattttagactagagcccgccgtgtgctcatgtatcgtcctctggcttggaaagagggctctgtccctttaagacagtcctcctttgtatgccactggctggaacccatttcagctctgggtttctgccgactgttaaaatctgcaaagcaacatttaaataaataaataaatgaaagcttcccttgtgtggctttcctattcacagccaagcacaatagcgccttgttgtttttgtcactttaatcctcttcattaaattggaaccctggaaaggaatggtgatggggctgatgctggaccgtccccctgactgccagccggacaccttgcagattaacctttgtgggcatggattccgggtgcccctctggcaatgggcgaggagggcgagcgaccgggtggtgtgtcagggcggctccccctctggtttgtctccattgtgctcaggctgccggcagggacaacctgctgccctccccagtggccattcttttaaagagcaaggggttcagccgcctccctggcacaccgcctccctggcacataagcatggctgcagcacgtggcagtgggggagggaggagctgtttgttgtgctgccatctggcccatctgagccgttcttttgcagtttaaccctaatggctacacaggagagaagcggcatgaatagacgggtttcccagggtgcggacggtgctttcccagaaactcccgggctgtgaggtagacatgggtatttctgaccaccacctttcttgttccagctgtggccttcgcagtgtcctg

SEQ ID NO: 21285 - DNA, 1050 bp, Homo sapiens
acagataggcagaagaggaagagtccaggcctcccccactctctttccacagtccttgctttgaaaggtgattcctgctagcagtttcaagtgtgtccttctcagaagctccctgtgtgtttagcaagcgtaggtgttacttgtgagaaggtattctgtgccatcctgtttcaccagatgtgtcttagagatcttttcatgttagcatttacaaatcacctcattcttttaaattaccaagtagtttttaggtagtttaaaatttttggaatttggggagcatatccactcttaagtggaatttaagaatcaaattcataagtttgattcaaatcaaatcaaaaggtgtgtgctctttatgttttgctagtgccaaaaggttgtaccagtttacactctcccagcagcacgggagactgcctgtgtagcccactcccctgacagtatttcgtctcatctggcattctgattcctgccagactaatggaaaatggtatgttattcatgttttaatttgcattaaacacatagtgactgtgagcatcttcttctgtgtgaccatttgtatttctctttttgtaatctgtcttttatatcctttgctcattgtattcatctttgctttactaatttttatgctgctttctttgtgacttaaataaattaaccctagccaggtgtggcacatacttatagtcccagctattctggaggctgaggtgggagtatcgcttgaggccaggagtttgaggctgcagtgagctatgatcacaccactgcactccagcctgggtacagagtgagaccctctctctaaaaataataagttaattaatttaaaaaaagatattaaccctttgtcatatgttttgtgaatttattgtcctagttgtttaccttttagcttatgggatattatttttcactcagaagcttttcattttcatgtcgcaaatgagcagactcaccaatattatgactatactaattcatgctctattctagaattattcaggttttattttacattaacatctttgattaagctag

SEQ ID NO: 21286 - DNA, 1030 bp, Homo sapiens
gatgaggtgggaagctatgtctggatccagcagttctacttgtgagaatttttttctatggagataattaaagagatgtgccgaaacgtgtgcacacgtgtattgagatacgtagaagaattggaaatcacttagaagtcttacaatatgggactggttaaatattatgtctagactgagaagaataataaatgtgatagatgtccatttacagtcatgaaaaaatgttataagtaaaaataagtagctataaaacgacatataaaatatcgtgtgtgtgtgtgtgtgtgtgtgtgtatctatagaagagagagagaatatatataatacttataacaaaagtctggaaaatgtctaccaaaatgtcaccaatggctatctcttggtgataggattaaggtgttttttttccttgttactattttctaatcttcaacaatgaatatgtgtcatgaacatgataggactgtgcaggcaagaatctttgggtgcagcatattagaaatcataatggagatgaaactgaacttagattgggagtttggcccttggattttttttttttttttgcctctaatatctgctttctgcttttagcctgtgacctcataacatgctgtaatgattacgatctcttagtcatgctcttgggaaatgggctattatctcattgtgaggggaccagggattttaatgattccattttaagaaaatgtagtcggctttccatgggctccccatccatggatttaacctattgtggatggaaaatatttggaaaataaaaaaaggtcacacctgtactgaatacatacagacttttttcttttcattttctttaaacaatatagcataacagctgtttacatagcagttacattgtatttggtattagaagtaatctagagatgatttaaagtatatgagtggatttgtgtagcttatgtgcaaataattaaggactcaagcatccgtgggttttggtgtccatcggagttcctggcaccagtcccccttggataccaaggga

SEQ ID NO: 21287 - DNA, 1026 bp, Homo sapiens
tgaagatacagagagcgagtgaaaatctatatttattttaaaaaataccaaccaagaagcagcaccgaaaaagcccgtatatttaactgtgagattcccatcctttcttcctcagtgtagcccccacaaatactggtggtcagttttacactccacacagcccaggtaggggattggagaatacttctttgggtaactagtctaagcaaaaataagctaccgagccccacatgtggggtctctacacattactgccttatcatattacattgccacacatcaatctataggccatgcctaccacacggcttttaaccaggttattagtgtgtcactcttaaatgagaagaagtagactatgcttgctagagacttaaggaaaatcttcagtgttagcaagcaaaagagcaaatagtttaaggaaacaggtcatgggacatgtagaagaaagccttaaaaagtatatacttaagagtctcagatattaaatgaatgaaacaagaataggctgctatcaaaaaggactatgggttgagtatttcttatctgaaatgcttggaaccagacaagttctagatttcagtatttttttggattttggagtacctgcattgtacttgccagagcatccctaacctgaaaactggaaatccaaaatgctccagtgagcatttcctttgagtgtcatgttggcactcacaacgtttaggatttgggcatgtttcagggatttgagatttgggatttgtgttaggtagacagcttcagaggccatgacacgggagcgaagctggaaagtaagactgctggctggagaccagtgtggagtctggtgtactgtggacgagaacagagaaggaggggctggtgagtggacggagatgatgggagaattctctaccatcccaccgcccagagataatgattgttaatgtgtttagtatatattcttcctggcttatttcttttttcatttttatagtctatgcatttttgttacatgattttttcatttaacagtataac

SEQ ID NO: 21288 - DNA, 1057 bp, Homo sapiens
tacttgttaatttatccttcctgacattgaattactatttttttaaacttttttttgaatttttttttttgaggcagagtcttgctctgtcacccatgctggagtgcagtggtgcgatcttggctcactgcaacctccacctccctggttcaagcaattcccctgcctcagcctcccaagtagccatgcctggctaattttttttgtatttttagtagagaaggggtttcaccatgttggccggactggtcttaaactcctgacctcaggcagtctgcccgcctcagcctcccaaagtgctgagattcaggcatgagctactgcacccggctgaatatttttttaatcttttgggttgctgatataattaaaattttttcctgcctctctcagcattggcagaatgaactttgttctaagaacctcggctagtgtttacatgtattagaatgggaaaattatagcagcttctttcccaggtcgttttttattcatctattcaacagatacttattgaacacctataatgagctggacactctatgggccttgcaatttagacatgaatagagttctcaggtaccttacattctaattagaaggagaactttgacctctaaccaagacctgtttaattcataggagggtttcttttcttttttttaaactgcactcacggtcatccccccaaaggatgagggtttcttaagttatgttgaaaattcaaaccttgagtccgggcatggtggctcacgcctgtaatcccagcactttgggaggccaaggcaggtggatcacgaggtcaggagatcaaaaccatcctggctaacacagtgaaaccttgtctctactaaaagtatgaaaaaattagctgggtatggtggcgggcgtctgtagtcccatctactcaggaggctgaggcaggagaatggcgtgaacccaggaagcctgggcgacagagcgagactccatctcaaaaaaaaaaaaaaaaaagaaaaaaaagaaaaaaattcaaaccttgaaattccgccttgtgaataatcttagtctaattttt

SEQ ID NO: 21289 - DNA, 1094 bp, Homo sapiens
atatatatatatatatatatatataaacctgctatttggatagaggccagaattaaaacatcagtagtcaaaagagggaattcagtgtttcttgagtttttagctttatatgtctaaatttgtaaaattcaaccatgtattttccgttccacatgggcaccttttgcaattgtggtagcagatgtcctaggcagatgaacatgcagaagtggtttgtttagccttcccttttaaagttcgtaatctagtaaatttgggttagaatggtggttcccatacttgactaacccgcagaatccctggaggaatctttcaaaaaagccatttattctggttccttactctagccataccaaacgtaccagggcagatccaggaatgagtgaatgaataaatacgtacatacatgcacatgcttgtacacacatgcacacaaatatacttctaatgcccctaaatttggggaccccaggtgtggaaactcacgcttcagaacctctaactgttctctccaaggtcacatcacacaggcaggctctggcttgagttggcctggccagagatgcttcccttcatttcccgtgttgagtgtataaaatgatttcacaagaatttgtgcgtccatgattgtaggaagggatggctgagtgttgaatgcatttcctcagctgtaactatctaatttatgtggttttgctttaagccattcagtattccgcttggagggttttgaacttacagaggtttttaagaagaggctcaacagatgaaagaagcaagaataaccaaccttggatttttgtttttactcctttattatagctaccaagtatatagctacctacccactttagcttccccatgtgtctttgtgtggttttctgttttgttccttttaagagataccgtctctttatgttgcagctgttgctaggcagccagtggccaggtgccagttttagagccctgatctgtacaacagtgaggaagcaacctaaaaagacccctttgcctaccccgttggatgaaagagaggcttggcgctgggatgtagactgctaggcgcatgagacctacgaagaactgaggctgcg

SEQ ID NO: 21290 - DNA, 1077 bp, Homo sapiens
ccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgag

SEQ ID NO: 21291 - DNA, 1038 bp, Homo sapiens
ctgtgtgaacatcatagagtgcatttacacagacgtagatgacggagccagctgtatggtatagcccattgctcctaggccacaaacctacacagcctgttcctgtcctgaatactgtaggcagttgcaacacaatgggaagtatttgtgtatctaaacatagagaaggtacagtgaaaatgcagtattataatcttatgggatcgctgttgtatatgtggtctgtcattgaccaaaacatgttatgtggcacatgactgatggtatgtgacgtttaagaacaggcaaaattaatggtgacagaaatcagaacagtgaatatttgagatgggggcaatgactgggatgtgggaattttctagttgatgttctgcatgtccatcagtatatacttgtcaaaactctttgatctatatactgaagatctatgcatttcaacaaatcccacaactcagtttaaaaaaatgatttaggctgggcacaatggctcacaactctaatgtcagcacttagggaggctgaggtgggaggattgcttgagactgggagtttaagaccagcttgggcaacatagtgagaccctgtctctacaaaaaaattttggtttttttgtttttttttttgagacggagtcttactctgtcacccaggctagagtgcagtggcaccatctcagctcactgcaatatctgcctcccaagttcaagcgattctcctgcctcagcctcccaagtagctgggaccacaaatgtgtgccaccatgcttggctaaattttgtatttttagtagagacggggttccaccatgttggccaggctggtcttgaactcctgacctcaagtgatccacccacctcggcctcccaaagtgttgggattataggtgtgagccatcatgcccggcctaaaaaatttttattaattggccagtcatggtggcgcgtgcctatagtcccagctacttgggaggtagagataggaggattgcttgagtccaggagtttgaagttacagtgagctatgaatgtaccactgcac

SEQ ID NO: 21292 - DNA, 1023 bp, Homo sapiens
cccgtgcagtgcactttcatggttggcttttcctctggcagcagaagggtcgatagtctaggatagttttgagtttttttcaggaccctgatgtttccccttttgcctctcttgcccttcactgcccttctaaggctgcctgcctgcctctttgccttctccccctgagagcccatgcctgtggagactgctactccagctgcgtgcctgtgagaccccatattcagcacttcacttcagggtgccctttgcagctgtgattccgggtggctctcgggccacctcctgccccctcctccattcttgcccagctgttctctactgccctttgtccccaggctcagtgggatgcctgtgggagctcgctgtcactcagcttgcctttcctcctcctggggaaggtgacagttgtgcttcctctgctttgggttatgcaagaggggattccttgtggccctgcgggcgctggtgcttgcgggcttctggatgacagaggggttgtgggggtggtctggattttggtagccgccatcacacgcagctacccacagttctcagtccatgcagagattacgtccttgctagtatttgcagttaaaaggtcacttttgaagaatggtgggacagtagatggtggcagttgatttttcattttctaactttgcagaataaaaattgaatgatcctgtattggtcccccaagtatttcagagctcccggagtctgggaagtgccatggtaaatagtcacacaggccagatgagagactgaggtgtgcatgttctgtgggaggggaagtgtagcctgcgggtgtggaatggtctgggtggccgtgggaaacgtggagagagccctggaaacagccccgctttgtgccagtgaggagtcggggaagcagctggggagacggggctggagagcctggggagaggggaagctcttctggagggagtgggtgcaccggcgcactgcgcagcctcctagtaaagggcctgcagacccagctggcctcatgcctggagg

SEQ ID NO: 21293 - DNA, 1049 bp, Homo sapiens
ggctagcatccataatgaccaaagaggagatcttaagagatgtttttgtcccgggatttcgttatctatggctctatgtttcttcttgtccccacagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggtacagatgtgcagtgtgctggcagagaggccctcactccggggtgacgaagtggatggacttaaatattgactaattagtaggaaaaacaagagaatgtggtcaaagagttatgaatttttacatggggtcagtggatttcagttatagaagtaatgatacagggttggtagcaaggaaatctgtgtgcttggtggatctgtgtacttggtgggtccttggacttgctgtccccctatcccaagtataatacagtcgaaagtcaggcttggaactaagaaagagaaatggggtgggctgcatgtgggcacagtgtggtgcagagtgccaggcctggctccttccgccactcagtctctgagctgtgtcctccatctatagaggggcccttgaattctttagccaagcagcctaggaggtccgtgggatggctgggtttactcctgagctttccaggaatgtcctgtaaaccagaacaccagttcttctctggtgccatgttccgagtcactgcatgctaagtgtatgcttcaggagtttctttttgtggacgacctgtgtgtggacttacgtcttcctcttttcttcccttgtccctttcttcctcaggcagtgagcacacgtatgagagctgtggtgacggagtcccagccccgcagaaagtgcttttccccacggagcgactgtctc

SEQ ID NO: 21294 - DNA, 1063 bp, Homo sapiens
ctgtccgggctttcaacagattgagtgatggtgccccacctggcgaggagggatcttcttactcagtcccccggttcagatgccagtctcttcccagagccacccagaaatcacgttttcccagctatctgagcatcccttagcccgtcaagctgacataaaatgaatcatcaagggctgcgaagatggactccaaaagtgggcgggggtaggggggtggtggtggactgtgatcgagaacattcctgcagggagaatgcctcccttccctgagtcagggaccagataacctttccagggtccttccagcccaggacaaagggctttgtctcaggttcagctctcctgagaattcatcctccccgagatttggacacctcagccgaattcctgctgtttaccttcttctctcaagaaacaacaacctgaggattgttgctttcacttcttcggacccaaatcatgatttcccagccacatttctcagttgtcaaatttgtggaggatgctggaagcttctagtgagttgcttacagatgatccaactggcggcttactaaaacatatcttgggctgggggcggtggctcgtgcctataatcctagcactttgggaggtcgaggcaggggaatcgcttgaggtcaggagttcaagacccgcctagccaacatggtaaaaccccgtctctgctaaaacacacacacacacacataaattagctgggcatggtggcatgcacctgtagtcccagctactcagaaagctgaggcactagaatccctgaacccgggaggcagaggttgcagtgagccgagattgcgccaccgtactccagcctgggcaacagagcaagactgtctaaaaaacaaacaaaaaacatatcttgacaatgccagtcatcactttaccacagaccttaagatgccaaccacccagactaggtcaggggcccccatttccagcagctactcctgcttcctggaaaccccctgcaccggccagactcccccagtgtcccatgttcatccccagcctcgccctgccagcttccctcgcccatcct

SEQ ID NO: 21295 - DNA, 1060 bp, Homo sapiens
atttgaaacaagcctggccaacatggcgaaaccccatctctactaaaaatatttttaaaattagctgggcatggtggcgggtacctgtaatcccagctactcgggaggctgaggcaggagaatcacttgaacccaggcggaggttgcagtgagctgagatcacgccactgcactccagcgtgggtgacagagtgagactctgtctcaaaaaacaaaaaacaaaaaacaaaaacaacaaaagcactggaggggctcaatagttagttagtttgtcctagacccttctagaatgttgagatcctggacagtgcttctgagaaacctgcagtctctgtccaaggagcccttaaggaagaaaggcaggagtgtggggcaggaagaccagcttcccctttccattccacacggctggctcgcaatattctgtttctcctgcgacagcctggttcctccctgctccccagctcgcctctgccaccattcttccctcagtccagatcaagagttcaagggacggggacagatgatcagaaaggcccagctcaggcaaggaaggggagaaaagggaactcgtatatgcggtgggtgggaatggaaagtagtacagtcactatggtggaggttcctcaaaaaactacaaatagaacggccatatgatccagcagtcccacgactgggcatttatccaaaggaaagggaatcagtgcatcagagagacacctgcacccccatggtcctggcagcactgttcacaatagccaagatatggaatcaacctcagtgtccaacaacagatgaatggctaaagaatgaaatagtatttcattgtggatgttggtacatctacacaatgaaatactactcagccataaaacagaatgaaatcttgtcatttgcagcaacatgaatggaactggaagacgttaagtgaaataagccaggaacagaaagttaaacatggcatgttctcactcatatgggaaagctaaaaaaaagaaaagttgatctcatcgaagtcaaaagtagaacagagaatactagagtctgggaagggttgggg

SEQ ID NO: 21296 - DNA, 1255 bp, Homo sapiens
ctgccaaaaacaacaacagatacgaaaaagaaggagtgtttttatttggtttggatgtgtttggtattccaatgctgcaggagcctaacccagaggaagtggagactcctttactgcacatctgtctgctccaggccaggcactgttctaggagccaggatacagaggtggagacagaaacaaacaaaccgataactgtatacaatactctaacgtcaggtggggacaagggccaaggacccagggacggagggtgatgtctgcagcagggcagtcagggagggcttcctggatgaggtggcatttgagtaaaatacagacctgtaccctgtctatgatcctatcccacttcaccccgtcagccttcccctcccacctgactctcctgcgcttctctctttagagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctga

SEQ ID NO: 21297 - DNA, 1031 bp, Homo sapiens
agggtgctcagtaggaccgtagagcctgatagagaccccagagggagagaaggaggggcccccagagcctgatagagaccccagagggaggggaagaaggggccccccagagcctgatggagaccctggggagagaacaagggaagaggggcctagcactccccgagcctggcactgtgcctggcactgtacctgggcttgttcttggccatgtgcctggcactgtctggaagtctctgacttgagcctccagcagccccaggatatgatcgatcttcccatttcacagaagagaagaactgcggcccagagtagctgagaaggttgcccttgtgagcgcgtctgtcgtgggggtgacgtgcccgccttgccgggggtcttgagagagctgggctctctggatttcctcatggtcctttgtttgaggctgtctctgggcccccggaggcatggccactggtctgttcaccttcttatttttaacagctttattgaggtgtaatttgcatactgtaaaattcactctttggcaggtgtgcaattcggtgacttttaaggaattcacagttgtgcaaccatcccagaaacccgtttttgaattttcatcacccaaaaagtttattggcaacttccctttgtttcgattctcccactgagcccagcctggcatccgcactctgacctggctggggccagccctggcaggaggggtggatgggctctgagtggcctgggggcttccctcggccaggtggatggtgagggtcaagggcctacattccgacctgtgcatgttcataggggctgggctcctcctccggatctcggtgctggggtgttgggccttcaccttccctgaggctctgccctccctcgggacccttccgaagccccctcattcccttcccccatctcagctccccgtgggtggctcttggactccccttcatctgtggctgagagctgagcctacttaagtcttttgatcttggttcagacatcatcccctccggccattcccattgctgcat

SEQ ID NO: 21298 - DNA, 1024 bp, Homo sapiens
aaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccagg

SEQ ID NO: 21299 - DNA, 1020 bp, Homo sapiens
aaaaatactgggagtgtgggccgggtgcggtgcctcacacctgtaatgccagcactttgggaggccgaagtgggtggatcacctgaggccaggagtttgagaccagcctggccaacatggtgaaaccccatctctactaaaaatacacaaattagccgggcttggtggtgcacgcctgtaatcccagctactcaggaggctgaggcaggagaatgccttgaacccgagaggtggaggttgcagtgagccgagatagcgccactgcactccagcctgggcaatggagacagactccatctcaaaaaaaaataaaaaataaaaatacagggagtgtatattaatgtaaaattatttacaatatgagatcacttccattcccacactgggaggaacgtaaaactcaacaatgcaagagcaaactgcatctctgtttccagagggtggcgctgtttttgcaccgggctgactctccgtttccagggtggcgctgtttttgcactgggactcgtacaaggactggtgctttctctgatgtgcttagcttatttcaggcatgcatttcccctgggctctctgctagctcttcacctttctgcaggcttcactgaggacccccaggtccacctctctagagtggccgtgcccagcccctccacctcccaccctgtgctcattcccttagagcaccccatgacccgtttaccgtttgctgcctgacttcccaccacaatgaagctctacacaggtggcaaccttgtctcgttgtctgcaggttgagagggtgggggacacccagaactttttattgcagaacaaatattttctgaggccatgctttgtacaagaccctttggtgggagatgtacaagataaatcagacgggagagagcgggtgcatagtgaccttttattcacatagcataaaagtcacccttttaaagtgtacaatgcagtggcagttagtacattcatgaagctgtgtaatcacaacctgattccagaacattttcatccccccaa

SEQ ID NO: 21300 - DNA, 1010 bp, Homo sapiens
gaaagcgcttcccggcaggcggagcacacaagccagccggtggccacggccgggacaggcttgtacgcaggacattgaggtccggcgaggatgggggggccaccaggcccccggccctttgcagagtgttgctcgttttctcccaccccagaattgggcttggccaacacggcccccccaaccatccccccacccccgccagctgcccggagcctctgtgaagatggcggcaccgccccttgcaaactccatctgcgtggaggtggcactcctgctccgggagggatcccggtgcccagcagatggcaggcttcccctagatcagcccagggctggccgctgcctgcggtgcacgcccccgccctccccctccccgccccgccccgccccacccccacctgcctgtggctggagggcagcactgcctgcgcgcctccccacctgacctccctcttgcctccctgcctccttccaagcagattttggtgaatcctaaatcacgtggatattaactcgcaagtgcctgcaagcagttctgagggccgggctggggtgcacactcacttgggccaggtccccctggtcagggtcagccagacgccactcctgcatcctgtccactcttagcagccttctgccttccctgctgactttccgcctcttctctgggtgtctggtgggtggagaggtggagagcctccagcacaacctcaccccaccccacctcgcgtcagcctcagcctcccctgagactacacggaacccagacacgtttgacctctggccccaaagcagagatgcctggctgatgggatgggtgggaggcctgacacagccagatgcagcctgctttgtgtcattcctgctctcccggcgtggacgcagggaccgcccccgggacagcccagctgggtctccagggtggctttgtctggaatttactttgtgaacctcttgcttgtcaaaattatttcatagatgattcatggttatatagaagtgtcagaaat

SEQ ID NO: 21301 - DNA, 1051 bp, Homo sapiens
tgcctggctgtgtgctggtgggttattaccctcattgcctcagtttcccctctgcacaatggggctggcgctagtgctccccaccccatagactgtcatgagaagtagcatctggacaggccctgagagcagtgcccatctctgtgccatccgctgggactggtgttggcctggtactgtaccgtctcacccttgtgtccccaggaggggagtggggtcgagaccagccccaggggttacatggacaatggggttacatggacaaatgcctcttgttacattttgttcactggttcccaaaatgaggtgcaggctctgcagagaaagcaggctttccccgaggggctctggagcagaaagagctgtctcaaggtaggtgctggggctggggtgatgtgagagcagagttggaagtgggaatgttctggaaggagggagagggctagtggcagatatgtggtcaccggaggaggagccctgcgatatatatcaggcagggacagggagaggagaggcgacctgggaccccgaaaaccgggtgggtggtcgctgtggcctctcctgggagcctcggactggcggttagggcagactccagtagattgtaaaggcatcaggatctgtcttgcttctgtaaatatttaaacactgggaggattatttttggtagctacggtctctctccgagcctggcgggctgccgggacgggtgtcaagtgacatcgggtgcaaggataccccaccccctggccccaccggccccaggctccgtgtgttcacctttccaacggccacagtttgatgtgggtcacggtttccccttctaggagacgcagagagatggtctcgggcgcgaccagcagggattcctcgtccacacagtttcctgacagcggttgaaagggacgggtctacgcaggccaagaacagcagcggagtgtggggtcaggggcccagcggggggcaccccggggaggggccgcctccgccagacccaccccgggtgaaaggacgcattgtgtgcccgcagcatgaggggagcctgcagaga

SEQ ID NO: 21302 - DNA, 1029 bp, Homo sapiens
actgcaccccagcccgggtgatagagcaacattctatgtctcaaaaaaaaaaaaaaaaaggaaaaaaaaagtttttatctgtggaattatttaatcctctagcaattttggtgattgcgttagtagttcctaattatcatgcatgaattcacttaacccacaaaacaagctcatgaagtcaggactgcagttatgcccatttacagatgggaacactgacgcttagagaagtaacttcccaagctcatgcagttaggagtgacagaattaggccttaggcccaggacgtcccagctccagaaaaccgttgtacaactttgccctctgtcttacagagggtgcccaccattcatatacaaacattcttccaagtggttcataacagtgcaaggaggtgggactaatcccatgtcaccactagctgctaatctcagttcacttcagtatggaaagcatcccccaggcttcaggataaagccattgagtttgcagaacctacctacaattgcactggtctctgtccacagttttgggtaataaggtgcagtggttaagaacatggcgtagaaagatggactgctggcttcaaatacaaatcctggactgggcatagtagctcacacctataatcctgtattttgggagaatcacttgagcccagaagttcaagaccaccttaggcaacctagagagaccctatcgctacaaaaaatgaacaaattagctggacatgctggtgggcacctatggtcccagctatttgggtggctgaggtgggaggatagcttgagcccgggaggtcagggctgcagtgagccatgaccagcctctgcattctagcctgggtgacagagtgagactctgcttaaaaaaaaaacctaaaaaacccaaacaacaacaacaacaaaacaacaacaaaaaccccaactcctctggcacttagttaattctccagtgccttaatttccccatctatactacctacttcagagactttgtgcaaggattatgaaaagcattgaattcctg

SEQ ID NO: 21303 - DNA, 1031 bp, Homo sapiens
cccttctcctcagccatcctccagggcacagggtcctagccctccctctgtcctgtactcctctcctgaaattttttttttttcctgagacagagttttgctcttattgcccaggctggagtgcaatggcaccatctcggctcactgccacctctgcctcccgggttcaggcgattctcctgcctcagcctcccgagtatctgggattacaggtgtgcgccaccacacccagccccatgattcttgaagaccagatcctggcctaaatgagtggcatccccctgccccagctgaccaactagcagcagctcccaaagcccctcacccacttggagccagtggcccctgtgccagctcaccaggcctcaccctccatcctgctggggtccaactggcccctgtcaaaggacaaacgcagagggctggccttggctttgtccatactgacgatgcggaccagcttctgtggtcccccagaagatggctaaaggagggacagagaaaggatgaggaggagctgttgaagccatcaacaggaatgggaattcaggggagatgattggcactagggcgacctgggagtgatgcagaggcgcagatgctctgagaacagcctgaggtgtgtctgcacttgtgcaagagcctgcaggctgggcaggggctgcagaccctgccctggtttgaaggggtgcagaggagagacaggtggggttaccctccaatcagcagcccactctccacacagtgcctcctgccaccctgccagcaccgagcccctcttccagcccaccccagtggggtccaggcccctccctggagcctcaccttgcgggtcacggtgcactgctgagtcatgtcctggatgagggctatgagctgctgctgagccctgcagagaccagcagaggccctgacccagctgcctcctgccaggtgagcagggcaggggagagccgagcaggggagagtgggggagatggccgggtgggagagaagggcctccacctagagctccacacatccctttgctg

SEQ ID NO: 21304 - DNA, 1881 bp, Homo sapiens
cagcgaggcctacgtgagcctcctaggtatgcctttgtctgtctccgtcaggaaaggtgtgggagtggatctgggacggggccatgacctgtcagatgctgctccacacccattacctaatgtggctctcatatcatctgggtgaggaagggactgtcactcccactctacagaggaaaagaatgaggctcagagaggtgaagtaagctgctcaggattgcacagctggtaagcactaagctaggattctcgcctggatcctgctgctttcaaaaccattgccttttccccgcctacctccgatgagcttcagaatcacctgggatgcttgttaatatccaaattgcaaatcccagggtgtccgattcagtagatcttggcgggctcaagaatttgcatgtctgacaagttcccaggtgatgccgatactgtgggcctggggacccctctctgagcatccgtgcaccccatcctgccttcctgggggacccaaagcacctcatgaccctgctcattcctaaaaagacctaggacatctagtcccatgttatggatgtgcagacaaagacacgggtgcaggaagactttgtgaggggctcggggtgaccccttcggcacagggcagaggctcgtgtgtcctgcccactgcctggcagagcctccaggtggggtgggcccgggacagcaggaaactcaggttccctttccctccgagctcgcggcccacatctctcttggggcccacatctctctctggccccaaatgatgagccaggagcactgtggccacacccaccacaggggctggagtacacgagctaccaaaaaggagacttcttttccagtccatgggattttagaaggatcctaaatgtcaccgaatcagggcctcttgttataccattcaaggcactgaggcccagagagatgacgtggcggtgagaggtgtcggctcgacaaggcacctcccgctgctgattggattggagaagggagccgcccagagtggcgtaggttcggcccttccgagggcagctcctgtgtgctgagggctctgctgctctgagatgccgcgtcccttccagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggca

SEQ ID NO: 21305 - DNA, 1025 bp, Homo sapiens
tttagctccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgtt

SEQ ID NO: 21306 - DNA, 1918 bp, Homo sapiens
ctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaagggtgaaggcaggccgtcctgggatggtaccctgtgctctcccgtggaggagaggggatggctgaggacactggcccttaccccagggccagacagcatccatccctgctgtttgcatctgagagcagcatggggcctgggaggtcggcctgtgtgcccagctcagctagctctgccccaggacggccctgccctcgaccttcccacctcctcagatcctgcaaggctggggtctgcccctcccttctcacctctggagctgtgctgcactgcttcagcccagagggccctgagagaggagcgtgccacccacagcccgggaagccgggccccagcacccctctcctttggcctccggcagtgcagaccagaggggaccttttaaggaaagaagccgtgtttcgatgaagacctggccacatggggccactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcacgccctgagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgct

SEQ ID NO: 21307 - DNA, 1044 bp, Homo sapiens
tttttctttttctttttcttttttttttttttttgatggagtctcactctatcgatagcccaggcaggagtacagtggcacaatcttgactcactgcattttccaccttgggagttcaagcgattttcccgcctcagcctcctgagtagctgggattacaggcacctgccaccacacctggctaatttgtgtgtttttagtagaggcggagtttcaccatgttggccaggatggtctcgaactcctgacctcaagtgatccactcacctcggcctcccaaagtgttgggattacaggcgtgagccaccgcgcccggcctgaagtcaggcttttcatggagtgtggaatcctctgcgtggccaggcccagattttggtgggtttgtgccccagcactgtgaggttctaattattgtagcttttgacgctggaagggcagatttcctgtctgtgctttctttttccacgctgttagcttctttcacccgggagcttcatctaaggcagtgtctttaatgggcaccagcacgctggacttcgtagcttgtgattcacaggagcgagctgggctctcagactctgccacactctccggtgtggatttgatgaagacagaagctttagtaacagtgaaggcgaactcctcccacgctggaaatgtgaatggccgggggtgcggcactgagagtgggtgggcggctctcaagggagccctgtgggctcctgcgggccccctgcccggcccccttgcccctccattgtcccagctgcagcggccccgcctgggggtgcctccaggggccactgtgtcctctcggccacccacaggcctgctcttccctgatgatgtggccaccctctccccagggtcctggctaccttgccccaggtgtgaacacccgaccagcacagagcgatggggagggcagtgtggggctgggacaaggggccttgacctttacccccaggctcctatctgcagctttgctgatcctgatccatttgtttgtgtgatttggggacattttgggggcatttttgggag

SEQ ID NO: 21308 - DNA, 1050 bp, Homo sapiens
ctccacacctgggcttaagcgatcctccgacctcagcctccggagtagctgggaccacaggtgtgtgccactatgcctggctaattttatttatttattttttaaatggggtttcgccatgctggccaggctagtctcaaactcttaagttcaagcaatccgccagtcttggcatcctgggattacagatgttagccaccttaccaggcctaaaacatagtcttaaattcactttttatggcttattttgcagatataccattgtttttatttcatcattctttcactgttgaacatttaggctcttttttactttttttttttttttttgagatggagtctcgctctgtcacccaggctggagtgcagtggtgagatctcagctcactgcaacctctgccttccgggttcaagcgattctcctgcctcagcctcccgagtagctgggactacaggtacctgccaccacgcctggctaatttttgtatttttagtagagacaaggtttcaccgtgttagccaggatggtctcgatctcccgacttcgtgatctgtctgcctcggcctcccagagtgctgagattacaggcgggagccaccaggcctggcctcttttttgctcttataaataccactgcaatgaacatctttgtgcaaatagctttttccgtctgcggcgttcactttctcattccttactttatttttattctggatgcgtgtgccctctaggttattttcttagtgtaaatttccagacatggaattacttggctggagagaaggcaggtccacaggctgttctgatttaacatccaccaaacggcctgggcagccggttctgatttactggcttctacaaactcccgctgtctggaaactggacatgttataattttgcatttctttatgatcaaggctgaacattttctcacggattgggcagtttggttttttgttgttatttgttttgagacagcgtcttgctctgtcatccaggctggagtgcagtggtgcgatctgggcggctcactacaacctctacctctt

SEQ ID NO: 21309 - DNA, 1003 bp, Homo sapiens
gatcggtgtgactgatgaagcttctgatggaagctcaccctgaacgcccagctccactgaggaaccctggccaggcacagtggtcagatgggggctttgggcctagaaacagagttgctgctagtgcctcagcccctctgtcctcgcgggacctgcctggtctgtgtgcctagcgtcggcttcccggctggtgactctttccttgtgtgccgccctctctcggatgcaggccaacggagcccacagacttcctgatgctcttcgagggcagccccagtgggaaaaagaggcctgccagcctgagcacagcccccagcgagaagggagccacctggaacgtcctggtaaggtggtgcatgcggccccacgtcctggtctctgtgatgggattgtggcctggttcctaatttgttctcactgcctttgcaaaagggcactgcagggagggtgtcaagcttagatctgacatggcagaccccaggacatccacctgtctgtatgggaagttggtggctcctcccgtttgtgggagaggcagggaagggatggggtgtctgggtgtgtgcgggcggtgtcatgggctgagctgtctgacaggatgaccagccccggggcttcaccttgccatccaatgcccggagttccagtgcccttgactcaccagcgggcccgcggaggaaagaatgcaccgtggccctggcccccaacttcactgctaacaacaggtacgacctgtgcaggtgcccacgacgggcaccagtgggaagctcctggagtggagactgtgtgtgtctttgtcttgtttatggctcgttcagggtgctttggaatgaatgaatgagtgagtgagtgaaagaatggctttcattcccaagggcataggcaggaggctgccaggtggcgtcttgcacataaggggctctcggcccaggctttgctcttaaagagtttcaggccttggggaggctcacatggggctgagagggtggggcctggggagggg

SEQ ID NO: 21310 - DNA, 1052 bp, Homo sapiens
cttgatttaccatctgagcatgagtggtgcctttccaccgtggtgtccgtcagtgagtggcagccccttcatccctcccctgacatcccttatcttcctcttggaggctgcgaaactgaccccaggaaaatggagacaggatgaagggcacccataatcccatggccctgatgcaatgactggtgccattttgggggatgatttcaaaattcctaccatgtgttttgaataggccattcacacccaccatttgggaaaagggggctcattgagcagtgagcctgtcctgcccgaccttgcgggcctctcctaggcggccactgttctgtttctcctgcacccacacttactctgggcacacaggcatcagtgatgctggagatgtgttggaacaagtgccgtatccgtcagctgcgtggggctcctgcattctcttttctttttctttttaagacggggtcttgctctgttgcccaggctggagtgcagtggagaaaccacagcttactgcagcctccacctcccggacacaagtgatcctcttacctcagcatcctgagtagcatggattacaggtgctcaccaccctgcccagctaatttttaattttttttttcttttgagacagacttttgctctttttgcccaggctggagtgcatttgtgagatctcggctcactgcagcctctgcctcccgggttcaagggattctcctgcctctgcctcccaagaagctgggattacaggcatgcaccaccatgcccggctaattttgtatttttagtagcgacggggtttcgccatgttggtcaggctggtcttgaactcttgacctcaggtgatcctcctgcctcagcctcccgaagtgctgggattacaggtgtgagccaccacacccagcctactaatttttaatttttttgtagggacaggggtctcactaggttgctggtccttaactcctgggctgaagcgatcctcccacctcggcctcccaaagtgctgggattacgggtgtgggccgctgcacctgaccctgctcccgctttcc

SEQ ID NO: 21311 - DNA, 1052 bp, Homo sapiens
ggtcagtggcagggtcagcctctagggagtaggggtatccatcgctccgtggaagggaccttgggggacctgctgtggggtgccgggctgaaggaagcccagggtgaccttgggcgataggctgggtgcctgctggcctactggaggccaccgtggcagggaggtaattctcgaggttggtccctggcgccagcttctcccgttcatctacgggttcagctgagtgcctttccctgcaggtgctggggttgctcaggagccacacaattcataaaccaactgtgtgcggccacaggaagggagtccgagccggatggggagtgaagagtgatgggtgctcaaggaaggcctctgagtgcagggagggagtgtcctgagacctagaggcaggggactggccggggccaagctggctgagtttgaggagaaccagggaggctgtgttggctaaagccacaacaaaggggcacagcaggggagctggcgaggtcacagagagtacagggccagatcttgcaggagttggatgtgtagactttattctctgtgcctaggaagctgttgcagggtttttggcaggggcacatgcacgagctgagacccgttcagaaagatcagaaagactcgttcagaaagaggtgccatgtggggacgggctgggggccggcagggtttgctctgagaagttccaaagtaaggaagccagcatccccaagctaatcccctcgatcgatcgtcagaacccccgtcccctgctggaataacacattacccagggagtgtttgcccggtgcagccttgaggccttgagaccagcatcttgtctggacctcacaaaaccactcccgcgttttttttttttttttttttttgagatggagtctcgctatgttgcccaggctggagtgcagtgtcacgatcttggctcactgtaaactccgcctaccaggttcaagtaattcccctgcttcagcctcccaagtagttgggattacaggcgctcgccaccacgcccggctaattttttgaagtttttagtagaggtggggttt

SEQ ID NO: 21312 - DNA, 1022 bp, Homo sapiens
cagttgggtagcagcagccccgtctgtgagcctgctggggacaggcttctgtgccatgtcctctcccaggctaggggtccacccgccctctgagggtgtgtggctgggcccccgctcaccaaaagtcacgtgcatttggtggcagtgtccaagccttctctcaagatggtcaaccctgccccatgcggggtccacgtgtgcctcagcattgagagggtctgttccagggatctgtgtgggggtcgcagggcacagccgctccagcctcctgtgccaagcccctgggagcaggtgtgggagctccgggccagccctggcacgggcacctcccaggatgttcgtaagacacacgcttcctgcccgcgcatcttgccctgtggcctcaggacagccggtccgagggagggcaggtgcagcagccacgtcccagtcgctgcggcctggcttctccaggtgcagctcgccctccttgcacctgcagcgcggaaggcagagccaaaaggcgccccctgggctcccggagctctgagccacttcaggagttcgggcatgtggggttttgtctccggttttagtctggccatgtttgttggttccaattcctatgctctgttacctgaacctgtttgattcttttgattttcttctttctgaaaaagacttttcacggtttcctattctgcctttcttccgtatgcctctcaacgggacgagcagctgaaattaaaaagatagtagcaggtacgaacccaaaggagtgtgctgaagtcaagagcctgtctggcgggccacagacctgagcgcagcccctcggtggcacacctgccccagggacagccctgcatggggacacgtgtcaggccccagacctgcgcacgcacccaggctcagccacagcccctcaggcagggtcccgatgcccactctgctcccttgtgttacaaatgccgtggtccttctcagccctgctgtggccttgcctgtcatcagagggcagctggtctctgcaagcgtctgagtgc

SEQ ID NO: 21313 - DNA, 1501 bp, Homo sapiens
taataactgatttttgagggaaaactttcaacttatgtcctattatttgtctcatatgtcctttttctgtttttgcttttactttctttggatcaatcaaacattttaaatatttactctttttttggcttgttggtacatttctattcttctaatgattatactaggcagttgatatcaacccttatttaaaactccacaagacattgttattgttgtttcaaatagtaattattgagccaggcatggtggctcactcctgtaatcccagcactttgggaggctgaggcaggagaatcacttgaacccgggaggtggaggttgcagtgagccgagatagcaccactgcactccagcctgggcaacagagcaaaagactccgtctcaaaaaaaaaagaaaaaaaagaagaagaaaaagaaaaaagtattgatattgattctttgtggcttcttgtttttttgtcctggggtcttgttttctagtgtgcctggtattttgcagatgttgtgtttgagaaatcgtagaagttctgggtgacattgtcattcatccatcatacaggggataggcagaaggcctgtgtcccattgaggcaaatgtgttttcagttggccttgttcctagggtacagcccttctggggtctcagctgggcagtgacaccctcaaatggtgaatcttctgcttggcgttcatcttctgcttggcgttcatcatcttgctggctcctctctgcatagctgatagctggcaagtgctttgggggagatttttgcacacagaatgtggagtggcgtccttctccgaggtttccttctctccctcgagctctggctgctggagcgccctcattcttgcttctcggtgcccagccctgtgagtgtgcccaggctctaggctgttgtgctctcttgtcttgtctgcttagtcccaatgatcgatgagtctccaagggcaacaggcttgacctctctgtgactaagggcttttctctgtcctctgggatctggacctctcaagtctgagctgacagagctgtttaccagtgtctttggttgggtgtttttattgtttttattcagcttttaccattgttttaaataggaagaccagtttgataccagctattatgccatagcttgatgaggaagtttcttggtgagttttaggagcttaagatagcatgagagcctcagcctctgctcatcagatggcacatgtcctgctatgccaggtcccatgttttagtccattgggcttccttagaaaaaacatctgttctgtgagttagcaggagaaagaaggaaagaaagaagggagggagggaggaaggaaggaaggaaagaaagagtcatagttagaatttccacactccagtactattttaaaagaagaaggagggggagggccatagttagaatttccccactccagtattattttaaaataattcctccctcatttttttagtactttaatgacttcatttttttaatttaaa

SEQ ID NO: 21314 - DNA, 1063 bp, Homo sapiens
atgaggagatgcttctgttgacagatgaggaaactgaggcaccgagaagtcacttgcctagggacacacaggtggggctggtgagtggcagagcaaggatttgagccaggtggtctggctcctgtgtcctgtactagagaccacagctgggggtcctggggcaggtggcgtctgaggccatccgtccttggctctgccgcctcctccggaatgaatggccctggcatcccggtgcagatcagtagagtcctggctgcacactggggccaaaacaggcacttgaaattagggcctcatcgtgcccttctctcttcttcttcctggactttgaaattgctcactgcttgttgcacatctgctggagataacacggccatgtgtgcgtgtgtttgggggggttctgcctgcaccctgaaacctgtgggccaggagagtcctggggcatttgtcaggagcggcgctgtgcagcctgtgttttgctctccatacttcctggcacttaaaaaactctcgtggtattgctctaaaagcaaaaaggaaaacggaaggactcgatactcacatttcaaaaggaagttgtaaaatgtacggtctgtgcctggggtgagaagccctcgtgccttcctggcatgctgcaggttcccgtttaagttgctcagccagatctgattgtgctggtcaggctcacctgccaggtgagtgcgcggccggcctcacgtggagatgtgcctggtgtgcctggcagagccctttcaggctttgctttctaggagagtggtggaggaaatcagtcatttcaaaaccttttgtttttcttttgtacagcaaaaagatggcacctttgcagcagggggctacatgccccctctccggtttaaagcacttaccctctctgtggtgtttggaaccatggttggtggcatccttatccccaacggtaaggcgggagggctgccctgttgccggggagtgggacccggggcttcggcatcaaccaagacctgcacagttacgagacctgcacagagaccatcttctctggtctcttaaaaaagtctagaga

SEQ ID NO: 21315 - DNA, 1026 bp, Homo sapiens
aaattagctgggcatggtggcacgtgcatgtaaacccggctactcgggaggctgaggcaggagaattgcttgaaccaggaccggggaggcagaggtacgccgaggccaagatcgcaccactgcactccagcctggtctacagagggagaccccgtctcaaaaaaaaaaaaaaagaaagaaaaagaaagaaatgggcatgttcttacagaaactagagatttttagaaggaggaggcgaaatggtgccttgcccctggaaggccatctcttgcagaagcttcattatgaagtggattgaaggccattctggggggcagggcacaggtcccccccatgccctgcccactgtgacaggtgccactcggctaggatgtctgtctgccacgttgccatttcttattctccaacaggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcaggtaagaccctcggggcactctccggatcgtaatagcacaggtcaggctcgcttcccataagcccccagctgtcccgaaccagagatatagcaggaaagtggggatttgcgtcagaggagtcccgggagggcggaagttgggggagcctagaggaaccagattgatgggcaggagctgataatggccagagtctggagatgggcacatggcgttcactgcacagttctctttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagatggggtttcaccgtgttagccaggat

SEQ ID NO: 21316 - DNA, 1823 bp, Homo sapiens
ttctttccagggatgatcccgggggtccctggggtaggtggtcaggattggagaggagcctggggcttggccttccaccctggccaccccgtgtgcgtgggacaccccttcccacagtgtccgtggcttccttgggggtcactccccacagggtgtattgggggctgggggtaagcacgtgtcatggggcaccaacgctggtcccctcaagccaagactccctggtgtggactcagctgtggcgagaggacagtttagcactgggaagttcatgccgcaacatggccttcttctgtagctgtgggtctagggccgtggagacctcttgggtgtttctcctgattctctgccagcctcctggggctgtgtgcacaggcgttggccacttagctcccttctagcctgggccgaggggaaggctcatgtcctgcggggtcccctgactgctgctgatggcactccatgctgagggcggcctgatgggatggtgtgctaggacctgggcaacgggacaccagcagctgctggcaggaccttctcacttgtcagtctgctgggttttcttttttttggagatggggtcctgctgtgtcacccaagctggagtgcagtgatgcgatcacagctcactgtagcctcgacctcccgggctccagtgatcctcctgcctcggcctcccaaagtgctggtatttgggtgtcagccgctgtgcctggcctggtttgctttttaataaagtcaggatgtcctgtgttttctttcactttcttcaaggcggtttgggatttggctccgctggccgctgtgctggtgatgtcctgtgttttctttcactttcttcaaggcggtttgggatttggctccgctggccgctgtgctggtccatttactggctgctggctttctgcatcccgccctcccccggcccacctagcttcctttgtgcccttgagcccctgccctgggacagccatggccatggccacctggacaccctaggagcacccccctggactcccactccagagtcctcgttcagccccatggcagagcagctctcacctgtgctctggcgtgtgcctggcccaactcccttctccccggctgcacacagatgctccatggccccagcctctcccttgtcgtctcgcccacccctttccagaggcccaggtccctgtgcaggtccctcggatgcgtctgctgcctgtgcagggctgtcatgtccttgcctggctggtggcttgggtccctcccacccctagcagcaccacactcctggcaccaggctgtgggaccgaagccagttttctcatcacacaagtgagaggctgcagtggggaatcgcgccccaggccgcctccttgtctgtgccgactctgatcatgcctgtgcggaggcgccgagatggaggcgccgagatgggccggccgcccaggccagggtgtgtttgtttaactttccctcctcttgacagcgattctctgagcagcctcctccggctgcttgccctgtaaactggctgctttgactctcagcacccgctccctggcgtggagcagcagcctgtcgttctgtagccttggggaatgttcgcatggtgcacgctctggggggtgtcctgagtgggggctgctgcaacgctcctgtcctcagcaacaccaagtcctggcctcagcgctgggacttccagtgtgcagagaatgttgcatgaaggaaggtcagagactctcactgggctgcagagaggtcctagaagtggagccgctggggagggcgtgcctctctcaggtccgctgtgaaatggcctgtttctatacagc

SEQ ID NO: 21317 - DNA, 1053 bp, Homo sapiens
ctcccctatccttgctccttactcccaatcccccagtgtgggaaatacggataattatttgtgtgtgttggtttctaccggggagacaggcgctctgggctccttccccggcgggccagaggcctcgccggccagtgcgcacgcggcgccggttcccgaccaaggctccggcccgctctgctggctcgtttgaaacgtcgacattctcagcgcacgatccggggtctcgggggcacccatggggcccgaagcctctgcctgccggcggcgaccggacagctcccccgggcgcgcagggtagaggaagcgccctcgaaagcccccgcacgcattcacgagccggccctgcgcgggcacagcggcagccgcggcgggacacccggcagggtcttcggcgctactttgtgccaaaaactgcgctcccggagacccgggcaccgccggcgtcggcagctagagcgggacccagctcccaccgcgtcctccactggagcccctttcggcccctcggcgagtgcggcccgtggggagtgggcgtcggcgcgaggaagttccccggcccgggcgaccccggcttctgagcggcccctccccacgtcgccgcccgccaggccgacggaggaccggggcggggacgggggtctcagcggcccattctgctgtcacttctgacctattctccagcaacggcgcgtccccccctcggctttttcgcgaggtttgttgaagacggatttagcccccgcagagctggggaaggacggatggacggaaggcccagcgcggcccaccccttcccctcgtcgtctcccggctggcaggagccgcagcgacagcttcggggagcggggcctgccccaagacccccttcgcggcatcgggagccaggcgtggccggaggcaccgcggctgctccacgtggctcccgccggccgccaccccgcgcggggaggacgcgtgcgtgcggtgcgtggccggcgggctgcggggacgcgcttgaaattaaatcttcgcagtgcctgaccttgttttttcctcggccctgataactgc

SEQ ID NO: 21318 - DNA, 1059 bp, Homo sapiens
accttgttctgtgacctcacatcacagcatgactcttctcagcgactctgatacctgcaaaagatagaaattctctttgtcctgtgaagcattgcacttacaggacaaactgtgagatgctcatggacactgggcatcagcaaatgcacattaaaacaaattagatgccagtttgtggctatcagatgagcagaaatcaggagatgggtagttctgagcactggccagggcatggggaccagggacagtcacgcactctcgaagcgttgaaagctgcagctcttccggaactgcccagtgcaggttccctgggcaacttggcaagaccttgtctctacaaatttttttttttgaaacgcagtttccctctgttgcccaagctggagtccaatggtgtgatcttggctcacaccacaacctccgcctcctgggttcaagcgattgtcttgcctcagcctcccgagtagctgggattacaggcatgcgccaccacacctagctaattttgtatttttagtagaggcggggtttctccatgttgctcgggctgatcttgaactcccaaccgcaggtgatttgcttgccttggcctcccaaagtgctgggattacagacgtgagccaccgcacccagccaatttttttttttttttttttgacatggggtcttgctctgtcacctaggctggagtgcagtggtgtgatctcagctcactgcaagctccacctcccgggttcatgccattctcctgcctcagcctccccagcagctggtactacaagtgcccaccaccacacctagctaatcttttcatattttttagtagagacggggtttcaccgtgttagccaggatggtctcaatctcctgacctcgtgatctgcccgcctcagcctcccaaggtgctgggattacatgtgtgagccagcatgcctggccccaattttttttttattagctgagcatggtggtggcctgcctgtggtcccagctactcaggaggctgaggagaaaggatctcttgataggagtttgaggtttgagactgcagtgagctgt

SEQ ID NO: 21319 - DNA, 3540 bp, Homo sapiens
caagggacgtcccagggagcaaagccccgcagcgtggccggggactcggggacccaccccagctccggcgcggccccgccccgggtcaggcagtttcggggcgcagcagggccctccccacggcgcggcagtcccggggaggggccaggcccgtcagcccttcggccctcccggcgaccctcggagggcgccccaactcagacccgcccgccggcccgcgcagggtcgcgagcgcgcgggggtggcgcgggcggggccgttgggaggcggtgcgggctgggggcggggcgggccggggccccacgtgtccctgcccggcgggccaatgggtgcccggctttcggaaagatcgccatatatggacatgttctggggccgcgcgcgccgccgggccgcgcgggcgcgccgcttccgcttaaataacggcgggggaggccgcggtcggtctcagtcgccgctgccagctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgcaatggaagaagagatcgccgcgctggtcattgacaatggctccggcatgtgcaaagctggttttgctggggacgacgctccccgagccgtgtttccttccatcgtcgggcgccccagacaccaggtgagtggatggcgccgcggggctcctgggttctgcgttgcggggtgggttcggtgtcgccggcgaggctgacgggtcgtcccctgcagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggtgaggctcggccgacgcccgtgctcctcccgtcctttccccagtcattttctgcccggcttgatttctgacatttaagtgtttctttcgctgttccaggctctgttcctctcccggcatttcctccctgaagcctccaggtttctcatttggtttctgcctgcgttcttttcttttctccacacatcacactggcatgcagcatgttgtggcgtgtgagcatggggtggccgtgggtctctgtccctgactaagccgccccttgtcccttctcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtaggtgttgtgagctaaaggtttctactcttacatcctcggtgacacagcatcactaagggagggctctgtcccctaggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaatgaatggctcctgtttggggaagtagcaagtgggctgggaaagacagaccaacctggaagtattgggtagtcttgggggtgggggcggtgggtgctgctcagcttggcttcgtgggctggtgagaaaacggcttaacaataaactgagcagttcgatttcttccaaatcgaaagtgcaagaacaaggcagcctagtgggtttgggtgttggagataactgaagcaacatcataagcaggctgggagggaagtcctgagacggctt

SEQ ID NO: 21320 - DNA, 1881 bp, Homo sapiens
cctcagtgctgagattgcagtggtaagccaccatgtccagccaactctttaataataggcagttctgactggtgtaagttctgactggtatctcactgtggttttaatttgcatctctgatgattagtgatgttgggcattttttcatgggttttttgtttgtttgttttgagacaaagtcttgttctgttgcccaggctggagtgcagtagtgtgatctcagctcactgcagcctccacctcccgggttcaagccattgtccagcctctgcctcctaagtagctggaattacaggtggctgccaccacacccagctaatttttttagttttagtagagacagggtttctccatgttggccaggctggtctcaaactcctgacctcaagtgatccacccacctcggcttcccaaagtgctgggattataggtgtgagccaccgcgcccggccctcatgggttgttttgttttgttttgagacggaatctcaccctgtcacccaggctgcagtgcaatctcatgatctccacttactgcaacctccacgtcctgggttcaagtgatactcctgcctcagcctcccgagtagctgggactacaggcgtgcacccacgcctggctaatttttatatttttagtagagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggaggtcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtagctcacgcctgtaatcccagcactttgggaggccgaggcggtggatcatttgaggtcaggagttcgagacagccaggccaacatggtgaaaacccatctctactaaaaataaaaaaaattagccaggtgtggtggcacgtgcctgtaatcctagctacttgggaggctgaggtaggagaatcgcttgaacccaggaggcagaggttgcagcgagccgagattgcgccattgcactccagcctcggcaacaacaaaaaaaaggagatgcaggaacagtcactatcattagtcatcagggaaatgcaaattaaaacatgagaagccgttacacattcatcagtgtggctgaaatgaaaaaaacgcgacaatgtcaagtgtgagtgaagatgtgaagcagctgggactctcgtacctt

SEQ ID NO: 21321 - DNA, 1077 bp, Homo sapiens
ttccgtggaccgtctgtctgtctgtccttgttactggcgtgctgagtgtgtgtggtgtgctgctcattgtgtatcacaagccagagactccagcagggtgttttcttccagagagggctttcctttcctccatgggaaatgtggtggtggtgagctgtccatctccatccaggtggcaagtagctggtcagagccgagttgcattttgatgagacttcgtctattgttgatccttccctttttctacagtgtaaccccttaggggtgccatctgagagcctggtagagctctttgtgaggtgacagtcttccttaaatctttgtctcattggccctgaaaggctgggagatacagtctgtccagaagtttcttgttttcctcatgcctcatacagcttaaatatgtaggtatcccatgtaccttaaaacttttgcaagcatcttttttttttttttttgagacagttttgctctgttacccaggctggagtacagtggcgcgatctcggcccactgcagcctccgccccttgagttcaagcgattcttgtgcctcagcctcccgagtagttgggactacagatgtgtgccacctgcccggctaattttttgtgtttttagtagagactgtgttttaccatgttggccaggccggtcttgaactcctggactcaagtgatttgcccaccttggctacccaaagtgttgggattataggcgtgaggccacccaaagtgctgggattacaccacacccagctgcaaacatcttgaggggagagaatggctgcatgtttgaaattcctgtgtctccagagtctctgccagaccctcatctcccagcactcacttcctgcaggaggggagggaaggggctttccatctcagtgccacagtcccctttgctgggggtcttcttatctggtttggattcaggcccctgcctccccttcctccctcctaccccgttgggcaggctggtctcgaactcctgatctcaagtgacctacccacctcagcctcacagagtgctgggattacatgcatgagacactgtgcctgacctatatttttctttt

SEQ ID NO: 21322 - DNA, 1035 bp, Homo sapiens
tagagcatgtccttagtggcacctgtttgtggagccaagtgtgtgcggagctgcagggtgtcctgactgtgctaggtcttgtgctaggtcttgtgctgtggccacccatccgttgactactgaatttttttttttttttttgagatggagtctgtcacccaggctggagtgcagcggcacaatctcggctcactgcaagctccacctcccgggttcacgccattcacgccattctcctgcctcagcctcctgagtagctgggactacaggcgcccgccaccgcacccagctaatttttttatttttagtagggacggggtttcaccgtgttatccgggatggtctcgatctcctgacctcgtgatccgcctgtctcagcctcccaaagtgctgggattacaggcatgagccaccgcacccggccgactactgaacattttttaactcttacccccgacaaactcttgagggtttgttttttctgttgatcagaggtgaagagttaacagatatggactggttttgaatgccgtttggtagactctttttaaaggtctctctcttgcaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggtaaaagtatggtaagaaaaagaactctgtacatggagaatggtgtgaacctgtcttggacctttctaatttgggtgcattctgcctatagcagccgtttgtcagctgtggttgaaccctgcttgtcactaaaggcttctgtcacgtttctggggctggatattcgctactcatgcttccatggcgtagggcttctcaccagaagtggagctacatgcactggctttgagatcagtaacaccaaatccgaccattgcaacacagacagtctcagtttctaaagatgagaagatgggtccttggcat

SEQ ID NO: 21323 - DNA, 1056 bp, Homo sapiens
ccctgagtccacgcacttggctgtagtgagtggttcaaagaacttacctatttattgccctgggcctcatattcccctagtgcaagctgcacacaggacgagcctttatttatgggagtgaccttctcgctggattatgaatggctgaagcatttgtgtggctgtgataaaggggcagcatttacagcgggctccctggacaatccttttccgatctgacacaaagctgagcctgtcggcctccgtgcttatcattgttgatttactttgccttgaatctcacatctcttctactggtttgtcctggtgagactgagagttaccgtaataatgccgactggaactgttaatgctgggtttacagcaggaaggccagcccgattttcttcatgaggcatctcttgcctcatcttgtggcatttctttttgcacaattttcctgaaactcatttgacttagagcgttttgtgtttaatagagattcattttaatcttgaaaagataactggcacacaaagaaaaacttgcttctggctatgtgcagtgacgcctgtagtcccgacactttgggaggccagggccagaggatcatttgagcctaggaattgttcagcctgggcaactctttttttgtataccctgtctctacaaaaaatttaaaaaattagctgggtgtggtggttcacgcctgtagtcccagctactcaggaagctgaggcaagagaatcacttgaggtcgaggctgcagtgagccatgattgcaccaccatactccaacctgggcaacagcatgagaccccatctctaaaacagttaaattggccagactcagtggctcacgcctgtaaagctaacactttgggaggccaaggcgggtggatcatgaggtcaggagtttgagaccagcctggccaatatgctgaaaccccgtctccactaaaaatacaaaaataagctgggcgtggtggcgtgcacctgtagtcctagctacttgggaggcagaggcagaagagttgcttgaacccagaggtggaggttgtagtgagcagagactgt

SEQ ID NO: 21324 - DNA, 1029 bp, Homo sapiens
acttgagtgtctatccctagacactgccagttagtcttgctttttaaggaaatttgtatgtcttacttcttgtaatcttcaggttccccttccatctcttcccttttcttgaaatttatctgttgaggaacttggtccattgacctgtagagtttcccacctctgaggtcttgctgatttcacattcacaagaccctccagcatgaccctctgtgtcctggatttcctgccgatgcaaagcggtaaacagaggcctgacagactcaggccattccctcagcaggaccatggggtgctgtacccccaccttttttttttttttgagacggagtctcaatctgttgcccaggctggagtgcagtggcgcaatctcagctcactgcaacctctgcctcccaggttcaagcgattctcctgcctcagcctcctgagtagctgggattacaggtgcccaccaccattcccaggtaatttttgtatttttagtagagacagggtttcaccgtgttggccaggctgatctcaatctcttgacctcaagtgattcacccgcctcagcctcccaaagtgttggcattacagatgtaagccactgcgcctggcaccccgccttttttcttttcttttctttctttttttttttttttcttgagacagagtttcattcttgttgcccaggctagagtgcagtggcatggtctcagctcaccacaacctctgcccccccgggttcaagcgattctcctgccttagcctcccgagtagctgggattacaggcatgtgccaccacgcccggctaattttgtttttgtttttgttttttgagacggagtctcactgtgttgcccaggctagagtccagtggcgcgatttcagctcactgcaagctccacctcccgggttcatgccattctcctgcctcagcctcccgaatagctgggactacaggcgcccgccaacatgcccggctaattttttgtgtttttttttttttttttaattgatcattcttgggtgtttctcgcaga

SEQ ID NO: 21325 - DNA, 1030 bp, Homo sapiens
tctggggactggccgtggacatggagcggatgatgcccctcgcaggactagttaaataagtgaagttggtagcgtgtcagtccgtgatcctgggtagatagagcagggcagcgacggaagactgcctataggacattcacgctgggatgagaggggcctgagaggcctgggctttgtgacagggaaacttggataaagggtggtgcgattcttccggttggtccctcagaggtggtggggcttggttatactggtagaggtgctgggctggccaggagcttacagggttacacctctcgcatactggtgtccacagagcagccatcttagctggaggtgtcgagtgcctcccccaccccccaccatgtgcttgagtgcacacccggcgccaggccctgatcctggcacttcttgtgaatcacaccgtgtcatacccatgacttccattgcacagtggggaaactgagtctagagaggtgaaataacatgtctaaagtcacaggaagtgaaaaagctgaggacatggagccagttgcccaatgacaggagagctgaaatgtcctcactgctgggggtagaccgggcctcaccagcttcctggagagtcacatgtttgtctgcatcctcagggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggact

SEQ ID NO: 21326 - DNA, 1900 bp, Homo sapiens
gggctggagtgcagtgccacgatcttggctccctgcagccttgacctcctgggctcaagcagtcctcccaccccagcctctgagtagctgggactacaagtgcatgctgccacaccaggtgtgttcatatgggtgtgtgccgcatgtgtgtgggcaggtgtgtacagacaggtgtgtgcgggcggttgtatgcatgtgtgtggcagatgtattcagctaaggtgtgtgcaggtaggtatgtgtgggcaggtgtgtgtgtgtgtgtgtgtgtgcacacaaggcaaagggagccccggaagggtagttgcttgggaggatgtggggcaatcagtgggatctggggcaggagtgacaaccgaacccagcagggggatcccaggccaaaggtgtggctgcataaaggccaagtggccactggaggcagaggatgcatggggagaagagccacgggagagggcaggctgggaggcaggtacccctaaagcagcagtcggtcagtggtgagagccagcagggggcgaggcagggggctggccagtctacctgttacctgagctctgcctttctctgtaacgggagcttcccagcaggcagcatgtccctgtgggaccctcaacccaaacaggcctttccctccgtgctctggtgttcgtgggctggagtccctggcaggaggactgggcagagagaccccagagtccaagaaaggagaggtgactttgtgagcaaactgggtgctgccgtgggtggggagcccctggccctttttggacctcactcctggcctgggatggggcacagagttccagggctgggagctggttttctgctctttgctggttttgcccttgagccgtgggattcttatcacgtggtgtttgagggctggaccattgacatgaggcggaatgagccagagaggactcgaagcctcagtgctcctggccctctgtgagggctgcagccgtgtgccctggagtatctgcagccttgggcctctgggtgggcaggggagttgcttgtgctcaaagccccctcctgggaatcctgggactcccctcccccagaacctggagttgccccctctggagcagggcaggctggagaccagccctgtcagcttccccaccttggggttgtgtgtcctcagctggagtggggacactgtccagcctgccagtgtgagcgtctgagcctcaaaatagactccatttttccagagccgtggattcccctgggctgggaggccataaacgggcggcagcccagggtcttggtcaccaggtcaggcccagcagcttcctccagggccaccccctctgcccaccaggggagctggagtttggttccatctccagggtactgatgtggctcatgctctagggaaccaggaagctggacctgggtaggtgccggggagctgggatcacctttaggaagctcatccccgttttacagaaaggaaatcaaggctcagcagaagccgtgtgcccagccctgcaccagggagagcagggtcagttagctgaggggctgcaggccctctgctgcagtgagaggcagctggacatcagagatgctgacggccccaccagcccacgtggggaggggctctggccacagtgctcccggtgctggggctgaggcctccacgtctgagcctgagacgtggaggatcaaggccgctgagcgggcttgatcgcttcaagttgtgtgtgtgtctggctcgtctggccagctctctgctacctcgtagggttgcctggagcccactggctgcctgtggctggaccccagcctgtgggggacaccctggtaggcagagggaccatgcactttgttcacatctgaagggaggaggcaggtgtgccctgcgcctccccctccttctgtgctggag

SEQ ID NO: 21327 - DNA, 1295 bp, Homo sapiens
cggaggagctgacggcagagaggatcacagagttctgccaccgcttcctggagggcaaaatcaaggtgcaggcgcgtccccgggccagggctgcctcccgggtagagccgccaccttggggtctctgggctctcagtgtcctgggcttcgtcctcaaagtaagatcttcagagtaagaggacggagcccaagatggtgtgaagaccaccattcttgtcacacctttggggacctgtaggagccctcttgtccacacggctggcccagatgctcctcagggaaacctcctggccggcgagggtgcggcctgcgtgggctcattgggcccagcccactggcccagccttctctttctggattcttggcactgttggtgtctgcggctgccaccctggtgtgcccagggcagccacgcacctcagtcccgggcagggtgagggttggggagctctgtggtcccccaggcatcgccgcccctcaccgtgccctgcctgccctccagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgccaccagggcacgcgcaaggtaggcagactcctggggaagcgtctgccagtggctttgtgtccaggacacaccctagaactgctttcttttcagatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtgcgccttccctccagacggggctggggcgggctctgggaagagcagtggtccccacgccagcctgggtgcctctctggaaggagcctggggctagtcaggtgggagaagagctgtgggagctccttcagaagcacccacctttgtttttcgagagagatgggatctcactatattgcctaggctgtttttgaactcccaatgtgctggattccgggtgtgagccaccggaccgggcctgctctgcctttctctagggaggaggagccaatgccaggagattggctctgggccgggaccagcccctgcactcatccctgtcttccacaggtcattgattacaacggggaacgcacgctgga

SEQ ID NO: 21328 - DNA, 1004 bp, Homo sapiens
actgtcgaggaacagccatgtcctgtacccattgctggacctgtggctcgaaaccccacgggagggcagggctgctggctgctgtgacttcccacgtccagggagacccgggcccaggggctgtgctcccagcagcaatgctcagtcagggccctctttctgtccacagtttgatgaaggccggaacaactttgaaggggaggtcaccaaggagaacctgctggactttatcaaacacaaccagctgccccttgtcatcgagttcaccgagcaggtgcggctgccctgcagcccccaggctggggatggggaggagtgggttgggggtggcatgaggctcccggtcaccactgctgtccagcgtctgacattggaggccattgggagaatcttctgcattaatagtgtgtgactcagacccagtaacttaagtttataacacagacagccccgaagatttttggaggtgaaatcaagactcacatcctgctgttcttgcccaagagtgtgtctgactatgacggcaaactgagcaacttcaaaacagcagccgagagcttcaagggcaaggtgagctgctcttctgggtggctcgtggggcggtgccagggagcagtacaactcttcccgaggtgacaagtgtggggccttcctgaggctgcctgctggactggatcgggcacctgattcaggacagcctggatgtaggcgaggggccagccaggccagacctctgctcccagtcacctgctggtctggttgggcaaccccggaatccaggttggaggaaaaaggcaccggagcacggtctgcttccgagcaaagtcagggctggaggcagaggccagccgtctcccgcacctgtgcaacctccttttctcccccagatcctgttcatcttcatcgacagcgaccacaccgacaaccagcgcatcctcgagttctttggcctgaagaaggaagagtgcccggccgtgcgcctcatcaccctggaggaggagatg

SEQ ID NO: 21329 - DNA, 1026 bp, Homo sapiens
gttcacgccattctcctgcctcagcctcccgagtagctgggactacagggcacccgccaccacacccagctaatttttttgtatttttagtagagacggggtttcaccgtgttagccagggtggtctcgaactcctgacttcatgatccgcctgccttggcctcccaaagtgctgggattacaggtgtgagccaccgacccattcactttctgtagtaagcacggagcatccagcactccccgggaccaggtaggagggagggtagagccagcttcctggagcgcggtggtgcgggtgggtcaggatggcttgcttccatgttcttgttcttgtcatttagctgtttttgcagccacttcctcaagataactcaagacagtagatgctctttaccaggagacattctcttgatgtcccctgaagggaagagagttgctaaattagtctattgccattgcaaggtgcccaggaaattaaacctctgactagaaaaagccagtgaagtgttggataaagttgaaggaaccaaaggtctttttagagcttttattaaagagaaagttccaagtcttgtcctgaaacttgggttctggggcagactttctccagagcccacgaaactcgcgaaccctgtgttgtcacacagcccacagctccttcagtgccctggatgtctgcagtggccgctgtgactctatggacagtttggtgatatgtgtccgcgaaggctgggagggtggtttcgttgctcttgcctgcaaaggctcacacgtggccatccatgtgggctccccacaggttaacgttctgtctccattctctggagtccactagagctgggcacagacaaacccacttgggtttgatgccagttggtgggtggcgctttcctgcccactgaaggtggctcaggtgtctgtgatggcgaacgtggtcgttgcaggcagctccgggcagaagcccggccccctgtccggtgcacgtggtaggggctgccctggaagtcagagctcaccccgcagctg

SEQ ID NO: 21330 - DNA, 1069 bp, Homo sapiens
gcctcttccatggtgggagaacatcttacttaggttgattcaggtgtcctcagcctggctggcagagagcagagacgggagcaggcgcggcagggcaggcggcactccctgtttgagagtagaacctacatttgtttggggttagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggtagagaccagagcattccagtcttccttccttccgtcatccattgaggaggggtccacagcctgcagctggcagttctgcacgtgtcccccctggcctgggctctacagggtctgccctactgcttggtgctgcgggatcatgacgacctctgcttctccctcctcattcaggacgtggagtcggactctgccaagcagtttttgcaggcagcagaggccatcgatgacataccatttgggatcacttccaacagtgacgtgttctccaaataccagctcgacaaagatggggttgtcctctttaagaaggtgagtggccccaggcagctctgcccaggttagttctggggttggtctgcagagggtggcgttgctctccttatcgttaagggaaccttgctcctggcacctttggcccaataggtatgttctgcagctttgccaagttggggtgttgcgctgatgcctgtggcctggtcttcgcattcagctgtgggctttctggccactctcctgccacagccgcctcagaactgcttttgactgttagcttttttttttttttcaattatgataaaacatgtaacaacatttgccctttttttttttttgggagagtcttgctctgtcacccatgctggagtgcagttgcgtgatctcggctcactgcaccctccgcctcctgggttcaagtgattctcctgcctcggcctcccgagtagctgggactacaggcatgcactaccatgcccagctaatctttgttttagtagagatgagatttcacc

SEQ ID NO: 21331 - DNA, 1854 bp, Homo sapiens
ggcggcccacaagtacctgctggtggagttctgtgagcgccgggcctggcgggcgggcggggctcggggccgctgagccaggctcttgggacgcaggcacggcccggcagcccccggggtcgggacccccggcgcgcccggaactgaagggctcccttgctgcccgccttgggggccatgtcaggggctccctgggggtgagagccgggctgggagccggggggccgtcccgatgcccgccctgcgcacggcaggatcttcctgttagtgcgagaagaacaggatcgacctgtgtgagcaaacagagcaagccagtgtccagccttgccgagtcctccccgggggccgacccggaaggcgccccgctcctgcccaccccaccttcagcttgccacagcagtccttccgatggtgtctcagaggagaatcccaagccttcctcacgtccataaggatttgagctctgtccctggggtgggaaccttgtgcctgacacagctgctaactctattgacagatcgtcttattctcaccctaagcaactcagggtctgtgtgcacggatgtgcatctcatactcacagctagtgctggtacaggccgccacggtcacttcttcacttttgtctgtagtcttaaagggaaagtctaggggagatccttgccttagttgcctgtggggaataagaagtcagcaaccattgaaaggtttgtctggctgtgctgatggtgacatagcagagtgggggctggtgttggttggtggtagtttgtcgttcacggcctctgtcctgatattgcccaagaacaccaggctatcagctcagccttgtgcgttaggaggggttatcttggtgagtagataaggtttttatgaagggaaatgccagaggaaaaagggaagcactgctgagggatcaaggctgctttagggatcaaggctgctttctagcatctcatttccgcttccagatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggtgtggctgtggcactgcccttgaactgtctttagagagggactggcctgccgacttggaagggcaggggcagctgtctgagcggtggggaggccgggttccagaggcttggagggatcccgttcctcaggccgggttctctgtccacttgtgccctgagggtcttgtgaggagttttcatcctggaagaaccttcgaatggagaacctgtcttgtctggtgccatcctgggggcggctggctgaggtctgtttggagactgaccagcgaggagagggagactggtgcctttctggccacatgggctgtttgtgctgccccctgttcctaggagcagcagcatggctgtagctctcggggtgacacctgctagctgtcgtgtgtagcgtgccagctgccgcgtcacgtgcttgcgtgatttctcctcgcatcctctctgtgaggcgggcttttcccagacaaagggctgaggcttagagcagctgagtaacagcatcgagcctgtcggtagcagacctcgaatccaagcccgccctgctccgtctgtagcacgggccctcagctgctcgtctgccgcctctgaagctgccgtagtggaggccgagcccctgtgtagccagatcagtgacggtggcaaaagaaaactcgtctataaaaccggttctgtggcatgtca

SEQ ID NO: 21332 - DNA, 1058 bp, Homo sapiens
atgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggagctgggggtgtctgctgcttggcttctccagggtgtggcaggggagggcctggctcctctactgcctcacgggctttaggagacaaaggggaagatggggaccctggtggggtggtgggaggggaagggcagggcccccttgaagtgctgtggctgctgggccccttgcaactatctggggagaaaggaatgtgactcccagctacagtagccctaggcagcaacagtctagaacagtgcagaaggccttggctggggttgcccctccttgctaagggaatgggaagacgggcctggcttgtgtagctcatgctgccagagggagagctgcttgattccctggccgggcttggaggtgtcgagttggcccagctgtgcgcgggccctccaatgactggatcccaaggaaacccagggaggaacaggcccaagccagggtcggccttgtggcccctggcgcacgtg

SEQ ID NO: 21333 - DNA, 1077 bp, Homo sapiens
ggggcatcctgtttgaaagatgacgctgagccgaccacacacgtttacatgtgactaccacggccagaggagcaaccctactgagggataccgagccccgttaccccgtagggcgagggcctgggcagctcaagagcggcaagaccctaagagagggtttagtgtgggccccgccggttgattctggggcctgctagccccgccccacacatacagggggctgctgcctcctccatcgtggagggggaggtgtgtcctctctccccatgatcggctgcagttcccattttgtcttagatgttatacctggggtgggggcacctcacactgccccagaggatgcccctgagcaggaatcgcgggggtggagaggagcgaaggtggcccccttggagcccttttggagctccggctgcagcccacactcctgctcagaagtgcgcctccgttggggatccaggtccaaggcctgtcaccgtcccgcccacaggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcaggtgagtctgggctgcgggagccgggtggccgcccgttcactccagctgtcttgccgctccccagcccctacttccactggtgggggtggggccctcacctgctgtcactccccagaccccaacgtccccaacgtcgtggtgactggcctgaccctggtgtgcagctcggccccgggccccctggagctggacctgacgggtgagtgccctgcggccgcgggggtccgggcggcccctggtggggatctcgggaagtgcagccagggggccgcgcagggctggggcttcgcgcagggctgctgggcagtcattgagggggaggtccccccaacaggcgacctggagagcttcaagaagcagtcgtttgtgc

SEQ ID NO: 21334 - DNA, 1522 bp, Homo sapiens
gatattctaaatggaattaaatgtcctattatcagtggcattcatcacattcaacaaaatagcatcataaaaggttgatattgttgagcgtaatgaatacctgaactccagttacataaagatgaggatcatgtctcttcatattaccttaatgtcattacattttgtagaaaaacttgtctcaggctgggcgcagtggctcacgcctgtaatcccggcacattgagaggctgaggcaggcagatcacaaagtcaggagatcgagaccatcctggctaacatggtgaaaccccgtctctactataaatacaaaaaattagccaggcgtggtggcgggcccctgtagtcccagctactggggaggctgaggcaggagaatggcgtgaacccaggaggcggagcttgcagtgagccaagattgcaccactgcactccagcctgggtgacagagcgagactgtgtctcaaaaaaaaaaagaaacttgtctcaaaagtgctatgatattcttcctgaaatggacattgtagcatctcaatatcttttttaaaaaactaaatttttgaaaaattgtgttttgagacaaggtctccctctgatgtccaggctagagtgcagtggcgcaaacacagctcactgcatcctggaactcccgggatcaagggatctcccacctcagcctccttagtagctgggactacagacacccaccaccgcgcctggctgatttttaaaactttgtatagatggggtctcactatgttgcccaggttggtcttgaactcttgtgctccagggatcctcctgccttggtctcccaaagtgttggaattacaggcctgagccaccacaccgaacatagcctattaatgtcagcctatttctctatttatgaattttctgaagtgttatttttatattcagatttatagaagcttttgtcttttatgaccttgacacttttaaagggtactctcagctattttgtagaatgtccctcacactggggactctgaccttatgactggacaaggttttgttttttgtttttttttttttttttgagacggagtctttctctgtcttctaagctggagtgcggtggtgtgatctcagctcactgcaatctctgcctcccaggttcaagcgattctccttcctcagcctcctgagtagctgggattttaggcacccgccaccacacccggctaattattgtatttttattagagacaaggtttcaccatgctggccaggctggtcttgaactcctgacctcatgatccatccgccttggcctcccaaaagtgctgggattacaggcctgagccaccacgccctgctggtttattttattttttggcatgaataccacagctgggatgtcatcttctcaatgcatagtggagatatgcaatgtcagtctgtccaactcctggtcctgttagttcaggtggtggcagcggctgccggggcttctcccctacatagttactgttttccctttgtcatccataaatacctt

SEQ ID NO: 21335 - DNA, 1055 bp, Homo sapiens
ggcacccggagaggcacccgcggaggcgcccgtggaagaggcagaggtgccggcaggaattcaaagcagcagctttcggcagaggagctggatgcccagctggacgcctataatgcgagagtgagtcccgggggagccagctgggggcctggtcaaagccgcagtggggagcaggccgcctgtgaatgcaagcctctttctcctctgtgtttcagatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgtagaactggaactgtttgattcgtcccactgttggagtccaggcctgggccaggattttggtgtctgtccagctgggagggggtgggagaacctgagttggggatggagggagcagccccatctggtgttggacacctgaagttggcatgggttgtgggggtggcggggggtccccgctcctggagggccgaagctgcctgtcttctttcttatcttctttcctgcctcacacctaacaccttcctctctaactcaccaggtgggaggacacctttgcccgggagccacctgttgacccttgtgcctgtgcctccaggtgaggggaggttggggtgggatggctgccctgtgtgccgtccacaggcttcccacagccagaacatctctgggctgttcctttccttcttgtactctggttttcagagaaacgtggattcagcagttttgactttgtagtgtaattcctttttctgtttgtttttttgttgttgtttttaaccttgccacggagcaaggcatgaggatcctctcttagttgt

SEQ ID NO: 21336 - DNA, 1050 bp, Homo sapiens
tgtaaacttacggacacctctttgtggctgttggagtttagtttttatatacacagagttatcagacattatttataaaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctc

SEQ ID NO: 21337 - DNA, 1048 bp, Homo sapiens
tctcacacacatctgctcattcacgcactcagcagatacgtattgagctccagcccagtgttgcgcaggacacagggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcggggtggccagccacattaggaaacttctgtgggggcccaccttcctcctgccctcgctgtgggattaagttagaccagtaggacacgcagcaacatccaggcacaaggaaaattccatggaaggtgaaagaagcaaagagcaagagaaagacagagtttgctgtttgcctgggatcccacagctggtcaaaggcagagccaggctgggagccgctgtccccagttcaggtctgcagggtgggtgaggacgtctttctcgccacactgcccactctccagtccagacaccctcagactctgcgagtgccaccctgtaacagtgaggggaacacgaggggcctggcctcacctccagcctgcaggggagacaggtgtaaacccacatcccgtggtggggccacgagaactcaggtctggggggcactgcggggagatttggtgatgctgagctgattcgaatgaggtgagaaggagcccagcagctgtgtgggggcgtgtcgctggcagaggggaataaaggtgctgaggtgagggtgacagcatcgcccagggctgactggcactgggagctgtgggcttcactccctcttcctgggtgcacgcttgtgctccaaagccaacctctccctgcctctctagggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaa

SEQ ID NO: 21338 - DNA, 1025 bp, Homo sapiens
gggtccccgtgtctgtcctcagggaccctttcctgcaactctgcagggccaaggcctcgggagggcgggggtatgtctggagcacccagccagagcggtgggtgagggtcccgcataacctccccctgccttgcagtgagcggggacgcgctgcagctcatggtggagttgctgaaggtcttcgttgtgggtgagcccagggcccacgctccctccgggcacagcatccggaattttgcgtttttccagcgggaaaaccaagacgtgttttcccgtttcccacaagggcctaaacttgggtctcctgagcctgtttgtcaggtgctgtggcctggttctgggggctgcccgtgggtgttggggggggcaccggcccaggctgaggccctcactgggctcgggtttaagatccccccagcatcccccacctctcgcgtttctcaccgcagaagcagcagtccgcggcgtgcggcaggcccaggcagaagacgcgctccgtgtggacgtggaccagctggagaaggtgcttccgcagctggtgcgtgagcgtgggtcggggcgcaagtgggggtgcccggctggctggccctaagtgcttctcttccccacagctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcg

SEQ ID NO: 21339 - DNA, 1045 bp, Homo sapiens
gagatgaggccccaggacggggacagtgagatcgtccagcccgaggagccggcaggacctaccccagccgccaggcacagtggtttcccttttgtttgctccccggtgggcgccagcactgggctaggaacgcgtggtttcttcggtgctccacgttacacacacttgacagggattaaccccacctgccagtggagaaactgaggcacgggggcgttaagtgactcagcagggctagggtcagacctaggccgtctgagccaggatccgcccaggctggagggcgtgccctgctcttccctgttcctggaagtggagctctctgggggtgccatgtgcagaggaccccatcggtgcaggcagagtggtttctgaacctttctactgctctacctgaaggttggggcaccgagcttcctcgatgtcagcagggcctcgtgggcctctgtggcctgggaagggagggtctcaggcccttgtgaacccatcctggagggaggacttcagccctgtagaagcagggagaattctgtttctcctgaatcaggcccttctttatcacccaaggcagcaggcgtggggggcggggggtgtcggtgtggggaactctggtggtggagttgaagattcttgccggaattcagaaagagaaagtcactgaggcttgggccacctcactgggtggttgtgagaacaccaggttaaagtagccaaaaggccactgccggagacggggcactgggtacacaccccaggaggtcatgtgttctatcaagcccacctgacaactagaggcccaggggctctggccagagctggagttgtggtcattgcagagaatgagcgtgagaatgacggggagtggggggcccgtagccctggcgtggcgcccacgtcatggggcaaagctggctgtgtcctaggcaccctccacaaccgccccagtgctgggcctgccttccgaggccactgccgatgtacggggaagccccatggattgtcgaggcagacctggcatccgccactctctggcgtggtcttcctt

SEQ ID NO: 21340 - DNA, 1030 bp, Homo sapiens
gcacacacgctttccggaagagtccagcttgcaggtcctctgagaatataatgttgtatccgttttacctaaactccgtcaacactagtcttaaaacctaaagcctgttactgctgtctaacggaaaggagatgatcattcatgtttaagccacactctaaggttgcatagtgcctggtccgggaggtcaccctgtctcatttatcctccccattttttttggcctaagttcaggtccacgaggtcctgaggcttttctcctaagtgaccagttacgctgctcccttttgtattgttgggttatgtttataaacgtttcaaaccagcagttttccgctttgattcaaataaccattcccgggcaggaccagtcccaggctcgctgttctgggcagagcccctggccgtcccaggcccaagtccctgctggacccagttggctccagctgcagagagtcagtgtggacaggggtgaggagggaaccaggggcggccacccctctggaggaaacagggcttggaggagcaggggggctctagggggccggcctggtaagaagcagccagccaaggtcccataggcaggtgctgttaggcccgcaaggcagcgacgtggtcacaggcacaggtcacgtggggtgtgtcatggtacctgatgagacagtgtccacactcagtggacacctcccttcagccctaggagttttgaacaacacaggaaaccaccagctccaacatgtccagagagcacctcccgacagcagcagaacacatgctctcctcgagcgcacgagaactttgtccaggagaggccagatgttagaccacaaatcaagtctcagtgtgttttgaaagatagatactaaaccctgtcacagtggcacgagcctatagtcccagcactttgggaggccgaggcgggaggatcacttgagcccaggaattccagaccagcctgggcaacatagggagacccccatctcttaaacagaataaaatgtattatacaaagtttcatctctgagcccac

SEQ ID NO: 21341 - DNA, 1096 bp, Homo sapiens
agccggctcgctggcctctcctgccccgggagctgttcctcagcgctggggacagatactctagtcacgggtggaaagagccccaccaatgctgaggaggctccctgaagccaggcatgcagggaagccctaggtgctagcagggctgcaaaggacaccccagttcagagcagctcgggctggcagacctgcctcacgcccacagtgacagcagccagaccctgaccacacgtcacccactggcttccccggggcagactttaggcaccacctacacctgtacatgtgcccacaacatcctgcgccctgccagggaagttttccctggctgaggcagggaccagcctactgccctgggctgggaggacttagcaacaggggaacgtggggtcagctgggcgtgacccaggccctcacctgcggcacacttgagcttggtgaggatggcctgggtctggctgtcacgctctcctcgctgctgtaggaggaagccacatgcgtgaggcccatgctccacatttcctagagctcgatgcccagcccccagactgagaggggatgaaggcagattcagatctgggggagaatgaggtgggggaggacaggaggggccagcagtggtcaggaatcctgggggcaaggtctctgaggaggtggcccgtacctcggcaatctctggggtggactcagccttgctgacgtagctgagcacatgagaccaattctgcaagtagacgctgacctggcgggggggcgcagagccaagtgagcccgggcgccccaatggcccagccatgctgcccacccccgcccgccgaggcaggccgaccttgatgacattgaggcacatgttgatgacgtgtttggcgctggtgcagtagtcccgggcccgggaatagcacttgagggcgttgctgaggtccccacagtccaggtagtggtcgcccaggtcgtcgtggccgcgccggatgctctctttgatggagttgcccttgtagttcttcaggtctgtgtccagcttctccagcttcagcagcgccttcttccgcgtggcctccacccaggccgtgtccagggctgggggctccacgccgct

SEQ ID NO: 21342 - DNA, 1052 bp, Homo sapiens
gtgagtgggttcgaggcagggctctggggccgctttaggatataacgggatgaagcccccaatgcgaacttgggggctgggcagcgcagggcctcagcgcccacggtctacccgcggcccgggccttatgtgcgcctcagcgaggcccaatttccacatgcctcgtttccagcgagctgtcggtgagtcccggcgagccccgacccctctctagccacggcctgacgggtacggtggtgacctcagcctctgacctccgaccccgcgccgcgacctctcgtcgccggtcccctcggagccgggcgcggtttccggggaacgcgtttcccgccgcaccgtgggccgcccggaccgcgcaggaccgggcaccttccggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcggtgaggacgcggaggcgtgtgggctcctgtcacttcacacagcaaacgctgcccgccgcgtggctccggaggagtctcgcgaggggcgcccctgtggcgtttcgggccagccgggccgcctggccgggtgcggagaaggaagctctgcccttcccctggcccggcgcggagccgattctcccgggaaggggccgggggtcctaacttcaccgccgggcggcctgctcagggccaggcccgcggggacgctggcgtcaaggtttcttcccccttcacgccagtcccctaccaggccgacatcgagtcccgctccccagggagggtcaagtcccaggggtccagcggctcccccgaggtccgctaggaggtggcggcactggagtggccgttctccagcctgcaccgacccccgcctttagtgcccccgcgtgtgacccaacggtggtactggagcggccttagaagggtgaccgctgcctctgagtt

SEQ ID NO: 21343 - DNA, 3678 bp, Homo sapiens
catcagggtcttgggacatagcagtcgtgcccctgtgcgcctcagtttccccatctgcagagccagggtgcgggcgcaggtgtcactgtggtggtggtgctttgggagatgcacagcccacgcacccctgggtgtcagccctgccgcatacaggccgtccccatgccccctctggagttgccgacccggcgcatcccttccaggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcggtgcgtgtgggtggccaggcgggagtggggtccccgggcctccccagcccttcctccttgttgtctggaccgtgtcccggcaggcataccgcccttcgtcacgggtgccattctgagcgttcccaccccgactcccacctgacgtagcaccgtggggacctgcgtgcgtgtctgtgtgtccttgcgtgggtgccagggctctgcacccagaccagcctggcatctgcccctgtcttcacagagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgaggtactcccgggccctcctctggaagcggtggtcagtgctggccatcacggggcccgtggctgccgcctgcacatgctgagtgcccggcactgccattgcagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccaggtgagagccaggctggtcctagaggcctacggcaaacgtctgggctccccacctgtgccctggctttgggggaccgtcgcttaggaggccccgccccttccatctgctcagcagtccctccttcctctcagagctaccgggcaaagctgaccccaggctgtgaggctgaggctgagacggaggccatatgcttcttcgtgcagcagttcacggacatggagcacaacagggtgggtcctggacacccctgaggccgcaggacccagagtactgggcaggaacggaagggggaagggaaggatgggatgggacgcgaagagcgttaaaggccccccaacttcacccctttaatagccgatcccggccggatgcggttgctcatgcctgtaatcccggcactttgggaggctaaggcgggcagattacctgaggtcgggagttcgagaccagcctgaccaacgtggagaaaccccttctctactaaaaatacaaaaattagccaggcatggtggcactcacctatagtcccacctactcgggaggagaatcgcttgaaccgggtaggtggaggttgcggagggaggagaatcgcttgaaccgggtaggtggaggttgcggtgagctgagatcgccccactccatctagcctgggtaacaaaaatgaaactcgtctcaaaaaaaaaaagcccacccgcagtgtagcacagggcaggccggtgctgtgggtgctgccagcacctgctcagagcccgaccccacaggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtgcgcaaggggcctgacgggaacggggacagggacaggagtggggtgggacggcagctgatcgcatcccctgcaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaccaccgtcctttcttccctcctccctgacctggcagctgcaagctctccagctccaccccacccagtcacggggccgtgaaggggatgccctctgtcctctggtccccagttcccacacacccctaggccatgtcccagagccggggctgggccggggagtgaggaaggagcccgcgtggcagccccgggcttcccgggaaagcgctgggactggcgggggggggggtaccgaggctctggccaagaaacaccaccagtgagaaacgtgtaggaggtacagacactgggaagttggcttcagctgaggagaggcccctcgtggagaatagtatttgcttgaagtcagtggattgcaggcattcgccctgccaaagatgccgtcacagcctcaccaagacggtgtcaatagcgccactggctggccaggttgacccagaagacttgggtttaggcaaagga

SEQ ID NO: 21344 - DNA, 1028 bp, Homo sapiens
ggctgccctgagagaagggggctttctgctcctgcacacactgctccgggggcaccccctcggggacatcgtggccttcctcacctccactgagccgcagtatggccagggcatcctgagccaggtgcggccgccgggcagggggacagggtgggggccgggtgagggccaggcgggcagggtgctgaccaccgcccccacaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaaggtcaggccctgccccacctccaggccccaccccacctcccaacttgccgagtgtggcctgaccctccccgacccgctgtagggcatcctggctgacgaagactcttcccggcctgtgtggctgaaggccatcaactgtgccacctcgggcgtggtgggcttggtgaactgtctccgccgagagcccggcgggaaccgcctccggtaggagcacggcccctcaccacttccccttccccaccagcctccccatccccagcctgagctccccgcctctgcccccaggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggagggtgagcccccgacactgccctgcccctcccgggagactgcacccgaaggccccgcagcagccccacctccctgtttccctagacaagcctgaggagccgacggcacatgcctttgtgagcaccctcacccggggggacctgtcctccatccgctgggtctgctcctcgctgcgccatgcccagcccacctgccctggcgcccagctctgcacggtctacta

SEQ ID NO: 21345 - DNA, 1022 bp, Homo sapiens
tgttggcacccatctctgagccccatgggccacatgtgggcaggacctggaaagaaccttggctgcagaggactgagggggccaccatctggggactgggctcccaggagctgcccctggagtggcagctctgtaatgacacctccacccacgggtcaaacacagcagggggcgaacctttctcatgaaggctccaaggctgccattaccacacttgtcattactgcccccagctgcaggcagtgtctgggtgggtgggtggctgggagcggctcggtgtccacgctaagcctctgaggctggctctgccataggcttgtcctgggaggagtgtaaacagcgctgccccccgggcgtggtgcccgcctgccacaactccaaggacacagtcaccatctcgggacctcaggtgggtgctgcggcctgggcgggctcctctgtcccctgcgcctgccattgcaagtctggcagggacacgcggccacggtctacgccccaccaagctctgacgggcctggggcatggggcaggtttgtcctcaggtcccttgcccattccctctcggttcccttggggtgaggtgggtgcgccctacctctccgagcctgaggtgggtgcccagccaggatgcttatccaggctcccacgatgtccaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtggactaatacggcctggggggtgcggggcgggccaggggacccacaacccagcactgacctggcccctcatgcaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacg

SEQ ID NO: 21346 - DNA, 2146 bp, Homo sapiens
ccaggagccgctgctcatcggctccaccaagtccaacatggggcacccggagccagcctcggggctggcagccctggccaaggtaggtggggctgggcttgggggtccctcaggctcctgctccctgggactgggttgcgccatggctgggcactgctgctttctctttgccaagtggaggcgggggcttccccaccaggagcctctgtcccccgggctatgctgcaggtctgagcagaggcactgaggctgacagcagggagagctcgtagccaggctcgctgggccttccctggaggcctgatgccctgcagagcgtctgccggacacggagccgagctggaggagccgcttgggtgggaagagcgaggcaggagcaggcctgggggggtccacggcaccatcagggtctcccgtgtcgcccacccgtccctacagcttcctgacccactagcagaggcctggggacctttagagagaccaggcacaggagccccaacacccatgatcactcacgccctctgccccccaacttctgcagcctctgagatgcaacatctgggccaagggggccttagtgttcaggccacagccaggctttggtgggtccacatcaggctgggaggcagcaaggccggaaggggaggtcttggaccaagctgagggcagggccatggcggctcagtcctcggacccctgtgccatggcagaattaggttggggacaggaagtgcatcggagagggccctggaaccctggccccacatgagagtctcggggaggtgcctgcccccagctcaggcagtggtagagggagtggggcggctgcccatccaccacgtacccccgcaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctggtgagcccacactctgcccccaaggtggtcccttccctggggaaaggcaggcgaactggagctggtggtcccctgaggtgctctctgggacggggatgggcacacagtggcacgggatggggctgagcctcgtgacgtgctctctgggacagggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccaggtagggcccagcctgccagcgtgtgagcaacgccagccccagggctctggctttccctggagcccaggagctgcagtgttgagtccggggcccctgacagcccctttgctaggcagagccttgtgctgggggcaggacgggaggggaggaggggtctcagtggggctgtgtgggggccataggggcttctttcctatcaggagacctgggagggtcgatggggcgcgggggtggagatggcctagtggggccgggggccgcccccaacagctgcacctgctggaggttgcaacctgagtgtcctgttcccaccccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggc

SEQ ID NO: 21347 - DNA, 1976 bp, Homo sapiens
gtcctcagttccaccatggcccctccaggggcctgcagcaccccacagggcccccacctctgggcagcttccgtcagagatttaaacacccgcctgtcccacagggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggtgggtcgggcattcgcgactgctgcgccgagggctcctgctgctcacgtggaataggcagtgttttctcttcttggttctggtagaaccaggtgctggcaccacctaccctccccggctgtgcccctggcctggccaacgggctcagggaggtgtgggccacggggtaggccgcagtttcccaactgcaccccagaggtgtcgcgggtgtgccctgacctgagcgtaccagtctcctcgcttctgatgtctggctggtgctggggccggggccggggctggagtgacgagaggcaaagcaggaggttcttgaggggccctccaggcccccacccccaccagccaagcagcggacagcaccggccctgctgtctctcccctcccaccctccccactacccttgcccacgtccccccaccccaggcatttcaaccctctcccgccagcctggccctcgctctgactggcatttgacctcggacaagcgccacgccgtttttttatttttatttttatttatttatttatttttaagacggagtctcactctgtcaccaggttggagtgcagtggcgcgatctcagctcactgcaagctctgcctcctgggttcacaccattctcctgcctcagtctcctgagtggccgggactacaggcgcccaccaccacgcccggctaatttttgtatttttagtagagatggggtttcaccatgtttgccaggatggtctcgatctcttgacctcgtgatccatccatctcagcttcccaaagtgctgggattacaggcatgagccaccacgcccagccatgccatttcttaagatccaggtgctccctccccgggcggagaaggacctcctgagggggaggctgagccctgggctgcccttgggtgtgagcggttcacacacccacccaccctagggcagagccagcccaccaggggcgaggaggggccctgctggccgagaggtggaagcccttctcctgcgcccttcctgctgccagaccccaccccaagactaaggttatgctccccgggggtgaccggtgtccctctctccttcccgagcctggacacttggcctttgtctcctcggttccttatcacggcctgttctggtgcaggctgcccttggcgctggagaggccactggccgacgggctcatcagagctgccggtgacaccaggggccaaaggcgtcgcctggggacaatgctgccctctgtccttcctggagccactctggccgtgcctggtgccctcccctgggcccgcctgccccctccgcctcgttccctctgtgacctggttcctgttccaggcctcacctgggctggctgctggccacaggctctgttctggcccctctgcaggacacctcaccctccttaggccccttccagggtcccactgggatggaccccccctcaccccaagccagtgaggccaagatgggaccttcgccccagagccgggtgggtgggtgggctggctgcgctgtggggcccggccgtggcaccttgaccactgtttgtggcaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttca

SEQ ID NO: 21348 - DNA, 1034 bp, Homo sapiens
ccaccatgcccagataatgtttgtattattaatagaaacagggtttctccatgttggtcaggctggtctccaactcctgacctcaggtgatccgcccgcctcggcctcccaaagtactgggattacaggcgcgagccaccgtgcccggcataaataattcattttatgattttctctataaccaaaaattattcagtagtaggttttacaattttgaagcagaagcaggatgagaggttttgatgttggtttcaaattttattgtgttacatttgaaatgaattgagacttgctctgtggcctggtatgatgagattctaggcatggtctgtttgccgaaagagaaagtgaatcatctacctgtaaggttagacctcctgtgcctcatgactcaagccaaccagtccccgttgatgaatgagtttttgccaggaggacatgggtttgtttgtttttgaggaacatgggtgagttaacagcttcatctactctcagttacctctttcctgcagctctgtccgtcagtacttgacatgttttgaagttgtacctttttatttatttttttcttttttctgcatctgaagtcttaccttttaaaatacagagttctggccaggtatggcagctcacgcctgtaatctcagcattttggaggccgaggagggtggatcacttgaggtcaggagttcaagaccagcctggccaacatggtgaaatcccatctctacaaaaaatacaaaaattatctggccgtggtggcaggcacctgtaatccctgctactcgggaggctgaggcagtagaattgcttgaacccgggaggtggacattgcagtgagctgagatcacaccattgcactccagcctgggtgacagagtgagactctgtctcaaaaaaaaaaaaaacagacttctttgcctcttatgacgttttctgcctaattctattttattttttaatttttactttttctgtctttttaactggatcttttattgttggatcttttgtttttttcattttttattttt

SEQ ID NO: 21349 - DNA, 1036 bp, Homo sapiens
gggctggcctttaataggacagaggcagaggtgggcaccgaagccagaaggttgattgcagccagtgctgtgcacttgcccagcctgcaagctgacaagcaagcctggcgggagacaggaggctcctgggtcagagaccaagggctctgtccacatagcaggcagctgggcaggcagtggctgcaggtgcagtgggtatgcatctcagctgaggaacccaggcctggggaccgagtcctagagcgaccacaagcacctgccctccgagtcctagagcaaccacgagcacctgccctccgagtcctagagcgccacaagcacctgccctgggcctgagggagatgcttgctccgacttctgagctgcttgctggacagacgcccttgcaaagggtctgcagcagtggccagggcagcctccaccgtgcgggagtgcacaggccccagggaggctgtccctggtcccagcagctggcctggtggtgggaaacggttctggcagattcctttcatttcctcttacatgctcagcatccaggctgagagcccgaggccggccacaggctctgaaggaggaaggagcggtgtaggaggcttgagaaagtgggttgtaaaatggtgggttggcgcctcaggaagcagatccgggagagagtgaagagggccaccaagctctctgtgagaccagggagctggtgaccacaggagtcacctggggccgaggccgtgctgcaggaaggagcgttcctgacacagcagcacacgtccaccgaggctgagagtgtgggtggcctgggagggaaggcgggctggtgtggatcagttaagatgcttttagctacaagtcacaggacaggatatgaaagtgacgtgaaccagagcttcccggcctttatctcctcgtggtaactgtggaaaatgacacgcctcactaaaataaggagagaactgaggggtccatatcctgagtgcccaaaatggtctcagcaggcggcatgcacggccccatggcaggacgcgctgactgaggcccagga

SEQ ID NO: 21350 - DNA, 1056 bp, Homo sapiens
ctgcactttgcagatagggcctgttctgttcctggttcactctccctcctctcttccaggaacggaacaaggtcagggaagcacttgctgccagcccatgttcctactcctgaaacaaggaattaggtcctaccctcagggtgtacccttgccttagagaaatgccctctgctctttctggggtctgtaacgaggcatctgtatgtctttgacacagcccttgccgagttcctgcagcctttggtagcccccgccaccaccaccaattctagctcttagttttaatgaaaatgaagtttgcatttttgcttttcattatctttttttttttttttttttttttgcttttggatgatttacaaggatagtggaggagtgctagcttcatgatgccttcttcaagtctgaaatctgtcttgttttctgaccaatgcagccaaagaaatgcatattcctccaagcgttgctttgctttaaccatgtctcataaatctcaacatcctcatgtttcccttgtctttcccttgtaggacttataactcaactcattttgctttaacttaaatggaatttttccttaagtttctagatttgtggaattttatttttttgtctgttactgatttctaatatttttacattctggtcagagaattaaattactatgatgttaactcttctgagagggaaatattagttcttaaactacaattatcaatctatctgtttttgtcaattgttgctttatgtgttttgaggttcgctgttaggtgcatacatgtttaggttttttgccttcttgatcttttcctccctttaccagtatgtaacatccctcataacccctcatgttgtatttcaccaaaaaacctattttgtctgacatgaaaattgctataggccgggcggtggctcactcctgtaattgcagcatttggggaggctaaagtgggaggatcgcttgaactcagaggttccacaccagcctggacaatgtagtgagacatcatctcaaaaaaaaaaaaaaaaaaagggccgggcacactggttcatgcc

SEQ ID NO: 21351 - DNA, 1213 bp, Homo sapiens
gcgtagaagaaactgatgctttacttgagggcccatctcgggatgtccacagggcagagctaatcctgcgatgctcctcagatgttgatcataagcaatatgttcatcatggctaacttcaagttaattgataaaaaagctttaaaatttttctgttttgaccaggcacatggctcacacctgtattcccagcactttgggaggccaaggcgggcagatcacctgaggtcgggaattcgagaccagcctgaccaacatggagaaaccccgtctctactaaaaatacaaaattagccgggcgtggtggcgcatgcctgtaatcccagctacttgggaggctgaggcaggagaattgcttgaacccaggaggtggatgttctgggggtgtcgagatcgcgccactgcactccagcctgggggacaagagcgaaactccatctcaaaaaaaaaaatgtctgtttcaatttccaatatgtgaaatgtcaacagttataaacaccctccaaaaaccttgttggaatcctcagtgagtttaacgaaactgatttgtaatcctgggaaatgttatttcagtaattatgtcttctgatgtgtctgcttagagaaggagcagatctttacataacataacatgaatggaattgatgaaaggatctcgtttgatgtggggtcatttctaagtaagctagcatgccgaagctttgagtagaaccatcatttttaagttgttatacttaagcttttgcttcttttgtttgtttgtttgcttgctttttgagatggagttacccaggatggagtgcagtggcatgatctcggctcgctgcaacctctgcctcccgggttcaagcaattcttctgcctcagcctcccgagtagctgggattacaggtgcccaccaccacgcccagctaatttttgtatttttagtagagacggagtttcaccatgttggccaggctgatctcgaactcctggcctcaagtgagcaacctgcctcagcctcccaaagtgctgggattacagacgtgagcctccgcacctggcaagtttttgcttcttctttgtgcctgccacagaaagggcgtctgggtgcttctgttagcgaatgtgcttgctgcccccgctgtgaggacagcaagggctgtgtgtggcaggggcgtggcattgtgtgtgcaagagctctaccgaaatgctgtgtgtcacagttcac

SEQ ID NO: 21352 - DNA, 1092 bp, Homo sapiens
tctcagactcagcagggctcgttcagggagagccatctcagacgttgggaacatggattttttatcatgttcagatagtatccttgtctctggaaagaaggaaacgtgacgttttaacgtggcagctttggttactaggggaaacttgggcagcacacatccggtgtggttctgggtagtccgatcctgtgtgggctctgggatgctggcactggctgtcgggaagctctgttctactgccggcatctcagccttttagttactaagctagggtcttacgtgcttgtcagtttcatggtttcctttgctctgatttcttgtcttgttttggaagatcttggtgtttgttattgtcagaggtagaattgactcaatggagataaggatttttctttttcttttcttttttttttctgtagcgacagggcctcactgtgttgcccaggctggtcttgaattcctgggctcaagcgatcctcccgcctcggcctcccagagtgctgttaccagtgtcgctgaccccagcttctctcctggacagtgtgtgtggtccttctctgttaaacactgtgtcctgctcacctctggatcccacctcccaggacgtgggtgggggtctttgctgggttcccactgttctttcatcatgaaacctgtttgttccaggaactgctgctggagtttgaatcgaaaatgcggaagagggagcacgaattccgtctgcaggctgacaacatgagcaacacagccttgtcccgggagcttaaggtaactgggggcacccttgggtcgtgaaggtttttcggtttttccttggtcaggtgtggtggctcacacctgtcatctcagcactttgggagaccaaggcaagaggatcccttgggcccaggagttcaagcccagcgagcaggtgggccatgtggatgccctgtgccccatggcagggtgggcactcccgtcaaaggtgggcaccgggtgccagttcacctccgcctgcatctgctgtgtgatttggtcacagccctggacacctgcccgtggtgggcatcacggtgcacagatcagtaggaaaagcaagagctgagtctcgac

SEQ ID NO: 21353 - DNA, 1031 bp, Homo sapiens
aaaaaacctgcagtggtttagtatctagaagttataaagaactactatgaataggaaaaagataccatgatagaaaaacttagccaaaaaaaaaaatacatgccttcagaggagaggcgatacatgtggccagtaaaatgagctgggcatggtggcgcccacctgtagtcctacctactcaggaggctgaggcaggagaattgcttgaatccaggaggcggaggttgccgtgagccgagatggtgccactgcactccagcctgggtgacagcgagacctcgtctcaaaacaataaaataatgaaacaattttttaaatgaattgaatttccctagtggtaccaaaacttgctttaagactaaactaaaaatctgtcttgccatggaaggacataaaaggtttatccaggccgttcacaagccgtatgtgtgtagagccatgtgtatagttgcggatccagtgctgtgaaaacataccgaagagacatgttcttgtggatatgagaaaaaaaaataggaccaaaggacgtattttgggggtggcattttgagaaacccacctgttgctgcagcatttgaatttgactgtggcgtgaggctgcggtgcacattcctgtgcatgtttttaccagcatgtgttttccatctctctgagaatcttcttgtggtcgttgacttttcatacgtaacgtcttgggtgaagtgtccaggtctttcacccattttttctaaaatggatttttttttttttttttgacagggtcttgctctgtggcccaggctggagcacagtggtgccatcacggctcactgcagcctccatttcctgggctcaagtgatcctcttgcctcagcctcccaagtagctgggaccacagaagcgtgccaccacacccacctaatttccagaattttttgtagagacaagggtctccctttgttatccaggctggtctcgaacttctgagctcaagcagtcctcccgtttcagcctcccaaagtgctaggattacaggcatgagccactgcacc

SEQ ID NO: 21354 - DNA, 1035 bp, Homo sapiens
caggaggtaaggccgcagacgctgacgtactgggatgccccaagcccgggaactggcagcccagtgagggggtctcacctgtgtcccctgagcctggcctgtcactctgtccacgcctcagctacctgtcccctcctgcaaagggcaccgcctgtcgcgaggaactcacctggcttcctcgacatctcgggggacacacgaaaagcccccgcgagagcagcaggagcctgcacgtggaaggggctggcggcccgaggtcccggggtaacaggagggcagaggggctgggcacggcgcagggtcgggaggaggcctggagcgctcgccccgcccggccccgcccctggagcgccgcggccccgccccgccgggttgctaggggaagtgacgtcacagcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtgaggccccgccgcccccgcccgccgcccgaagacccgggccctgcggctgccaagaccaagcgcgatcgcggaaggaagtggtggcccccgcggggtctccgcgcaagtcccggcaccgccggatcgtggccagaacccaacggccactaggctagcgcggccaggggtggggagggcagtggggagcggacgtgggggaggggcaggaccaggtcgggggagcagggtctggagaggggagggtt

SEQ ID NO: 21355 - DNA, 1050 bp, Homo sapiens
ctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttcattcttggctacttacactattcatgataatcacagagatacttggacaaagaaatatatttgggcaaaagcaagaatttccttctttttttttttgagacggagtctaactctgtcgcccaggctggagtgcagtggcgcaatctcggctcactgcaaggtccacctcctgggttcccaccattctcctgcctcaacctcccgagtagctgggactacaggcgcccgccaccatgcccggctaattttttttgtatttttagtagagatgggatttcaccgtgttagccagaatgaagaatttccttctgaagtgggaacatatggctcatgctggtaatcccagcactttgggaggccaaggtaggaagatcacttgagcccaggagttggagacccatctgtgcaacatagtgagacgctgtctgtacaagaaacttttaaaaaatgtagctgggcgtggcagtgtgctcctgtggtcccagctactcggagctgaggcaggacgactgcttgagcccaggaggtcgaggctacagtgagctgtgacggctccactgcattccagcctgggagacagcaagatactgt

SEQ ID NO: 21356 - DNA, 1590 bp, Homo sapiens
gctgggttcagtggctcatgcccgtaatcccagcactttgggaggccaaggtgggtggatcacctgagatcaagagtttgagaccaacctgaccaacaaggtgaaaccctgtctctactaaaaatacaaaattagctgggtgtggtggtgggtgcctgtagccccagctactcgggaggctgaggcaggagaattgcttgaacctgggaggcggagattgcagtgagccgagatcgcatcactgcactccagcctgggtgatggagcaagactctgtctcaaaaaataaataaacaaaaaataagagagagaagcagcacctgccctggtcgcatgctgagagcccattctgccccctcctcccggctctgccctcaggtgacctacggctccttcgactacacctcgctgctgtacctctccaactacctggaggacttcggcggagggcggttcatgttcatggaggagggtgccaacaagacggtggagccgagagctggtaggaggcgcgggcggggcctgggcgtggggctcctggctcaggcaagcacggtgggtgtggggggcgtgtccctgggagcgaggctgagttcacggagcatctgctgtgtgccgggccggtgctgagtgattcccaggtctagcgccagtcccaacacccaggaggctggtgtctacggggccacatgtctgaggtcaccgtcagtcagcggcagagcccccctccacgccctggtgtgtgtcaccttgacaggcaccatccatttccctccctggtgtgtgtcaccttggcggtcagggtctccctccctcccctctggagtgcgttcacctctgtacccttctcaaagagactcgcaacctaagattagacgaggccccagcccagtgtcggtgacctagtgccctcctcgctggtggctggaacctcaccgggtggctctgcggtgccggcttcagaacccatcacactggaccttgcagtcccagagtcccagagccccagccatgcccagcctgctgcagacacagcagtgccagtgagcatttgccgagcggacagtcatcctctgctccttgaacttgtgggtaacacaagcccagatcctggggtgggagggtgtggggagtggggaacccctgttaggggcctcctcaggtggagcccacggccctgaccccagatgcagccgaaactcgcataggcttgggagccctgtggactgtgccagcaccatccaccccccactgcctcacccatccccagggcactgccctcacccccccccccccgctgcctcacccgtccccagggcactgccctcaccccccactaccttacccgtccccaggacactgccctcaccccctgctgcctcacccgtccccagggcactgccctcacctgtggggtggcctctcagcacgggtgttcctcctgcctggccgctcagtcagaccagggactgtgtgacagtcaggacttctttcatctcttttaagatctccagcttgtttattttgagattcctgttatttgtacttgcctttctcaggttagtttacgacttcagtttgcaagctcag

SEQ ID NO: 21357 - DNA, 1069 bp, Homo sapiens
tatcagcttgtctttcttcaagaaccctttctgagaggttagctgtgatcacactgactgtagatgagttagatagtaatagccaatcttccagcccacgatcacaagaccagctctctctcagatcttctgtggtcttcctttgcaagatgttacagtccatggataggtcttgtacatctgttaacttattcctccgttttttaatatttttacgctgttgctgatggagcagcttttaaattttataattttgcattgcattttcggtggcgtgtaccctgacggacggacagttggtaaagtcgttaattttgcattgcattttcggtagcgcgtaccatgatggatggacagttggtaaagttgttcagcagatgtcttgattatgaggaggtctcatgcgaggtagctttgcttagccctctcatactctttatttacaatgaaaaatctttaaattgaatttgtggttctgatatttataaatgatatacatctattttttcggagaactttgggggcagaaagtggactttggctgtgagaaatcaaaggcagttcttgattggtgtcctctgtctccacgcaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagtaagtgtgccactcaccttgttggtgttgtgcctcctggagcagcaggctcagcaaaatggccattccctgtatcaagactcaaaaggcagtgggcctgccccaacctggagcccctcaggggcctgtggacctggctggtcatgtcatcagacaggttgaagtcttcacaggtcgtcttgtgcccagggactggttttatttctaattatttacaaagcagtgtcttgtaaaatatgataagccaaagaaacagggccaggggcagtggctaaacctgtaatcc

SEQ ID NO: 21358 - DNA, 1076 bp, Homo sapiens
cgctgggattacaggtgtgagccatcacacccagctgtgttttttgtgtgtttttttgagacagggtctccctctgttgcccagcttggagtgcagtggggtgatcatagctcactgcagcctcagactcctggactctacctgagtagctgtgactaatttttaataactttttttttcagaaatgggagtctcactatgttgcccaggctggtcttgaactcttggcctcaagcgatctcacaccccagcctcccaaagtgctgggattacaggcgtgagccaccgcacccatccctcctgtggttcttcaaaagcacggtgctggttggcattctcatccctaaagcttgtcggtacattagcccttagaacacaaactgctaatttatgctaatagaatgttgcaatgttagcaggcaaacaagacagaagaaattttgaacttaaaaaggagcaggggctgggtgcagtggctcacacgtgcagtcctagcactttgggaagttgaggtgggcagatcacttcagcccagaagttcgagaccagcctggacaacatggtaaaaccccatctctaccaaaaatacaaaacttagctgggcatggtagtgcatgcctgtagtcccagccatttgggaagctgacgtgggagaatctcttgagcctgggaggtcaaggctgtagtgagccaagattgcgccaccgcactccagcctgggcgagagaatgagaccctgtctcaaaaagaaaaacagaaaaagaggaagaacaacccaggaccttgagtggagtgaggaacttgttggccctgatttgtgtccctctgatttcactttaaaactgaaacctcccttcctgatgcaggtttatttgcagcacttttaacatcagtacctatggtcaggcttgcctatgggctcagtcgggtggaatcaaggaaggtcagggagaggaacgtaaccaggcaagggcaagggttggcagagagagatgaacgcgctcagcgcgcctgtgtgcgaggccagtgggtcgcctgagaccgggaccgggctgtgcgcactgagagaggaacgg

SEQ ID NO: 21359 - DNA, 1021 bp, Homo sapiens
cccagtgccaggcgggaggaggcctgagaaaagccatctggttctggtgacattgaaggccaccggtggtctcagaggatgactgagtgggagcccagtggtgggtgggtagggtgggaggaggtgaggagggaaggagaggctcagtgagggaggcagttcagaatcaagaccaggatggggctctgggggcgccgcatgccaaatgggaagtgagtgggtgaactaggatctgggtgatatcacgtacttaggaatagaatagcccaggtcagatcaggcacaaaaggattgtgtggaaaggcagaaggttccagatgactcgtgacaagctttggggcccagctcacagttctcagcagagccccgtgaactgcgtgaacgtgaatgtgcggaagagagaccacactcgggtgaggactggccctgcctgatacatttatttttgttttggaattaggaacagagaaatgaaatgggaagagattatcggtaggaaaaacagtggaagacagggcttgagatcttggcctttgagcggttctgtaatctcacaaggtttgtctgtgccagctttaaagcagagttgagagtggctgctagcatagcccagaggggcagaggcctgtggcttgtgagtcctctggaggagcccacccagaagggacagcggaggttccacagagagagcagggcaggatttgcaggagaatgactttgccctggctaattggggatgggcagaaatcctgctggtgaattggtctgtgtcttgtcatggagaacttcattgaccattaaggaggaaaggaagcttatagatggaagtcaggaggcctagagggccgcctcccttgccctacctctggcactgctgggggaccccaggtgctaacaagggagccatttgtatgagataatctcaggtctcattctcattataaagtttctaagaggtgaaaaagccttagaaacttcacagacttagaagaaagcagtattcagcaggtttttgagtaaa

SEQ ID NO: 21360 - DNA, 1032 bp, Homo sapiens
caggtgtgagttattgattagagttgacgggaagcgggtaggctgtttacagtaactaggggcaaggaagaacaagaaagtcgagttcgagaacaaaggataaggaagttaacaggctaaataaaccctttgaagagaaactcagaaagatttattgtatcttacatttttctgtaacaacgaatatcctttgtaatatttcagtaccagcccttgggatctggaacatagaaagctctgaatgtaaccctggtctttctgtggggagaccctttccccctcttcagctgcaggaggtgggggtcaggtattatgggagaatctctttggcggggtttagaagtcctctctaattcctgaagtttggctcttacctttgattacttctcattccaggaaaggccttaactctccttctctgcctcttcacttgattctgaaaaatctgtttttcttttttttctttccatttttaaaacccagagaccgcatagctaactgtgcctgtgactgactgtgtttgtcttctttttttttttttttttttgagacggagtcttgctctgtcacccaggctggagtgcagtggcgtgatctcggctcactgcaacctccacctgccgggttcaagtgattctcctgcctcagcctcccgagtagctgggactacacagctggctgatttttgtatttttattttttatttatgtatttatttgagagacgaagtttcactcttgttgcccaggctagagtgcagtgacgcgatctcggctcaccgcaccctctgcctcccgggttcaagtgattctcctgccccaacttctcgagtagctgggattataggcatgcgccaccacacctggcaagttttgtatttttagtagagacgggggttttccatgttggtcgcgctggtcttgaactcccgacctgagggatccacctgcctcggcctggcctcccagagtgctgagattataggtgtcagcccctgcacccagccaacatttctttacttaaccattagct

SEQ ID NO: 21361 - DNA, 1071 bp, Homo sapiens
gatctcaggtgatccacctgccttggcctcccaaagtgctgggattacaggcacatgccaccatgcctggctaatttttgtatttttagtggagggtaggtttcaccatgttggccagggtggtctcgaactcctgacctcaggtgatccgcccacctcggtctcccaaagtgctgggattgcaggcgtgagctgctgcgtccggcctcaaatgggagttttagaggcctttgtgttgggctttcacaccacttgtgcagtcattggaaagatccagactttgcaacatttcatgtgaaaaataattgaggggtttgtttttttctctttccagccacagcttcatagagccaacagttggacatggcatttaaggagatggatgtagtccctgggtcacacacgagcattaacacacgatcatctacgcacttaagtgctttattcagtttctaacagtgctgtttatttggaccattaacagcctgctgtgtgacttggaggcagtgaccaggatgagtgacctgggtaactcattgagactctgacaggattttaaggagttaggatgatttataggtgggagcaaagtcacgggagaccaccctgtaaatgggaaagagcatcctttcctcaccttcccggttcctggagtctaggactacctcttgtctccccagcaccctgcccttcccttcacctggtgtccacagtgggcgggattgcctgcttggtggctttcctctagaagtgtccttcacgtttgtcactgatcgtcctccaagcctgggccatggggatgccacagaaggcccctgcagtggggaagttgtgtgaacaactccaagactcctttgctaaaggacaaacaaaatgccctgcatggatgtgcttgtcacttagtaacatttgtacaaggacaggagttgtgacttagcacctatcgtgtctgtgtggtttgagcatctgcaagagttctcagtagttgtcatttctccagacctctttcttttaaccactccaggcctggggattaatgtctcttttacacttctgctttaggatgctttg

SEQ ID NO: 21362 - DNA, 1048 bp, Homo sapiens
gtggtcagcctggccacgaagatccctacagcaaggcccacaaggtgtgcagtttcagagaagcgcctccatgcccaccaggaggaaaaccaggttgcattcagagggtcaagaatgagtttacggccgatctcaaaaggaactctggaatgactgaacgtgtttaagggaaaagcatcttctccctcaattgtatgcctgtccaaacacaaggaagagtgagggcagcctaaagacattttcagacgtgcaaagtctcagatactaccttcttccatgcacctttctcaggaattgaaaagaggagtcagcttaagagagggaaggatggaatccagcagtaagggagtgggggccccagggcaacagtcctcccagtccagatgggagcaggacagaaggtctggaaagatgccccaaagaaagtgaaattcctgaatgtttgcaggtaccgagagcagatttagatagttggggaaaattacagtgatgaattagtaataaatgcagagaaaactgaacaagtaaacaatgagtaaacaacaagtaaacatgaggcaattttttttttgagacaagagtctcactccatcacccaggctggagtgcagttgcacgatctcagctcactgcaacctccgcctgccgggttcaagcgattctcctgcctcagcctcccaagtatctgggactacaggcgcccaccaccatgcctggctagtttttgtatttttagtagagatgaggtttcaccatgttggtcaggctgctctcaaactcctgacctcagatgatccacctgccttgacctcccaaagtgctgggattacaggcatgaaccatcacgcctggtacaatgaggcaatttttaactccagtagaaacaaaaattcgtacatgaaggaaaaataaacattgtataccatatggtggttcagctgtggatggcgtctacctggtgtcattttctgttgctgtaacagaataccacaaactgggtaatttataaagaaaataaatgcatttcttacagttctggaggctggga

SEQ ID NO: 21363 - DNA, 1034 bp, Homo sapiens
ctgagcacccttcgccccagcactggatgggagggtcttccatgcccctgagctctgagcatccttccccccagcactggacgggaggaacgtggaggaaggtggggggctccagagctgctgagtgaagtggcttttggatgggctgctgtgactaatggaaaagagctgctgagtgaaggggcttttggacaaattgaaacagagatttattctctcacagttctagagaccagaagcccagaatgaaggtgttgcctgggccacgctcccttggcaggctctaagcggggacccttcctgactcccctgacttctggggtgctgctggcagccctcggcgttctgtggcctgtggcagcaccgttccagtccctgctgtctgtcgtcacacagccttctctcctgggtgtctgtgtccccaaatctctctgtgcttataagaacactagccattggatttagggcccacctaactcagtatgacctcatcttaacttgattacatctgaaaagacccttggccgggcgcggtggctcatgcctataatcccatcactttgggaggccgaggcaggtggatcacttgaggtcaggagttcgagaccagcctggccaacatggggaaatcccatctctactaaaaatacaaaaattagctgggcgtggtggcaggtgcctgttatctcagctgcttaggaggctgaggcaggagaatcacttgaaccccggaagcggaggtttcagtgagctgagatcgtgccactgcactccagcctccagcctggatgacagagtgagactttgtctcaaaaaaaaaaaaaaaaaagaaggctgggtgcggtggctcacgcctgtaatcccagcactttgggaggccaaggcgggcagatcacgagttcagcagtttgagaccagcctggccaacatggtgaaaccccgtctctactaaaaatacaaaaattagctgggtgtggtggcgggcacctgtaatcccagctacttgggaggctgaggtaggagaatcgtttgaa

SEQ ID NO: 21364 - DNA, 1121 bp, Homo sapiens
ttatggatgtgcaaagaaagtaatttcttgagatagactctactcctagtgaagaagctgtgaatgttgttgaaatgacaataaaggatttaaaatattacgtaggcttacttgataaagcagcagcaggatttgagaggtttgactccagtttcgaaagaagtcctactgtggataaaatgctattaaacagcaccgcaagctacagagaactctttcatgaaaggaagtcagtcagcgtggcaggtttcattgttgtctcattttaagcaattacccagccttcaggaaccagtgccgtgatcagtcagtagtcatcaacttggaaacaagaccccccacctgcaagaagatcattaactgaaggcttagatgattgtcagcttttttttttaagcaataaattattttaaaattaaggtatgtgcattcctttttagacataatgctgttgcatacttcacagactgatataaacatgatgtttgtatgcactgggggaaaatttttgtgtgacttgctttattgcgatatttgctttctcatgctctggaacccaaactgtaatatcttcaaggtatccctgtgttttaatctatgtaatactcttttgttggatagaagataattttatctaagtcagttgatcacattttttagtgatttgtactatgttgtaagaaatcttcgcctgtgccaagtttacaagattttttttttctgttttcttgtaaagcttgataagttttagctgttacatttagatatattgtctgtctttttttttttttttctttgagacggagtctcaccctgttgcccaggctggagtgcagtggcacgatctcggctcactgcaagctccacctcctggttcacgccattctcctgcctcagcctcccgagtagctgggactacaggtgcctgccaccacacccggctattttttttgtattttttttagtagagacggggtttcaccatgttagccaggatggtctctatctcctgacctcgtgatcagcccgccttggcctcccaaagtgctgggattacaggcttgagccaccatgcccggcctatattgtctgtttttttgagacggagttccgttcttgtt

SEQ ID NO: 21365 - DNA, 1061 bp, Homo sapiens
gccagccagaaatcttgaagtcgtttttaagaagtgtggacttcgtgttgtgggcgaagagaaaccattggaagattttaagcagagtactgacattcaaattatcctctgaattctaggtagctaagattattattttattcttcaacagtttttattttaattttgcttaaaaaattgcctggtgaatcttactgtgtcttttatatatatcccaaaatattgctttattttaccctttcctcttatccttggatgataatattgcttggagcaagagtctaggtcaaagccatttttcctcagtgattggtagttatttgtccactatttttgtgtgtccatgcttactgatgagaggtctgatatcagtcttgatttttattcttttctgttagtagcttttagggttttctcttttttttttttctttcccccagttttccaagaatgtgagactgtgggttttatttatcttataaaagtactcagtgagcacttttagtctgaggactcttgtcgcaaactctaggacatttcttggtcattatttctttaggtactgcttctcctccacctggtttcttatacatattaaaatttctagatctgttttttagtcttctaactttcctccgtgttttaaatttttataatttttatgtgatgtgctctaggaaaatgcctcagttctgtcttacattttactgattcatacgtctactttgtttcactgcttacttatcatgaccttctgttcttttttataactccttattcttaatttttggatctaaatcctgcttttatttttctgaggctctgaagtatttttatttaaaggttttttttttttttccttgttgtttggccttttaactctgttctttttggatgtaagggttgttcttccctcatttgtttaaaggttgtgtgctcatatcatgcaaccatattctcttccttatgtcccagttgcaaattatctgaataggtagtttgctggggtagctttctggctagcacccttgggagtggctgatggagatagccttggctca

SEQ ID NO: 21366 - DNA, 1720 bp, Homo sapiens
ttttggcttcaggtttgatttgtataatacatatctttggggttgactctggggatagccagcgacgggttttatcataatccatgtatcattataaaagagggtcttagtgaatattggtgtaaagaagtgatgtgtgtgaggagaaatagtaatcttaaaggatagaaataactggtttcttcattgcataagagaatataacccccacctaattttggacattttaatactgttaaatctttgggttaggtcaatagggttttacagccatgcctttttttttactctctctctaacagctttattgatatagtgtacatatcataaaatctgcccatttaaagtgtataattcattgttttttagtttatccacagagttgtgcaaatattactaaaatgttaattttagaacattatcattccaaaaagcaacttcataacatctagcagtcacctcctttcccatttctagccctacccatttatctatgtgttatttctctctagatttgcctactctggacttttactctaaatggaattaaataatatgtagtctcttgtgactggtgtctttcacttagtataatgttttcaggattcatccacattatggcatgtatcagtacttcattcttttttattgctaaataagagtgccttgtatggacaagccacatatcatttatccattcatcgttggtggatatttgggttgtttctgcttttcgactattacaaatactcctgacagtcgtgtacaagtcttggtgtggacaaatgctttcatttctctttggtatgcatctaggagtggagttaattactgggtcatatgattactatatttaaccttttgaggaactgccagaattttccaaaggagtcccaccgttttacatttcccccagaagggtatgagggttctgatttctctgtctccttaccagtacttagtattgtatgtctttttgactatagccatccaagaggtatgaagtgttatctcattgttgtcaaccattgatttttgatattataaacaggtttcttttgtgtcatttgcagttagagagattttactctaactttttttcctaaagtagacttacttgttgaaatgaagtttttagtgagaaagtgtgatcatttatatctacttcatttgacagctcatgtatcttagaataacttagaatttcagcagcttctgcagcatcatatatgcggctaatagtattgatgcgatgaaaaatactgttctttacatttttgcttcttgattttttaactttttgttttgaaatacatttaaatttacagaaaagttgtaagaattcaccagttactaacttttagtcgcatttggtttctcatttttccgttatgcatgtaatttttttctgaaccattttagaataaggcgccagacatcctgaatatttcagtatgtatttcctaacaataaggacattcataaccacaagacaattcttaattttcagaatctgggctgggtgcggtggctcatgcttgtaatcccagcattttgggaggctgaggcgggcagatcacttaaggccaggggtttgagaccagcctggccaacatggcgaaaccccgtctctactaaaaatgcaaaaattagccgggtgtgttggtgcatgtctgtaatcccagctactcgggaggctgaggcacgagaatcgcttgaa

SEQ ID NO: 21367 - DNA, 1029 bp, Homo sapiens
gtttgttaaatgtagagtatatgccaaatattttaccaggttttctacatgtactgactgtaattctaacaataacactataacattgattaccactaccaccttttccaaatgatgcccagagggataaataccgtttccactgttacacgggctgtaagaagcagaaaggtgatcatgctggttaagatatgtgcagcagctaaaggctttcccacatctgttaggttaacagaggtttctgtgttatgacttttttcaaatttaacaataattcattggtgctgattggcttttatgcataaaacgtaaagaacaggagtttcttgggctctcttaattttcctctagagtgaatattctgataataaacaggaatgacagctttgttatataaaatacaatataaaattctctgaatctaagcatcatttggggcatagctaaaaaagagcaaacagtatttacactcggaggaatccacaacaacgtaaattatttgatgccttgtaagaattgaacagtatctaaaagtcttcccatattgtcatcaaattgtgtctcagtggtataaacccattgatgtactgtatattgcctcttaggtagtgctagtttttaaaaggcttactggtgtgattctatattgcagaaataaaatttttaaaactaatgtttggtcttctgttatgttctttcttagcgacttcaggaagaaatcaccaaacagtctccaacgttgcaaagaaatgccttgtatatcaaatctgtaagttatgcagtcctttcgaagccaaattccgcttcactgaaatatttccagttaattaattttatccagtcttaatttttaccaccaaataattaaaacttgtatggtattttgatgtaatgggatttctttacattttgtctcctcagtccaagatcagccggctgcctgcttacttgaccattcagatggttcgatttttttataaagagaaggaatctgtgaatgccaaagttcttaaggttagtaatgaactt

SEQ ID NO: 21368 - DNA, 1090 bp, Homo sapiens
cctgcagtgcccttaagcctgtgtggtcactgggtcgcacttggaggactgttggtgtggccagtggagcactgctgtgcctccgatgacttgatactttttttgcagtggaactctgagacgaatcctgcataacattaattcatcttcttgtccctgttatttagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttg

SEQ ID NO: 21369 - DNA, 1047 bp, Homo sapiens
ggaagaggagagcactgaagctggcgcgggaacttggtttcctggtggcctcccatccaatccccacgaaccagctttcctcttaaaccttgaaaagagaaattcgggagttcgagtataagttcttagtcgtcctttcctctttcctttccgacaggagcaccccaggcaaaaaatgtctcgcgggtcattggcgccaggctttcaggggacagtggggcggggcggggtgggcacaggacgttaggcagccgttggccctccctaaggccacaccgtcctgccgtcctggatcctgcgccagctgcgcgggggaggggactcgaaggtgtgtgagccaggggctgaccttgaccgctcagataaatggagcgcagccttgacacaggggtggaggtggttttgaatggggaaacccattcgtggtgaagcagattcactgtagctagcggaaaagccctccggcccacggacccatctagagacgaatacatagcagctgctgtggctgattggcgtgggacagcgtggggagttttgtctgaggagagggatccacttttctgcagctccaagcccaggggcctttgatgagccatagacctcatttttaacccacctttctgcttagacattgagcaagttacttctcatatagcttccctatatgttaaaaatggagaaaataatgcttagtaggcaattctgataaaagcaggtgcttgcaaaaatctctctgttgtctgaatataaactgtaccacaagcgagtgcggatgaacgaggactgcatttaaagataagtttttacactttcatttctctgtggctcgacacttctgatgcctccctttttgttcctgggacacatgcttggtgttgtcttcacacctttgtgacaggattagcactagtgggcagtggatgatagctcctcccttttgccacatgttcatccctgccctcgccaccatctcactgtgtggaattcctgtgtccactggtcaccggggcacagaagtgctgtctcagcctgaatcgggccact

SEQ ID NO: 21370 - DNA, 1076 bp, Homo sapiens
atcattaggaatatcctgtatgccaggtagaagatacattgaacagattgcatgtaggcattaaattcattttggggtattacatatagacaacacatttcattaagaaacataaaactgtcagatcggtggaatacttaaaagcacttggaggtgtttagcctaaaaagcttagttgaggggaatggaagaaaagatctgggagggtggttccaaagaagggatcagactgtcctaaagccctcaggaatctgggctgggaccagcctacttaaagataggatgggcagctgggtgtggtggctcacgcctgtaatcccagcacttcgggaggccgaagtgggcggatcacctgaggtcaggagttcgaggccagcctgaccaacatggagaaacactgtctctactaaaaatacaaaattagctgggtgtagtggcgcatgcctgtaatcccagctactcgggaggctgaggcaggggaatcgcttgaacctgggaggtggagggtgccgtgagccacgatcgcgccattgcactccagcctgggcaacaagagcgaaactctcaaaaaacaaaaaaaaggatgggttccatatgggtggtgtcaagtgcccacctcctagcaagtcagcaggggccagaggcccttgtaagtggtgtctcggggggatcaactgagatggcttaggatttacctggatgcctgctctgctctccccatctcttccagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcaggtgaggagatagaacaatgccttccatttcccgggtgcccttcctagcatgtgtttgctccgttgttttagataaggtctgggggatgagtcaatgtcacaggagctgatgtatagctttgaccttgtgaggggtggtgccaggttaagccacaattaagcctcatgaagg

SEQ ID NO: 21371 - DNA, 1140 bp, Homo sapiens
agggattgtggaattcaagtaaacgtagagctactatgagttacagattgactgtgttcctgtctttaataaatttgccaagagtggttataagaacttacacctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttg

SEQ ID NO: 21372 - DNA, 1040 bp, Homo sapiens
ttgttgttttaaaatctttatcaatttaggaggtgaaaaatagcttgtttatatataaatgtgtgtgtatatgtgtatatgtgtgtatgtatatatatttaaacaatttatgtttttatatggttatttttcttttaacttgcttgtacatggtttttcaggcaagttttatttcacctttgctttttgccatgaatttgaatctttatatattaaacttactgatggttttaatagttggcaacacaacaagcaaaaaaaattgacagctaattttttcttatttacattttttgtttttaaaggtgaattttttacatttattataatatctactcttctgatttttttttgtgttgatttgcaagggtgccattttgcaagtcaaaaatggtcgagtcagagaaattagttcctctctatatggtgcaagcaatttttttctctctctctttttttttttaatttcatgtgctgttttatctgttcagaaatgtgagtttttatctaatttaatgcagtctctccttttgtagcttctgagtttcctgtcctacttagtgctagaattcctaaagctaatactgttcccctgacattgtcttggccatcagcaaggctttaactaaatgaaggcaggcactgggtatatggattttgacccaggagccatgctggtacatacagtaccacccattgtcaagagagtagaattccaatgccatagcccattaataaaaatccaagtttcattggactttatatataacatttatgcattcaatttgtctctccccggtgatgcccatggacatttgataactacttttttggtctcaccatcagatttttttttttttttttttttttttttttgagacgagtctcactctgtcgcctgggctggagtgcagtggcacaatctcggctcactgcaacctccacctcccaggttcaaacagttctctgcctcagcctcccgagtagctgggattataggcacccgccatcacatccggctaattttttgtatttttagt

SEQ ID NO: 21373 - DNA, 1052 bp, Homo sapiens
attttagtataagaaagagaaggccttcttttttaaataattcactcatgtatcacagtcccatttatggaaaaactgatattggtcgggcactgtggctcatgcctgtaatcccagcactttgggaggctgaggcaggtagatcacccgagatcagaagttagagaccagcctggccaacatgacaaaaccccatctctactaaaaatacaaaaatattagccgggtgtgatggtgcatgccgtcccggctacttgggaagctgaggcacaagaatcatttgaacccaggaggtggaggttgcagtgagccgatatcacaccactgcactgcagcctaggcaacagagcaaaactccatctcaaaaataaataatattttccccacagttttgaactgtcactagtatgttcttaattaaacctatttctctgatcttttttttctatccctgcttcatgaccatactaattcctgtcactttctaatatattttatctagaagatgaacattcttacttcttttcacaatgttagctattgtcgtatcctcactctctaaattattttttcagattttaacaaaatcttgtgattttgttattattgacataacattgaattcatgatatataaggggaaatttccatcctgtcaatatttaatcttgtcatatgggaaagtgttaaatctcatttgttcatcttttttgttccttcattaagattttgtttttgttttttcgttctatggtggttttttgtttgtttgtttgtttgtttgtttgtttgtttgttttgaaacagagtcttgctttgttgcccaggctggaatgcagtggcatgatctcagctcactacaatctccacctcccaggttcaagcaattctcatgcctcagcctcccaagtagctaggattacaggtgcccaccaccacgcccagctaatttttgtattttcagtagagacagcgtgtcaccatgttggccaggctgatcttgaactcctgacctaaggtgatccacctgcctcagcctcccaaagtgctggg

SEQ ID NO: 21374 - DNA, 1067 bp, Homo sapiens
aagaaagaaagaaagaaagaaagaaagaaagaaagaaagaaagaaagaaagaaagaaataaatttggcaatccgaaaaaccaactttcactctaggtatatttgccctaaaaaaaatatttacactatatgctagggggctgtactaggttgaatagtgccccccgcaaaagtcatgtctatcctaaatcacagaaggtgagcttatttggaagtaggatctttgcaaatgcggttggttaagatgaggtcatgttggattagggtagcagttggttaagatgaggtcatgttggattagggtaggccctaaatctagtgactggcatccttacatgaagatcgtgtgcggacagaggcggatgctggggtgaagcagccgcatgctaaggaacaccaaggactgccaggagccgccagcaactggggagagacgaagaaggattcttccctagagccttcagagagaccatggccctgctgacgtcttgatttcaaacttccggcctccagagctgaaagagtacatttctgttgttttaagccacctagtttgtggcaatttgttacagtatcagtatttgaaatcgcaaaaaaatcaacaaaaacaacaagaaaaaataatgtggcatgttagtttcccattgctaatgtaacaaattaccaccaacctaatggcttaaaacaacacaaatttgtcatcttagagttattaaggttagtctaaaatgggtccaaagggctgtaatctttctggggcctttgccagcttctagaggccacctacagtccttggcttgtagctccttcctttatcattaaagccagtgcatggcatcttctctcctctctgccctctgctgctgtccttaaattccttctctgactctgacactggtgatttcctcttctaaggacccacctggatagtgcaggataatctccttttctcaagatccttaacttagtcacatctacagtttcttttgctatgtaagctaatagtcacaggttcctttctggaattagggcatggacatctttggaaaggctattactcagcctact

SEQ ID NO: 21375 - DNA, 1051 bp, Homo sapiens
cgcacggagacacttgtccaggtcagctctgcaggtagagctggccttctgcctgtctgagccctaacccttgggaatttccaaaccaagtcaaaggttggtatgggtggctgtggagcaccagaaaacgtacctaccccgtgtattggttcgctttgaaaatgaacgtggagggaaatccgctttaaactgtgatgtactttatagatatgaggtggtggcattgcctgagctttgaagaaggaatattgtcatgctctgaattaaccatatgaggtccctttttaagctgttaagaacacttagcgtccaagggaaaaaaagaactttgaagccgtgttttgtcgtgaggctgataggtttagaaatgttctagaccatataactgtatggttgctgaaataattgaaatcgtgatccgtagaatgaaaacgattggagaagtaaggactttcttttgttcacagctgtagtcccagcgtctagaactgtgcctgcgacattgtaaatgcccagattagaatggataaatgaatgaagacaaaaacctatcccctcaagttaattctgtgcctgaacgtagtagattcccgttgtgtttgaaaagtgaatgaatgctcatcttttttgttgaatgctttctattcagaaccattctacaaaagggaaactttttacgtttattgtgtttatagtaaaaatatcagtacattaaagaaaatatggaaccagaggggggaaacaagtaaatcttttactcgctgtaaaactactatatgactactcttagcacctgaggttatgtcttttcagccttcctcctccttcccactccattttttaaattactaaaatatgtgttttatattctattaattttttcacttaatagtgtcagaagtttctttaaacgtaggtcttcaaatcaaaatttgaaatggtccatttgctaccactatttacataaccgaatctctcctttctgttgacatttacattacttttaatttttttgattttaagtaatgctgtaataaacattttcccaggc

SEQ ID NO: 21376 - DNA, 1282 bp, Homo sapiens
ggccagtctggtctcgaactcctgacctggtgatccgccctcctcagcctcccatagtgctaggattacaggcgtgagccactgcacctggcctagatttctccacaaccattctatttcaccattttcataaatatgtggcatttaaaggatttataaaaagccagggagaaggcaaagaccactgtctttgatagtgtgaggataggatttagcatatcacagaagtattaggtggaagggaaggtagaacagatggtagattaggcaaaatggtcagaaaaacatcagttatatcaactggaagagtagaaagaaatgcaaatcttaactgaattcatgggacattgactctgatttctctctagttcttagaacaaaacaaacttttaaacttaaccaaatattagggaaattgtaatttctggcaaaaatctttttgctgctggttttagtcttagctttatgggtttggtgtcagtaaacaatcagttgttattatagctgttaggtactcgtactgtcttttaagtccattatcagttccttgacccactctaatttctatcaatatcagatacaccccttcagcctctagcttctgctcagttgctttactccttccatttgtttttttctggatacaaggatggatgtcatagaagacaggctgtagaagaaaggcaagaacaggctaaaagtactaaacaactaacagtcttgacctgtagcttatgttgtattggagagagaaacagaagtaaatacaaaaaattacatgtaaaagcatttcagttattattactatgaataaaatgtaagagtaatgttgaaggaatggattgctagaaaaaaaatgtagaataatagagctgatgcacatctcctctagataaggtggttggagaagagggcctctttgagattatatttgagttgaggcttgaatgatcagaagaaagtagccaaataaagatctgtgagaagtgtgtttcaggtagaagaagcaccagcaaagcaaagactgaaattgtgacagtctcattttgtttgaaggacagaaaggagactattgtgactgtagcatagtagatagaggggagagtagagggagatgtgagaatttcagtttggaaatattatttgtaactctcatttacctgggtactactccctcaccccaccctttttattttgaaacgtttcaagccaatagacaagatgaaagaactagcacccatatatccttcacctagatttatcagttgttaacattttgtca

SEQ ID NO: 21377 - DNA, 1049 bp, Homo sapiens
actttcatcagtgagtggattcttggaagtccttatgccaccattctggaagtgttcactcgtttactgatttttgacaaatatatacacttgtgtatctcaaacccttgttaagatataggacaataagctagactcagtggctcacacctgtaatgccagcactttgggaggctgaggcaggaagattgcttgagcccaggaatttgagaccagcttatgcaacatgagaacccacctctacaaaaaatattttaaaaaattagccaggtgtagtccgggcatggtggctcacgcgtgtaatcccagcactttgggaggctgaggtgggcggatcacctgaggtcaggagttcaagaccagcctggccttcatggcgaaacgctgtctctactaaaaatacaaaaattagccaggtgtggtggtgtgtgctggtaatcccagctgctcaggaggctgagacaggagagtcacttgaacctgggaggtggaggatgcaatgagccgagattgcgccgctgtactccagcctgggtgacagaatgagaccccatctcaaaaaaaaaaaaaaaaaggaaaattagccaggtgttgtggcttgcacctttagccccagcttctcaggaggctaagatgagaggatcgcttgagactaggaggtcgaggccgcagtaatccatgatcacgccactgcactccagcctgggcgactgagtgagatcctatctctcaaaaaaaaaaaaaaaaaaaggatatataacattacataaacctagaaaattctctcataacttgggcactataagaattattgctttagaatttaacttggatacctgggacataattataatagtatgtgtataattattttgtaggggagaggtatgacattagttaggtcagctggattcaggtatgtgttgggtcagcgctactctttctgcactttcaacttgcccatcaattaaaaggctctcaactcagagccattttgttgaaatatgaataagtaaaaatgctacatgacccatgccgtatgtatttta

SEQ ID NO: 21378 - DNA, 1035 bp, Homo sapiens
cctgcctcccaggttcaagcagtcctgcctcagccacccaagtagctgggattatagatgcacaccaccactcctgaaaaattttgtacttttagtagaggtgaggtttcactatgttggccaggctagtcttgaactcctgacctcaggtgatacacccacctcagcctcccaaagtgctgggattatgggcgtgagccaccgcgcccggccccctgatactttttcttacttgagacacctcttatgttttgtttccatcaaaatttcccaaagattaagtgtcctttcattgtatgaagattatgaattaagatattttctgaaatatttttggactttgatgtaaatttattcctgaaggagattaatttcctaattctccagaggactgctgtggtgtaaaactgttccttgaacttgtagttttctacttttatttatattcatgaagggatatttatatagtccttgagtggatataggaatttttctagactcattaacacaagtctgagactgtcttgaaataaatattctcagccttacttgctgtgatagagttgttgcctagatttggtttgcatgggtcatttaagttgaaaaagggatttatgattttgtgcatttctaactagtggagagaattctttagttttgcatgacctgatgtatgtatgttgtgttttatcagtgagcttctcctttctctaaacttttgtatattttcccagaaatattttaaggaaaatatcagagagtattttcaacttatttcctagaagtattgccatagtaactgaatacttagaactcatttacttttttttttcttaataaacattagctcatagactttggttaatcataattctaggaaataagttgcagcatctcacaagttttgttacactgtattttctgtttcattcagtttagtctacttttttcctttgcaacttggtatttaacctgtggattgttttaaaagtgtgtgaatttataagtgttccaacatattttcctattgtcttt

SEQ ID NO: 21379 - DNA, 1027 bp, Homo sapiens
ccagaaaggaaaataatactggatattattacatccataatgtaattaaatgtaataatacaaagagtgatcatctgtttacccatttatttgttttaattgttctttgttcatttcctggtatcttttattgactttctctggtgttaatatattcattctagctttcttttcattagtgttaaaatggtaaatgtttttccaacctcttaacctattgtctctttatatttaaagagggtttcttttacgctatagatatttgtgtcttaatatttaacaatctctgccttttaattggagtgtttagatcagttgcttttaattggattattgatatgtttagatttaagtttaccatctttgttaattttttatttttcctgcctattttttgttcccattttcttttttttcctgccttattgcagattcagtgtgtgtgtgtgtgtgtgtgtgtgtgtgtgtgattccattttatttcctttttggcttattaactatagctgttactttactggaaactctaggattcatagtataaatctttaatttatcacagtctgtattaagtaatactaaaccacttcgcatataaatacatcacaacagtatacttccgtttatgctatcttggtctttgtacttttgtttttgtacattttactttggcataaatgtcaaagtacagtattgttatttagctttaaatattcatttgcctctctccttaatgtaaaaaggcttcttctcaacttcctgacatttcttgctaaactatacacgtctgccctgttttccaacagcacactgttctgttctgtcccttatttttttcttttttttttttttttgagacgagtctcgttcttttgcccaggccggactgcagtggtgctatctcggctcactgcaaactctgcctcccgggttcacgccattctccggcctcagcctcccgagtagctgggactacaggcgcccgccaccacgcccggctaattttttgtatttttagtagagatgg

SEQ ID NO: 21380 - DNA, 1046 bp, Homo sapiens
acttaaggaaatgctgctggaacatttcagatgttgcattttcagacttgggatgctcaggtggtaagtataatgcatctattccaaaattggaaaagaaatcagaaatctgaaatacttttggtccgaagcattttggataaggggcactcaaacctgtatgttaaatatgtcactcaattttctaccagcttgcatcgtttataaggagaaatctgttgtcagtcttatctttgtatctcaaaacatatagtctgtttttctctgacttgttttaagattttttttttaaatcatcagtgtgtatgctttgtagcattgtggtgtgtgtttctgttgaaagtagttgtgtgtttgtgtattgtgtgaggtgttttgtataaatgcaaacttgtgtggggaggcattttctgtgtgttattttgtgtcgacagtttgtgtatgttgtgtggggatgtgattgtagatgttgggagggtattgtgaggggatacttttttgggtgcttttgttgttttgtatctctggtattacagtgtcctacctggtcaatgttgtctttattttgattatttatatatgaggataggactttttataccaattaaaatgtttttgtttatcccattctttctgtttctgtttcttctgttttctcttaaatttattgtcttctgctgttttgttttcttgctccatctttttctttttaatattttagactttatatcttctctgatcttctttgaagttttaacatgcatatttaactttagatttcaggatttaaaatattttccttcccccaacttaaggacttcattagctttggtcactcccttcctgaaatgacacttttgttattgaaggtatttaaagtgtgactttttagaaattcaacaatatgcacacaccagtttttcaccacaccagtaaatgtctcatatgtagtccttaaaaaaattacttttgtatgtgttgtattatggtgacctcttgtatgttagattgtgcttgtaggaacatttctttagaacaagtcttct

SEQ ID NO: 21381 - DNA, 1011 bp, Homo sapiens
cactggagtagatgtcttgacactgattatttcacctttcagttaggggtgtttgcaggcgtgatcattttattaacactgaatacaagtgcaatgaaagtttcttttgacacttaactagcttgtttaaaatcactgcattaatgttttattttagtgatcattcaggatatgttcgtccagtaccagtgccacgcagtttaaatagtgatatttcctattttggtgttgggggcaagcaagctgtcttctttgttggacaatcagccagagtaagtaaaaagatttcttataaatgaaagttgatcaaaatattttgaagttgactctgtctaaatgcattaaccagtttattaggaatttaaaaagtactctttttaatatttaacagatgataagcaaacctgcagattcccaagatgttcacgagcttgtgctttctaaagaagattttgagaagaaggagaaaaataaagaggcaatatatagtggatatattagaaacagaaaggtacaatacattttaactcataattataaatttactcctttggatagacggtgggacagaacttaacttgaaagtatgaaattttcaaaatgagttaccctttcctttagtcataataacaaaaatgggctttctcaagccaaaaatcttcagacaagttgtctcataaagcttactaagctttctgtaaattgcttgtaggattgtaagcttttttccctggtctgaatttgggttttaaaatctttgttgtataataaaattatagagtagaaaaacagtaacagggtaatggactttcaggaaattggacctctagagaaataaatgagagattgctcttacaagtttgcattgaaattcttgtgttcataagacaaaatgttaacaaatttgaatcttggtggcaagtaaatggtatatttattgtatattccttcaactcttctttgtttgaaacatgattttttttctttttttttttttttgagatggagtct

SEQ ID NO: 21382 - DNA, 1028 bp, Homo sapiens
attctctgaaagtgggttggtgtccaggatgattttacttttaagcactatgtgtttgggcttagctagctgggtccagcctgccctgtagttttcttgaacatggagggctgggcattggtcctgaccaagttaagtggtaggtctcccaagcaagcgttcattctaccctaggggtaagtgtcctcaattttttaaggcattttaaaactcagtatttgtctttaccttttcgtttatgattctaaaatcggtttagcattataagatagggtgctctttatgcatgctagtttagcagtctgtgtgaaagttcccttgtcttcacagtgttgtcacatactcagccagtttgttgtattgggccagtttcctccaaagcttttctgaaacctatttgtgaaactccaagtaaatcacattaaaatttgatgcaatagctatttgtataattataatttagatgatttaatctgttgtatttctgttcactcttgtagccctctgattctgttcacattacaaatgatgatgaaagatttctacatcatcttatcatagaggagaaggaaaaagatagctttactgctgtggttatcacaggggtacaaccagaacacatacagtacttgaaaaattatttccacctttggacacgacagttagcgtaagtaattatatttggcttaggaaatgttgctacttaacttttttaaggcagaaaacattacagatatattgaagcctctttggtatccgttttgctcctgtctcattttcttccctttagtattatccagtactctgatattggtgttaaaacagctctctattcatttattctgtaaatatttatagatcacctctagtgtactgagcattatttgaggcacaggattttgacaatattataaaattaaaaaagaacttcacagtttgtcagattgagcactatatcacttccatgaccccgttttgtgcttcttttccataggacctgtcgtaatcttccataccatatatattta

SEQ ID NO: 21383 - DNA, 1030 bp, Homo sapiens
gatagttttgaattcaaagctcatgttgaaggagatggtgtagtggaagggattatccgttatcatccattcttatatgatagagaaacttaccctgatgatccatgctttccatcaagtatgttaatctgttatcttagttataaaatatgaagttgtaatttaggacagtgatttgtttttctaaatgattatcggttgggttattcaggttagataaatattaaattttttcttatgcaagtcttagattgttaggtatttgtaatttttgtaattcctgatttttgtgtacattcatttctagatgaataaatctttaatgaactcttcttttagttctgttacgaaaccaaacttttagatatgtatgcgtattaatcctttatatgttcccttgtcttctctttatccttgttgcagttttacactttatgcagtcatatttactaactttttctttatgctttctgattttgtcttactgtagaaaggctttttacatctcaaaattatataaatctgtagcttttttgtttttgttgtcattttatggtcaatgcatctgtgtttttcttttttgtatgtagagcaaggtggggttttatttatttatttaaatttttgagtgatggggtcttgccgtgttgcccaggctggtcttaagatcctggcctgaaacaatcctcctgccttggcctcccaaagtactaggattacaggtgtgagccaccacacctggcccccacctttttttccccccccagtagagagatagggatttaacaattattttctatgtggtattcatattcagtttcttagcaccagttattgaatgttataatttacccaagagttagaacttgtataatacaaagttcccataagtacataggtctagattctttactataaagtactattttatttttttttaatatgagtaatgatactgtcttgtagctttatcttgtaatttggtatctttgggaaaaaacattttcactattgttcctttttgagaata

SEQ ID NO: 21384 - DNA, 1048 bp, Homo sapiens
tttaaagctaattttttagtaatgactaaacctacctagtaaagactaggtttggatagaatttacatatcttcattagttttttttgtttttttttttttaagacaggagtttcactctgtttcccaggctggattgcagtggctcaatctcagctcactgcaacctctgcctcccaggttcaagctattctcccgcctcagcctcccaaataactgggactacaggtgcgtgccaccacgcctggctaatttttgtatttttagtagagatggggtttcaccatgttggcctggctggtctcgaactcctgacctcaggtgatcgacttgccttggtctcccaaaatgttgggattacaggcatgagccatcgcacccagccaagatcttaatatctagcccttgacatagtagaagccacagaagcatcttaatgagaacatgtatgaacaattgtatttgctttaagggctatatttgtatattaataacctagttgtgcaatttttagctagtcttgagggtaaaaatggggtaaaactgtgaagtactttgagctaaaaggtgatttgagattgatcagtattaaaatacatgtattgattaatacaacaagaatgatttcactttgaaatttgttacaaagttgagtgaaactagtatactagtgtacttgtattctgtgaacagacctcagagacttttgatactactctttcagtagtttaatgttgaattgccaagaaatagatgattttattatcaatttattgctgggcaataaatacagtgcatagtacatagtatttgtagtcagtcagtcctgtaagatgttgaaattaattttgctcttataaagcttgtgaatcatagaagattaggacacttttaagaattatacaccgagaaagaccttatcaaaatgagttactactcctttataatacacttagaattcatttataatatggtgttagttatccaacatttattgagcagtgggtgttttcaaaagctatccagaataagttaattctattcctttg

SEQ ID NO: 21385 - DNA, 1034 bp, Homo sapiens
ttcttgttaatgtttgatatgttaggactacagaggttatataaaaaatataaacaaacattgtggtgtaacgtaagaatagctactgttatttatgtacttaattaggataaaatatatttctttggaagaaacaaatgggtgtttgtttttattacagctagatttaaatagttttctttgaaatgttggtaaatgtatttattcaggaacctcaggcactatatgatgaagtaagaactgtgccaattgcaaagctggataggacagttgctgagaaagctgttaaaaaatatgtagaagatgaaatggcaaggtaagtcacacttcaagatgcatgacaaaaataagaaaaattggaaagaattgtgctgtaagtattctgagtatgtcatttactctgctgttagggcatttgtagtcttagatattgtacctattgagatgaacttcttgttgaaaaaaattaagaggtctagttatacaaacagaattctgcatttgttttgtagacaaagaaggaaatcttatatatctaaagtgtcacttttataggcactatgattaacatgttttaaaaaaactcagtttggcctacaactaggatattacaatacctgctgagaggtaaagatgagtgtattagttcgttttcacactgctataaagatactacctgagactgggtaatttataaagcaaggaggtttaattgactcagtcgtgcatggctggggaggcctcaggaaacttataatcatggcataaggcgaaggggaagcaagccatgtcttacatgggcggcagaagagagagagagggaagggggaactgtcaaacactttaaaaatcatcagctctcgtgagaactcactatcaagagaacagcatgggggaaaccattcctgtgatccaatcaccgcccaccaggtccctcccttgacacctggggattagaattcgagatgagattcggatggggacacagagccaaaccttatcagtgagttataaagaagaagaaggaagtagaa

SEQ ID NO: 21386 - DNA, 1049 bp, Homo sapiens
aactgtgtatatcactcacctgttttatattatttcatctttagtggcctaggaaactagtcatagctctgcaatactccacgcatgatctggcccttcctctctctccaacttgatctcatcctcacttaccatacctctaaccacaactgttttcttttggttcttatcgaaccccagttttcccaactctagaccaaattttgttccttaaatgtgtctttcccctctaggacaggggtgacaaactatttggaaagcgtcaggtagtaaatacttaggctttgagagctgtatgagctgtttcttatgattacgtaagtctgttgttgtagatgaatgcagccattggcagtccagtagtttgccagtccccttgttctacaagattaaaaactccaggaaagcaatgatgttttctttaccctttttctagtactttgtatataggaggtaattaattaatatttgttgaataaatacatcaaaaatcagaaagttgcttgggtctttttagagaacttctcgtggtgatttgctgtctgatttataattgcaccctttttttaaagcaaatattgagaagatgtttctagaacatgtttctttctctattggtacaagttgagaaatccagcagtaaaaggcaaatataggcatgctttctttaagatacatcataaactggtctggccaacatggtgaaaccccgtctctactaagaagtaaaaaaattagccaggtgtggtgatgtgcgcctgtaatttcagctactcgggaggctgaggcaggagaatcacttgaacctgggaggcagaggctgcaatgagctgagattgcaccactgcactccagcctggcaacagagtgacactccatctcaaaatatatatatgtattttaaattttcatatcaattttatcattgacataaagattatttaagagtaagctgtttgatccaagtattttatagttttgagagtttctcttggaattgatttctagttttattccactatggtccaagaagttacttgatatgattc

SEQ ID NO: 21387 - DNA, 1038 bp, Homo sapiens
agttcttattctgaatgttaaaaaatacattggtattgtgttgacttgatttttaatttcttcttaatttatccagaaaatattcagaagttggggaattataccttgaaattacaagttgtgttgaatgaaagtaatgcagacacttatgcaggaagaccactaccatctaaagcaattaagttttctgttaaaggtaagcaaaacagtaatatataattatatatgctaaaggtggcattttaaatccaaagagaaaagagagataagccattaaaagatgtttgaacaattgggtaaccatctcgattttattttattttcttacttactttgagatggggtctcattctgtcacccaggctggagtgcagtggcacaatctcggctcactgcaacctccgcttcctgggttcaagtgattttcctgcctcagcctcccgagtagctgggattacaggcgcccgccaccacacctggctttttgtatttttagtaaagacaaagtttcgccatgttgactaggctggtctcgatctcataacttctgatgatctacctgcctcagcctcccaaagtgctgggattacagatgtgagccaccgtgcccggcccattttgattttcaaatagctttgtaagtctactcgataatcatattccttctgaattttgaagacattgttttctacttttcattgttgctggtaaagtctaaagctgtcctgattcctgaccctgggcatattgcccctcctcccccaaaacgttctctgttccccagtcctcaagttttaggggaatcccagtttctgaaatattcaattgtatgatttagcataggcctgtttttatctagtatcatccagccatgtacctcgtataccctttcagtctggaaatccctgttttattttctaggaatttttcttgaatcactttgattttctattttctttttctctccttttcttttctgttcctttcctttcttttcttttcttttcctctctcctctcctctcctctctcctctctc

SEQ ID NO: 21388 - DNA, 1035 bp, Homo sapiens
attgatcctaaaatgatattcctattttggaaaagtagattctaccataattctcttcctttcactgtctataaggaagcagtattgatcagtttttttcctctaagatttctgactccatatatgataattttagtaagtataaagttggtaagtaatttctacaatggtatgaaaataaaaccaaaatataaatcagaattgatgtgataaactacttaagtatgtattcaggactgggtttaatttttactgtttttttccaacagaattataatctgaaggttactctgcctggcttaaaagaagactcacagattttgaaaattagattactacctggtaatattatttcaagaaatataattatttaaaataattttcttatgttaaagtataatgatatgaagttagaggtttttgggcttttagtagtggtgtaaatcttgaaaatacacttaaatgtcaaaccatagcactgacagaaatgaccagtttttaaaaaggaaaacatttaggaagatgttattgacattctgaatataaccttgggagaaaaatttggatattgaaaatgtttggggaactgtttcttggaatatgtctattaggctttattagagatgggtctgttctttacattttgttgataaaactgtttcatattttaagaagaaaaacttctaatgttatttttattaagttaacttgataatgacttaacctgagaaaatgaagttgcattaaagttacgtagggtagaatatgctggctaatttgagaggtagtctatggtagagattttaagtacattctggagtcagcccttctgggttagtatctaggtaaactcgttctatgcctcagtttcttcatgtgtaaaatgagataatatctactcccttggggttgttaggaggattaaatgagttactacaggtagtccttgccttgcacagttctgtagtactcaatggaggacacagttccaatatgcgtgagttttcattaacacctactgtaccaagtaagaac

SEQ ID NO: 21389 - DNA, 1030 bp, Homo sapiens
aagcaagaattgaaatacctgtaagttattattgttactcattgatattatattgagtcttcatacaaatagtcttcaactgcttaataacattttttgcaaaattgttaacttctgaaaatgaggtatttgtggttctttcagccaaagcaaagcaaagacaatatgaaatgctgtaatgactattttaacattttgtgtcaaatattagtaattgtcttgatttttacagtgtcttttatagtgtctataactattattgatttacatttccctaaaatatttttcttctattaaaatacataattttattctttcgcttttttttttttttaaagagatagggtctcactctgttgtctaggctggagtgcagtggcacaatcatgacttgctgcagcctccaactcctaagctctagtgatgtgctcacctcagcctcccaagtaactgggactatagacaaggaccaatgcacctggttatttatttattatttattttttgaaaaagagggtcttgctgtgttgcccagtctgatctcaacttcctgtccacaagcagtcttcccaccttggccacccaaagtgctgaagttataggtgtgcaccactgtgcccagccattttgctttttatcgttctcatttgttttagaaagcttggtaaatatctctgtttaaaccaccatggaaggacatataaacctttaatttttgtatgtaattttctatacacacatagctttttatttgtgtttttacacaaagggattttttttatttctatttatattttttgagatggaatcttgctctgttgcccaggctggagtacagtggcacgatctcagctcactgcaagctctgcctcctgggttcacgccattcccctgcctcagcctccccagtagctgggactacaggcacccgccaccacgcctgactgattttttgtatttttagtagagatggggtttcaccgtgttagccaggatggtctcgacctcctgagctcgtgatccacccacc

SEQ ID NO: 21390 - DNA, 1043 bp, Homo sapiens
gactggggcaggagcattgcttgagcccaggaattggaggctccagtgagctatgatcattgcactccaacctgggctacagagtgagaccttgtctataaaaaccaaaaataaaaatagaatatgagtgattttaaaatcacaactatagaaggctaaataaaagtagagagaaagttgaggtcagaattcttaaatagaaagtattgggagtttaaaagtaagtacagagtagagcaaacaacttgaaaaagtatggattaagtgacaaaatatggaatgtaagaggtataaattaatacagaactaaaaacacctaagaagagattaaggccaaagtatggccagaaagttagatcaaacttcttttttctcaccttgctaagaataacgtccacctagatctcattgaaagctttcccataaataggattcttttcaaaaaataattgaatattgcttttcagaattaatcacatgatctgatttatatgttacttttaaacgataatggccacagtgatacttttgtggcagagctctaaagaaatgacttaagaatttttattttatctcactaaaaaaatagggcaatattaacaacaaagacaaagaggatgcctttgtatcatattagtatatgaaccacaccgtttctgaccataaagagacttttttcttgggggtgaagaagacggattataatgtagttttaagagtaagataagtggcagtaagagaacattagacgaagctttattattgttaaatatctctttttctcctaggttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaaggtttgtggactcattatattttgcagcctatggcaacaaaatactgtcctccattgcacatatatgaaagttgtttttaatgtaaaaatattacggtttctatgaa

SEQ ID NO: 21391 - DNA, 1705 bp, Homo sapiens
tcctgatataataatctacttcaacatttatggttcattttaatcattggttttggaaactatcttgcttaattaatcctgaatctttgcttgcttaatttagaccatcagtccaatcaagttggtattatctttaaataatatcaccataaagttctactgtgtgtcttttaataatggggtgtctttccactgtcactaatctcacattgtaccttacatgtattatgaagatataaacgtgtgtatatatacctgtatgtttataaatggaatccagatacacattcagtttaggtatataataagctttcctcctaagtatactatgttaaattttgtcattttcccctctccccttctctcctactcccctttctaggcagaaacatttagttgtaataaaataaaagataatgacaaagaagatggctgcttctatttcaggtatttctcaaaacatttcatattttgaatacatatcttgttacaaagtaattcaaccctggagatatatgtgggctcacctgaggaaaagtaatttatgatcaaatagaaatgttagtgtctctaaatttttctcagttttttgggaaaaggtgtgttttcgtttttaagcattaaattggttttaagctttgtaaattgtaattgtatttgcttttgaaactatcgaagccatcagaagaattcttttatgttgtcagggcactttataacttcttattatataggaggtttctataaagattagactggcttttaacatttctgtgactttgagcatgttgctgcttcattctggacctccattttcaaatctaaaaacattatgtgttaagtttctttacaaatcctttatcatcaatagggtcaaaatgctcattatatttgttcagtgctttttcagactaattggtaaaggaccaatcatggaagctccaccccttacctcttccagttattaccgtcttccttcctgttgtgcatgccatgcacacactcatgtagacacacacatgcacacaccacaaaccctctcctgatttggtcttatttagagttccgtttatcttagcatacatctctatagtctctgatttagttgtgcccatttttgaacttgatatacaattattttcctttgcataagacttctttcactcagcatcatgagattctgtggcatatagctataaattcattcatttccattgctgtatagaagtccattgtgtgaacacactactattttccattctgttaatggctatttgcattttcaattttgggctattacaaataatctttataacactggtgctcatataaaagtaaaattgctgggtcataagttcatagatgtgtatatttaaatatagatgtgtatgttagatgttaaatatagatgttaaacatagatgtgtgtgtttaacttgagtagcttgagggtttatttctttttaatacatagccttgctagagtgcaatgcctagagtgcagtggctcactgcaacctctgcttccctggctcaagcgagccccctgcctcagcctcccaagtagctaggactacaggaatgtgctgccatgcccagcaaatttatttatttatttattttgtgtgtgtgtggagactgggtttcaccaagttgctctggctagtctcgaactcctgagctcaaagccatctgcccacctcag

SEQ ID NO: 21392 - DNA, 1053 bp, Homo sapiens
caagtgatccgcctgcctcagcctcccaaatttctgggattacaggcatgagccactgcgcccagccttgtttaaattctcaatataactttcttaggaattaccatctcagagaaaacaatatagagaaaggttaaataattttcttcaaggttgcatagatgttacagtgtcgggatttgaattcaagtatgtattcaaagcctgtgctttgtactgcattgagccggtattttgagaatatgaatgacatgcaaaagctaccctagggatcatgagccacatcgcacatattgtagaatattattcatattttctttgtggtaaagcgtgaccaaaaataggttaataagtgtacctcttcttaggcactgagttcattattggtaattgattcacagtaaataccttgtatgtgtagttaaatatttcaaatagtacttgaatggaaaaaaagttacatagaagatcagcaggatgttctataattttgaaatacaaaactgtcgcttagaaattcataaagtagaaatgaagcaaaatttacttgacatgtaattcagcattttttacgtatttactgctttctcaacttcatattcctgttctttcaatttttaccatatccagcacgtttattctggatgttttgtaaaagaatgtacaggtaagaggaacctgggagtaagcaagaaatatttgttgaacgaatgaaggtcaatatactattagtagttctattcttcctactcatttatttttgtggaaagaacagaaatgttgactctttgaattccttccccctttatacaaacattgtcagtaatcttaactttcttttaaatttagggataaagtaattcctaataaagtggggacatattgtatccagtttggttttatgatggataaaacaaatattctcaacagtgaacaggtttgcttactttttttatataccacagttagctttacattttctttttttttccctcttggttctgcattacatgaaatagcttcacattttctcatttagtttatgaatgaaat

SEQ ID NO: 21393 - DNA, 1053 bp, Homo sapiens
ataaagtaagattttcttgtgctctaacaaaaattaggtaatgaaagccacgttgaaaaacaaaggggagtggggagacatacttaacatgcagagtggatttgtgttggaagaagacatctagtcttctttctaaagaaagttttctaaagaaaactttacctgttttcctgtttagctatgtccagttttctttttttttggagacagagtctcactgtctcacccaggctggagtgcagtggcgcgattgcccctcactgcaagctctgcctcccgggttcacgccattctcctgtctcagcctcccaagtagctggtactacaggcacccaccaccacatctagctaattttttgtatttttagtagcgacggggtttcaccgtgtttgccaggatggtctcgatctcctgaccttgtgatccacccgcctcggcctcccaaagtgctgggattacaggcgtgagccgccgtgcccggcctgtctccagttttcttggcccccttatggtcatttgaaattgctaaacctgctgtatatactcctgagattcagacaagagatttagctattccccagcagctgtatataaaaatctcttcacatcatgcatgtaaattgtactcttaccactagaggaccctgatatctcactgaatcaatagaaaactcaagtccttcttggctcctgcctcacatattgatttagtatgtctggagcagggctctagaatctgatttttaaaaagcaggtgattcttatcattagggaagtttaggaaacactggtctagagcacaaccaatgtttgtaaatgttccacattattgctttgtttaaagttacaatctaaatttgtagttgcttaagtttgttaattgtgctattcagattcactgtattatttgcctacatgatctggacatttctgatggcagtgtctaagtttcattctgatatgcatttgtttgtttctcatatgccaaatttccgtttatacttggatccagtttgggactcttcatttctgttattctgtttatccttttt

SEQ ID NO: 21394 - DNA, 1098 bp, Homo sapiens
aaattttaaattggcatctatacattcacatgaattgatcaaatcgagtgctgaaagcaagttgctaaagtatatgttacttatttttaaaatgcaaatagtattttttaaatacatgtttgcatttatgtaagtctgttgaaaaccacattcagaaactgattggcagttggtttaatggtgggcttgtattctatattctttgggaaaaagtctgtgagctgtaatttataattttatttcatggattgacctacagtgccatatcgatttagattttttaaaaatactacttctctgtaaattgtattgttatagtctaaacaaaaacagctactatcgtttcccttagaactgtgtgaaaaaatcatttcagataaaaatatatttgtgtcatttactagttatatgttttggtcttaaagtatatcaaaaggttttttatccattaatgagaaagacacaatttaaaaaatctttagagcttttcaaaatctcttgttctgtcacctgggactttgatgggtctatttccatgttaacagctgtaacttaaactcagcattgggctttgtgattgtttttataactttcacactatcagctctttcatgctgctttcaatttagaggttagaatcaagaagattttacaggtcaaaattttaagtggccatctctaatgtgaaggaaataactttttcttgaaattttttatcatatatacttttcacataagctgtttattgatacgatcatttggctttcaaaccaataccagaaggtaaaaagttgtatgtcttgggtagtggtggtggtgataatggtttaatggaatcttaaggatcagcctatgcctttggcctttaaaattaaccacttacttgaaaacagcataatgagttatgtaacatttatatgttgtaaattttctttttaaatcttgttttcccctattgtttgtttatatgtacagagtctggtgctggcagaaagtagtcctggaagggatagtactgaatattttattgtatttgagccccggctaccacttttatcaagaaccttagaaccatatatcctaccgttcatgttttac

SEQ ID NO: 21395 - DNA, 1047 bp, Homo sapiens
tggcaaacttttgtatctttagtagagatggggtttgaactcctggccttaagtgatccaccttccttggcctcccaaagtgctggaattacaggcgtgaggcaccgtgtctggccactttgtttgcttttattaaagtaaaatacacatagaaaaatgtgcatattttgtgaacattcagcttgatggatcttcacaacatgaacactgcacttatattaaaaaatagaacattaggctgggcttggtggctcacacctgtaatcccagcactttgggagggcaaggcaggcggatcacctgaggtcaggagttcaagactagcccggccaacatggtaaaaccccatctttactaaaaatacaaaaattagctgggcgtggtggtgggtgcctgttgtcccagctactcacgaagctcaggcaggaccatcacttgagcctgggaggcagaggttgcagtgagccgagattgtgccattgcactccagtctgggtgacaagagcaaaactccatataaaaaaaagaaaaagaaacaccagtactgtagaagatttctttttggctcctccactccctaccaccactccatactcaaaggataacaactttcttgacttatagtagcttagattaattttgcccattttagtactttatatacttggtattgtgcggtgcgtacttttttatatgtctagttttgttcaacactatgcatgtagttcattttcattgcaggataatacttcattgtgtgaatgaaatgtacaatttatttattctactgttgaggaatttgagcagtgtcttagtctgttttgtgttgttataaaggaatacctgaagctgggtgatttataaagaaaaagatacttaatttggcatacacttcttctggctgaaaagttcaagattgggcatctgcatctggtgagggcgtcaggctgcttcctatcacagtagatgaagagctggcatgtgcaaagatcacatctcaagaaaggaagcaaaagggaaggggagggaaggtgccaggctctttaa

SEQ ID NO: 21396 - DNA, 1048 bp, Homo sapiens
gaatagaggcttcagttttctaaataattttccacttataaagattaaaaattagttctgttaaaaatatgtatcatcttctatttggagatagttcagggaactattagaaaatatttacatatacctgaatttttaaaatctgtagctatatatgtcaaggtgctcactgtgttcatctctacatgaatgagattatgaatattaaatgttttattttgcttgtctttgttacttttctgtaataagcattataattcctgttcttaaaataataagttcatttaaggaaaagggggtgaaaggaaaaatctgcagaatttaggtctgagataataccatttcaaagcactgtgatacaaattacttatatatgttatatactgtgtgtgtgttaactacttttatttgggggcttgttttgcatacatgtgaaggaaatgattatatataaggatttaattaaatctgtttataccaagaattatatttaaaagaatatggtttcattggatatttaagcattcaggtgtgatgagggaattcagggaaaggaaacctttggtacataaaacttttttttctttcccctttgaccaggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaa

SEQ ID NO: 21397 - DNA, 1030 bp, Homo sapiens
cttggctcactgcaacaactgcctcctgggttcaagcaactctcattcctcagcctcccgagtagctgggactacaggtgtgtgccaccatgcccagctaattttttttttttttttttttgtatttttagtagagatagggtttcaacatgttggtaaggctggtctcgaacttgagctcaggcaatccgcccgcctcagcctgccaaagtgctaggattacaagcatgagccaccatgtctggcccctaagttttgagaattggtggatgaatgaagacaaaggaaggagccttctttttatacttaacaaggaggaatggctgtttcacatggaattgttcagtgttttctgaggaatccagaagcctgagtcacctgggacctgtggaaggaaacctgaggttcttttttattattattgttttttagagacagggtctcactgtgtcacccaggctggggtgcagtggcaccatcatagttcactgcaacctctaactgttcggctcaagcgatcctcctacctcagcctcctgagtagctgggattacaagcagaagtcactgcatcctgctagttttttatttttatttttttagggatggggtctcactatgttacccaggctggaaaaaaacgttcttcagaaactcactctagagtgactgagggataatttgtgagcagtgttggaagtacagggctggaggttggccgagatgctggagatagaaacgcatttctgcagttgagagtgacggacaggttggcatcactgaggccttgacatggttgagcagagctgagttcttagggacagtggaggggaaggaagaggaagagctgggcaaggagagagagtgaagcaaagatattggtggaggaaaccccatcttagagactcaggagaagtcctggaggcttcaggctccagaaaggccatgggttagtgagcaggaagcaattgtttctgcagaaagaggccattcaggtcagtggggtgcaggcattgtaatttgtgtgagat

SEQ ID NO: 21398 - DNA, 1075 bp, Homo sapiens
tgccttcagatgtatttgactaatcttgaagaaattgagtcaaaatttttagcatgagaatgaaccttaatctaagttttggtatgtgaagaagaatgaaaacataatcaaatgccttgttagtagactacattctgtctctgatttaaccttcgatataactaaggtcaaataacaaactaagttacaaggaagagaagaaaattaacatttatttaggacttgtatatggggagggtaaggagttggaatgttagagtaaggactgtaaggctggtgtacttcaaaacaacaccactaagccaagcttcaaaacaccctgtgggatgttctttagcttgaataaatagaagtagacaatacatttatataaaaaatcccaataccagaagtcctggagacttaggtccaaaatccccttgctcagtcattgacctctctagtcatttgtttttcacattgcaggaagttacggaaacagtctgcaagaccatcatttctgacagcagtttcaagtttggatgtcctaagaccacccttgcgtttgattatttgctaagactcacagaactcactgaaagctgttaggctcacagatacataggttttcagaggttatatgtagctagtaacggtggagctgagatttgaactcaggacttcctaactccagagctgatggtatttttgtgttttatttattatttaaaactgcaaattaaaaatgaaatgacaagtgccttttctgcttgacatttaaattattggtggctttcagtagagtgttggaagctactaccaaagccatattacggagaatggaggaatgattgggaagaagagaaaaggggctgggcacggtggctcatgtctgtaatcccagcagtttgggaggatctcgagcctcagagttcaagatcagactgggcaatatagtgagaaaccccccatctctaaaataaaaaacagaaggaaaaatgaagacagttcagcattagactggtattctgaaagtcttgtcaagggaaaagggaaatgcagggatagctagaaagatgaaagggtgggtttgata

SEQ ID NO: 21399 - DNA, 1067 bp, Homo sapiens
atacagtgtaactctttacatagggtttacattgtgctgggtattatacgtgatctagagatgacttaaagtgttgggaggatgtgcttaagttatatgcaaacactacgccattttatgtaatggacttgagcatcggtggaatttggtattagttgtggggaggggtatggaaccaatccccctcagatgctgagggatgcctgtataacatttaagcaatggaggctgagaaaaaaaatcagtctcttaggccaggtgcggtggctcatgcctgtaatcccagcactttggtaggccaaggtgggtggatcacctgaggtcaggagttcgagaccagcctgcccaagatagcaaaaccccgtctctactaaaaatacaaaaattagccaggcatggtcgtggcaggcgcctgtaatgccagctactcacgaggctgaggcaggagaatctcttgaacccgggaggtggaggttgcagtgagccgagatcacgccatttgcactccagcctaggcaacaagagcaaaactccgtctccaaaaaaaaaaaaaaaaattcaatcagtcttgtaatgcccatgaatttcacagtcacagaatgtaattttctttatttctggtaataaaatttatattctaactctgagcccccacttctgacggacagcagaaaagctccatctagtcacagccacagccagtcgacttgatccaatttagcactttctaagttgcttctggttaaaattcaggaatattcagaatatttccctttgattcccctcctttccttctattgctgctggaagccattgcatctggagaggcagtcgggacagtcagggggacctgtgttggtgactcagccttcctctgctgtctgagctttgaccccaggggattggacacagtgctgctgggatgcaagagtggatctatggggtggctcccacctgggtctctgatatgagttgagccttcgtcctgttccagtttctggaaggaactgttcactctgcagcccctgccacggggatccttatctccagccaggcacgtctgtcag

SEQ ID NO: 21400 - DNA, 1030 bp, Homo sapiens
acactgatattacgaagtatgcttcaaaatgatggtacactcatggaagcagcctcagaggaaagccattaagatggcgggggtgccaatcatgtcatatgagggcaattgtaagatattattgaactaagatcaatgggtacagggtttgggaggaaggattcaggtcaatgtagggaagaaccatctaacctgtccacagaagggatggattgcctaattaaatgccgagattagagaatttagcctcgtggatgtggtcaagaggattcaagcattaggttgatgatcatttagatcagcttcccacacctgctcatcagaatgatccagccacttgttgaaaggatgtgttctggttaccctgagatgttttcattcattagatttagggtggggcctgaacatctgaatttttaatcaacacaataggggacctgttgctgggtagagggtggtggggtataacagaggtcacaaatgtacaaaagccctttttggaggagcatgtatgaaatgttttaggaactgaaaggtcagctttgtggttgtactcaagagagtgaagggcaagttgtattagaaaaaagtagacatataggtgtgagccagaaattggaggttttccagaaccacattaaagattttaagcacaactgaaaccattttagcctagagtaacatagggtaaccagattttgtgtgtgtgtagtgtgtgtgtgtgaatgtgcagacccacacactcaaaatacacatcatatttttaaagatctctcagactgtgaagagaatggacttaaaaatgttcatggaggaggtagagtgggtggcagtggactggttaatagactattgaagtattccaggtgaatgacaaggggacatgaggaggtttttttgggagctaaaatcagctggcctggatggtagaccagatcatggggataagggtaagagggtattcagggtggagagggatgccatttactcacccagggaataggtttgtgggaatgttttgaacgaatgg

SEQ ID NO: 21401 - DNA, 1021 bp, Homo sapiens
ttaatccatcttaattttagcatagtatgtagagaaggggtcaagtttcaatcttctgcatatggctagtcagttacaccagtgccatttattgaatagggagtcctttccccattgcttgcttttgttagcgttgtcaaagatcagatagttgtaggtgtgtggccttatttctggtttctctgttctgttccattggtatatgtgtctggttttgtaccagtaccatgctgtcttgtttactgtagccctgtagtatagtttgaagtcaggtagcatgatgcctctagattttgttctttttgcttaggattgcattggctattcaggctctttttttgttccatatgaattttaaatagatttttctagttctgtgaagaatgtcagtggtagtttactaagaatagcattgaatctatataaattgctttgagcagtatggccattttaatgatattgattcttcatattcaggagcatggaattttttccagttgttcatgtctctgatttctttgagcagtgttttgtagttcttgaataggtcctttacttatcttgtttgttagctgtattcctagtttttttgtttctttctttcttttttcacaccggctaatttaaaacattttagagatgggatctcaccaagttgcccaggctggtctcaaactcctgggcttaagtgatggtcctcctgcctcagcgtcccaaagtgctacgattacaggcatgagccaccacgccccacctacacacatgttagaatggctaaaatctaaaacacttacaatgccaaatgctggcaaggatgtggaacaagaaggaccttcattcattgctggtgggaatgcaaaatagaacagctgcttcagaaagcagtctggcagtttcttacaaaggtaatcatagtcttagatatgatccagcaattctgctcctaagtttttgtcaaaaacatatgttcacataaaaatctgcacacatggttatagcagctttattcatttttgccaaa

SEQ ID NO: 21402 - DNA, 1019 bp, Homo sapiens
aggatctacaggaaaagaaggaacatgatggtacattatttctgttgaaagcaaatgagggcacagtgcaaatgccaggcaggcacctgtaatctgtgacatttcagcttttaaatttgattttggcttatctaataaatatgggatctgtttatattattgtgatttcatgtctacttaagagtttaatgttataattaagtccttactagttttgtgagtactaaatcgaagaattgctatcatgtaattctttgaacagataaacatttttgggagagggaaggcaaatctggattctggtagggttgatatttaatatttatcagttatggtttcagaagaagtgaaactgactacagatctattacctatgttaattaaaagaagggagcaaatggcatggaattttactactccttgaaaaagttctactagcattaatgttctagggggtattgctaaattcagttaaaattagtccatggtagcctcgttggcataatagggaaaaagtgaattctccaaagaatgaagctttcaaattcattaggacaaaaaattacctgtcttcctctgggtatttatttttgctacagcttgagctcctctcttagtttcagtgccacttgatagtatggacagataaaactccacggtgggggtcacacacacacacgttaaccaaaaataaaattctaagccctgcaaccaactgaatggatcccccttatggccgaggggattccaaagaaacctgaaaaactagttcaggtcatgaaaggaagtggggaccaggcatgcctcattgtaccttctctcttttggagtttagatacaactgaccagcattaacattaaaacagagatctggctgggcatgatggctcatgcctgtaatctcaacactttgagaggctgaggcaggcagatcacttgaggtcaggagtttgacactggcctggccaacatagtgacaccccatctatactgaaaatacaaaaattagttgagcatgg

SEQ ID NO: 21403 - DNA, 1034 bp, Homo sapiens
cagcactttgggaggcccagacaggcagattggttgaggccaggagttagaggctagcctggacaacatggttatatcccgtctctacagaaattaaaaaaataaataaataagccagctgtggtgatattcacctataatcccaggtacttgggaggctgaggtgggaggattgcttgggtccaggaggtcgaggctgcagtgagctgtgatcatgccattgtaccccagcctgggtgacagcaaggccctgtcaaaaacaaaaacaaaaacaaaacatcttattgtgtatggactgtgttcagggcactaaggtttgctttggagcaaagtaaaataaacatatgttccctgttaatacaggtataaagaaaggcaaattactgtgtccctcatcttaaaaacaaacacagtactttccttcaatcatacatcactctcgactctcctgtctgccccttatttttcttctcatagctgtcgaatcgatttcattaaagatagctgaagccttgtagcccttctggattttctattaaaattcacctaatggtagaggtaaaataaaatgtgcatcttcaccccttcactgtagcactccccacagctgtactctggtttacaagactctcccattctcttgagagcaaattacttgaggttaaggacttagggcttatctgtctttttacctttggaaaatagtgaatgtttaataatgtttgcatctttctgtgagagccttcgctccagcacatcaatgatcttgggcaccaagcaccaagagtcacctagatttgtacatcagaagccaaaatggaatcaaaccatacactgaatgttcagggaatctgtcttatctttatcaaggctactcgtcatggttgaactggtagtgttctgatttcccatgtgagcacgtgtgcccatgtcaatacatttatatatccatagtggacatgtggtccatgattgtcaggaggcatggttttctcacaactgtgggcgtgattaattacttgctagaaagtcca

SEQ ID NO: 21404 - DNA, 1022 bp, Homo sapiens
ctcccagttacaagcgattcttctgtgtcagccccccaagtagctcggattacaggcacgcgccaccacgcccagctaatatttttgtatttagcagagatggggtttcaccatgttaatcaggctggtagtgaactcctgacctcaggtgatctacccgccttggcctcccaaagtactaggattacatgcatgtgccacctcacccagcccactctaacacttgtaagtttatccagaggactcaaagcttgatggcagtttgcttagagctagaaggctgaggtgcgctgggagacatgtttctcttttgctcatttgcacacataccccaggaaggtaggtgaacccttattgagtgagattggatggctggggtcttggtggtgtggatgtaaggaattaaagcacacaggtaagattgttcaccatagggctgcttgtgagccaggcttaccttgcatccagtgtcgctggcctcagagcgggcaaagccagtcttagcctttgtcttctgaacattttaggaaaagttcagtcactcttgacttaccaggtatgttatgtgttatgtctggaaccactgtcatgctttgggaagcaggtggattttatcttgacctcatatgtcctgtgtacttccttctatccatgctcctctcagcacatccagatgcattctcttcttattcacccagctctcagtttattcgtcctcattaacacgaaatgtgggctcactgggacatactcagtggcatctggcctccagttaggacttgccaacttcatctgtaaggataatgctgcttgtgcttttaaaagctaaataagaagtaagataaatgagagctaaaacttgtatagtcataacaacagattatgaaagattgataatatgtcaaaattttagtttatgagggttagccatgttcctttgtgtaacacttttataaattaattttaagaatataaataactggtaattacctattagaataaactgcaagtgaatagaatgc

SEQ ID NO: 21405 - DNA, 1053 bp, Homo sapiens
tcgggagctctgcagaaagacagtcatatagagtctgcttcctgaaggatcagcctccttgggatctctaccataagaaacttctgtcctgaagagagaggcaaatacatgagggtaccaggaactgagggcctccagctttttgcttttagagacttaattatgccatctaacaaaagacgtaatttgagaaatatttctaggcatgttcaactgtgcagaaaatgtctttgtacttcagactagaggaaattaagctgccatctggtatgggatatacaacagcaataaaaaaattgcatgaatattttttcccattttttcccctttgggtatgagtgtggaagtgttgagttttggctttaactattttgtttggggtggagcaggtggggtggaagtagggaaaggagctaactcttgttatcagccatggttaggtcaataatatttagcctgacctttatatcttttatctctcattccttgttttgtattaataaaagttatcatttggagttgaaggaaaggaatattcacaactagagtattgtaagtgtttggctaggttttgagggagggtttagaattttctttttaagcaattataacaagggataattttttattgtgtaatattttatgagcacaaacttgacttgaaatttaatacacttgatattctgtgtatagaattaggttatagaaacagtatggagagttgagaaagagaaaataagtctttgggaagttagaataattagagattagaaaactgacacagattgaagaaaatgggttggtagaagaaagaccactggacttggaatcaaaaaatctaggttctagttatgattttgccaggcacttcctctctgattttgatcaaataaatttactcctacatacaaattaagataatattatctagcgcatgaatttatcatggggatttaaagatgaaataagtgccaatatatatacctcgaagcatgttttaagaaatttttcccatgtaagttacactacaaagattattgtcataatgagtgt

SEQ ID NO: 21406 - DNA, 1064 bp, Homo sapiens
catgtaagtgtttactcttgccttagcagtagttctcattacacgtttctattcataagaccagccctggtcctccagcatttccttttttcgtctcattttattcaaatctgatatcatgaaaaatctaattttacatgaaaaatataattatttcctctatcaacagaatcataaatagaattcatataaattcagatttctctgatgaatcttaagtttgattgcaaggagctaccagtttatttgtgcatttgcaagttttcaggaattgatcttataaataattagcaaactcccctgaccccaaatctatataataactcagaaaaaaaaatggatgtgtttccctattgatccctgaatcattatgtgattgtggttattatcagcttaactgaataaacttagccataaaacaagcaaaacggtcttctgtttataaccactctaaaaggaaataaacacttggcaacatagtaaatttcacaatgtgccatgggtatgaagaaccagtgagatgtattacttacgtaacttaacaaagcctaatgttctagtcaccctttaagtatatgaatctctttccactttattaaaaaaagatatttgtgatttacatgccattttataataattcagtccttataattatgttagaattcactccccagattccagaatttgttcttttaatcagaataggtttgttcaagagtttgatcctggcttagaggagccagctaaattctattatttattcaaaaaagtttatccctttatagtattttcctgctggaatgacaatattattttgagaaacaaaaaacttatagtgtaaaaccttgcaatgcaaagtttaccttaagatataaatattctggccaggtgcagtggcccatgactgtaatcctaacacttcgggaggccaaggtgggaggattgtttgagctcaggaagtcaaggcagcagtgagctgtgattatgcactccaacttgggcagctgagccagaccctgtctcaaaaaaaaaaaagatataaatgttttgtaatataaatttta

SEQ ID NO: 21407 - DNA, 1034 bp, Homo sapiens
acgtgtgtttgtgaacatgagctgtcatctggtcaacttgacagtgttgttttaaccgtcacatacagaaatgtataagaaatgctttgagaaatttaaaatgtcgtcttaaaatgaggcaatataaattaacactcaaagtcaaatacaatcatttagatcattggagtaaccatgaatacagtgggaagttctgtatgatttaatttagagacgatggtaaaaacacatcattaggtctgtagcagaagatttaatcaggtcatacttgatgagttgtgttggataaaataactttttgttgttgtttaactctcaggtgaacatagtttgaatataccatgatgtacatgtgcattttcaaaattctcactgaattcttattttgtgaacttacatgactcttttagtcagtgttagctcaacaaatatttcttggttgcatgttttgtgccaggcattgtgtgaggtactcacctcatttgtatcttgtttgtcctcataggcttgtagttctatatccaaaaatctatttatactaattttaaaacactcaatttttatatcatattgtacctaagtgactttatgtatagaaataaattgatatttactgaaattatagctgcttatgtgtttcataaactgccgtatgctatcagctattaattattacaggacgatgaagcccttgaaccaggtatccattgatgctcttagatctcaagattatggtccatactcaacaacaggaatttcaaaatactgctgtattacatttcacttacacttaaggtctgaaaaagtaaatcctgttccagggcccctagtttataatgcttaacgtttaacgtcacagctgaaagttttgaaatctctttcatgcgtgtgttctcatttatttcttcattactatgaaaagggaaacaggtactgctattcttatttttaagatgaggaaaaggtgtatttttggagacgaattgactcaccaaggtgactcagctgataatctgggggtcaaggcctgcact

SEQ ID NO: 21408 - DNA, 1051 bp, Homo sapiens
aggaggccctcaattaaaagggaagccgtagggaaatggaaaaaggaatgagagagagggaaggaaaggaactgcctcgggtgtggatttcaatatattattagttgttactgtcagttagaagcaaatgctgtgaaactttgcactcattcctgtgtggactggttagcctatgtttcctctaccgcagcattctgagtcgtccacctcaaatatgtgctgttggtcataaagacagactgggcccaagagacagtgtgggtgaaacaaattcattcattccttctagaaataaaatgggaagtctgtcctacagaggatgagccagccgccatcgtctgtacttgtcacatgccaggccagctcgcctgctagcttgggagcaggaggacagcaaattcaaacactggaaaattgcttgacattttattgggaggcattgtcaattattagctaagattgttttgtcttctgaagaattggccctctataaaaaaatagttgtggaaggtgggcttttaacagaaaatgtaaagtctgttcagttcatactaattagtacatggaattatttaacatataggcaataatggctaaaaactgacatgaccatcagctttattttaggatgttttacaaacctatcacaaagcaacaactaattttttgttcatgtatattaattcatttggcctttacctggactaatatcatctgaaaccttcttttctttgaaacattttatgaaatgtatacacttatttttactttattatgtaagcaaagcaattttttattttccgtcccacaaattatgtgttcctttaaagatttgacattttgatgcagcaaatgttaagaaaaggtgtgagataaatgtctacaaaataaatgttttatacagaaccacggggcaatgtactctcaaaattaatataaaataacttgaataggacatattttttttaccaggtttcatccatgtataattagatatatttgtataaatgaaaatacctgtatttttaacatttttcataaggaataatgt

SEQ ID NO: 21409 - DNA, 1031 bp, Homo sapiens
tgagttttgagttggtgggaaagaaatcatggccgaggtgttcaaaaccaagagctgatatgtggaaaacaagcattaaaacagtgtcactagaaagtgacggcggtggaaagttgtccatagagtaactctgctttcagggctccgtgtgaggactgagggggcaccctgaaatccacactggaaacaggcaggcccctttatgaataggagctccagctccatccatggtagctgtgcgtgctcattcattaggccttactggtttgttgtgagtgcagtatcagcatgatttatggcataggcagcctggaaataacatgagcagcacatagcacagccgtggctgtattcatccaacatatcctgtctgttcaaaggaaatgtagaaatctacttcttaatgacattttgtgctgctttttaatttttcttgcttttgaaatactgcattgttcagtactcctgtttgggagtcacttagagtgacgcagtgtcagtcagcccaagacttggtggttatctctgttttgtcagatctgagctgcactcgcctcttttattcttgtaaggattgggcatacaaacgtttcttctcaggaatcaaagaaggctctcatgagaaactgcctccccagcacctgagggccccaccatcccaaggcaggactctacatgcaaacagcatccaccctgaggacaacattctgcacagaaacctctcaaaactacagaattgtcatccacactttggccaggagtactgggaagtagctagaatggagttgagtcaattctcagctcttagaagttctttttttttttttttttttttttaaataatgttctgggaaagctagttacagaggcctttcacaaggacttcattggctacctgtaacctctggcctaagtatgtatttgcttcgtggttccatctcacatgaaattagtataaggtgaacccagtgatggctgcctttaacaagggttagcaactgttaggatggatgtgtggattgactcagcca

SEQ ID NO: 21410 - DNA, 1025 bp, Homo sapiens
cagacagcagtgcatgcaggagagcataagcatgcgtgctctgggaggggacagcaaggagtccttgtggccggagcaggataagcagaggaaggagtgttggcagtttaggtctgtgctggtggggaagccagtgaagtcagatagggcataggggctgctgtaaaaggcttcagcttttattctgaatgcaatggagtcccgtcggaaggttttgaaaaaaggcgtgacattgtctgctttctactgtagaacagaagagttttctgtgcttgtctccagttccttttggaggactaagtgtggctgctgtgttaagcatagaccaagagatggcaagggaggaggcaaggacacaagcgaagagactgcaccgacagcacaggccagaggcagtgatggctggtcccgagtggtagcaggagagagatgggtgggtttcagacgtattttcaaggtaggaccaacagggtttgctgatagattgaagtgtcaagaaaaaaatcaaggatgtctctgaggttttcagcttgagcaactacaaagatggatttgccattttctgagaaggaaactacaggaaaatgaggtccgggtgggagatgaggagaaattaagaagtcgggatttgtttggggactgagaaatttgaaatgtctctgacatctgtgatggatttaattgtgtccccccaaaaagatgttgaagtcctaacccccagtacctccgaaggtgaccttatttggaaacagagtctttagggagataatcaatttaaaatgaggcaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccacca

SEQ ID NO: 21411 - DNA, 1057 bp, Homo sapiens
acaacaggaaggggtgaaatgtggggcatgggggagagcccgtctcagtggcacagtcatctcagcatcagaacagggtggaaggtggagaaccttggggaattggggaagcttgtgtaggtctcttcttctttttttttttttttttttttttttgtttgtttctaagacagagtctcgccctgtcgcccaggctggagtgtgtggagtgcagtggtgtgatctcggctcactgcaacctccaccttccggtttcaagtgattctcctacctcagcctcccgagtagctgggattacaggcacccgccaccacccctggctatttttttctatctttagtagagacagggtttcaccatgttagccaggctggtctcaaactcctgacctcgtgatccgcctgcctcgccctcccaaagtgctgggattacaggcgtgagccaccgtgcccagccaggtctcttctgattgactcattttcctcaatgaaacaggaagcaaggtcatcagctgagagtgaagatgtggagtgggagatctgaagacagagggggaggcatgaaattgttctgttgtggaaacgaagggtgaatggactgggaagggcagcacaactcccaggcagcatggagggctcgctggaggctgtggccatgcactcgtcagcatggctatgccagccagaggggagtggactcggtgcagggctgtgaccaggtgtcaggggtaagctggggagttgagggttttgtgagggaatgatgggcatgactggctgtagggtgagctgggtgagaagagagaccaggacagaagatgtcaagacctttgttgaatgaatgggcaaagataaaaaaaaagaaactgtcatctcaaacagttcaagtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccagag

SEQ ID NO: 21412 - DNA, 1090 bp, Homo sapiens
ccatgttctttatagggaaacttcgttatactgaggtttcagtaaaactctcatctcttgcgcatagcagtctgaggatagagtgagccacatgttatggaaaggggttatacttttccttcatctccagggctggataactttcttaccatgtaccatatatcatcaaaaattcccgttaacaagtaacttacacataaataggtagacttgattctatggattaagagtttaagaactgagaaaataaattttaagaaatatatgctgtcatgttttattgctataatagtatttccatatctaagttggagagtcctaaggaatactataactctagactgcataatcctcctaaaaaattattggttgctgcattggtgtctttggcaaagtaggatttggggaagagtttaattttaccaatcatacactgtacatggcgccagggatacagagaggagaactgcttctccgctgtcccctggggaagctgacagggcaggagaaggcagccaggtaatgactgtagtttgtccagtcaaaccccacaccctctaagagagatgcgcaggcatactctgaaggccagtggggtcacctgagccagccaagagcaaggatgacttctctcttggaagatgagtgggagctgaccaagagaaggtgaaagagggtagccatccaggtagacccaaaagcaggagaatggggttctctgaggaaatggcaggagttctatatgcctgagtcccaggacgggctggtctgtgggatgagggtggtcagggctccaatcaccaaaagcacctcctgtgtcacactgagaggtttggacatcattatagaagtagtaaaagagaagaaagactcaaatagcctgagtctcattcctgtacttggatggagagctatttagtctgaacagctcaattttaaaatattatttgtatgaggcacacaggcaatgcttaaaaggtaataccccaaaaaagtaaaggagaaagggaatgtgtatttactttaaaagttcctgttgttctatctctattcaaaaatgccgtggaatgcttggcttcaagacttgttg

SEQ ID NO: 21413 - DNA, 1090 bp, Homo sapiens
agctagcctcaggatggggtgggtctccagaaaaacctaatgattagagagttggaactttttcagccccacacaccaacctccagcgaagaggggtagaggcagctagagatcacactctctaaaaactcgaacaagctgtgatgagcttctgggctgctgaatatatacatggaggtgctgggtggtggcacatccacagagggcatggaagcttggcgtcctggccccatacccagtcctacgcacctgttcgtgtggttgcttgcctgtatcctttataataaaccagtaaatgtgtgttccctgagttctgtgagctgctctagtgaataaattaaacctaaggaggatgtcataggaaccttgattgatagtatagatgacagcctactactggggactggcatctgaagcggggggttgccatcttgtgggactgaggcctcagcctatgggatctgactccaggtagaaagtgtcagagtggaagcgaatgagaggaaacagagttgatgtccactggagagttgtttggtgtggaaaaatcctgcacgtctgatgacagcagtgttctgtgctgggctgaatgtgtgagaggagaaaaagcactttggcttttcctatctcttaccaaccgctaatagaagcaatgtagaattatttacatgagactgtagtgcatttcataacatgactattccaacaaagaaactctatatcatcatagacagtttcacagctcataaaggcatttcagaggcaagtgaggctttgaggggtggactttccataagtcttgcttggctgctagaactttcatgatgttgagggtacctgcccttgtactaacacctactatatcggcactgtacaaagaacacaccaggccgggcgtggtggctcactcctgtaatcccagcactttgggaggccgaggcgggcagatcatgaggtcaggagatcgagaccatcctggccaacacagcgaaacgctgtctctactaaaatacaaaaaattagctgggcgtggtggtgcgcacctgtagtcccagctactcgggaggctgaggcaggggaatcacttgaa

SEQ ID NO: 21414 - DNA, 1047 bp, Homo sapiens
gttttgtttgaaattgcatgggatgcatttataaatcttgggagaattgtcttcttggcagtattggctgttcctatccattaatatggtttatgcctccatttgtttggatcttctttaatgtttttcaataaagcttcaaaatcttctttataaatcctatacatcttttggtttgataagattaaagtatgccaactaattggataacctagaagaactgggtaaattcctagaaacgtacaacttattcatgaagaaatagaaaattcaaatatagcaatagcaaggagattcaatcactaatcaaaaatctcccacaaagaaaagttcatgtccagatggctttactggtgaattctaccaaacatttaaagaagaattaaggctagtatttctcagatgcttccaaaaaagttgaagatgagaaaacagttccaaactcattttacaaggccgatattaccctgatccaaagccagataaggaccctatgagaaaaaggattaaccaatatccccagtgaatgtagatccaaaaattacccacaaaacactagcaagccaaattcaacagcacattaaaaggatcatacaccataatcaaatgggatttatccctggggtgcaaggatggttcaacatatgcaaatcaataaatatgataccccacattaagagaatgaagcatataaattatatgatcacctcaatatatgtagaaaaggcatttctcaaaattcaaagtcctttcatgataaaaactctcaacaaattgtgtatagaaggaatatacctcagcatatatgaaaggccgtatataaagtttccagctaacatactcaacaaagaaaagctgaaagcttttcttctaacaagacaaaggtgcccactctcaccagttctgttcaacatagtactagaaatccaagccagagcaattaggcaagaacaagacattaaaggcatccaaattggaaaggaagaagcaaaattgtctctgtttatatgtaacatgatcttatatatagaaatacctcagagactc

SEQ ID NO: 21415 - DNA, 1115 bp, Homo sapiens
ccatacatataatcagttttgtctgtagttataatttgtccataatttgaaaaagagaagcctaaaaagttccctccagacactttcagctaggaacaaacttttatgtgaaaataataaaaatgtggggagtgaaggtttatagtggaaatatttacagagcctcaaacactgcacaacagttcaaactttgttgtagtgccttcattctttttgctgtcagtttgtttttcttctatctttattccacatacttctggtataggtttaataaggatttttcaaaaagataaatatggtttatattttcccagctcaaaattccccttcaggcctctgaagcaataaataatagtgctttgaatgctgcactcactttcctgggcaagccattccggtagtggagggttctcagagcgtcagtgtaacttctgcacactctgtaaagcagcttttttctcttgcattctggcctccagatggagatgaacacttgaaattatttctcagtagaattgaaagaacttttttttaaatcaaaagctcagccttcagtaaacaacttttgtttttattcttccaagaaccagtgcagcttgcacttcaagtgcaaattctgtgttagctagcactgtgcttcctggcaaagttgttcctgcattgtcagtgagttgtaggttatgttttggattcatttgttatgtcctatttgagactaatttaaaagtattacctagtgaagtggagtattctctggtttccaaatttaaatagggatgctttgagaaaatgtgatttatatacaggcgaacagtgactccataaaagtcactgtcgtaagtattccagcgacccagggccaagtttatacagaccctgcctgcattttaccaaccatctgtggttttacaagagagaatgaacaattgcaattagcagcttatccagaaacttccttttaaacaataatttctcttcactagattaatttcaaaagatagttgccaattagccaaatggtcactttcatagacatttctcatccctgtgctctaaataaacttgctcattagcaatgagaacatttaaaggaagagttaaagttaaaagatgaa

SEQ ID NO: 21416 - DNA, 1033 bp, Homo sapiens
tggacccgatcctatgggcacctggaaccaaaagactccttagtaaggcattggcacgaaaacagtttggcagagttgcataggatgtttgggaataaggaagagctgcggaggatgcttgggaataaggaagaaaccaggaggcaaggagaccaagcagtttgtttctgtgtcccttaacaaacatgcacttacccgagcacatactccctactctgagtgtggttgaatttctgtcttgctcatttttgtttgcttcacatgtagcctataatacttagagtactggagtactttagtactcagtgcgtgcttctaactgtgggatgttcagagaatgatcatggcccctggcctgctgcagagcgggaagacactgtgagaacgccagccagctccacttcagtttctgcttcagagttgcttttcccctccactcatcagatcgtttgttgagcacctactgtgtgttgggtgttatgctacccagtggggattcagtggtaaacaggacatcgactctgtccagaagtggatcggagcttctgggagctgcgtgaccgcttgtcagggcagtgacagatgtgtatgggtatttgggagcacagtgaaagcgcctccagtcgaggctagtgatgaggcctggtcagagaaggcttcctcgtcattggaatgtttgaagataagtttgttcctctagttcctttagaaaaatgcaaattaaatatggtactgggtgtggtgtagaattgtggttgccttacctgaacgcttaccatttgagcagttagctcccggggttcttcccaggctggtttttctagtttcatcttcatgtagtgcagtgaattccatatagagcaagagtctcttccacagtaggagtttctccctaccctgtcagggctgctcgcgacagccgtctgggaaagaccgtgagcctcacagcatggcccagggaagagtccctgagtgtgcctggaccaagatgggtcactagagtggtagtattgtctaattcctaggctaggag

SEQ ID NO: 21417 - DNA, 1050 bp, Homo sapiens
tgaaagacagccagcaagaaggcagagcgcagagtcaggccttgtcttaacagcttggctgtgggagctatgagccacttcagaacatctcacgcttttctctcttttcacccatctgacttttattataataacctttcattgtgggcagtggtgtaaatttgagtcttggttctgctgcttctctgtcatgtggtatgactgtaggcaaattaccctgtcctctctctgctcatcatgttgtcttcctttataaaatgggggtaatagtttccccgtcactgggctgctgtgaggcttggatatgttgggtattagacatggagtatttgacagatgtccactgtcattagtactaaaggaaattaaggtcaagaataagacaccggcacagttgctcatgcctataaacccagcacttggagaggctgaggtaggaggatcgcttgagtttgagaccagcctgggcaacatagtgagatgctatctctacaaaaaccaaaatcagttagtgacagtggtgtgcttctgtagactcaggtactcgggaggctgaggtgggaggatcacccaggagttggaggctgcagtgagctatataggatcctgccactgcactccagcctgggtgacaaagccttcttttttttttcttcttctttttttttttttttttttttgcttcaaaaaaaaaaaaagactgacttaaacagagcagtctaagacctttgataatactgtatctctgtagcctgcgtgcttttagaaagcattgttaaaatacttttagaaagacttccacaaaactggtaagcctaaagaaaagcaagctcctctcaccagactaattcacctggtagaccagttctgtatctaagggactgaatggagaaactgttaccgtaatcctctgagattagtgtgtgtagggagaggctgtgagcaaggatgtctgccccatcctgtgaggaactgtaggagaaatgagaggttgtgttgctgcacacactcatatttcccctgtgtcctgggcacccctgcgttcactgc

SEQ ID NO: 21418 - DNA, 1031 bp, Homo sapiens
tacaggctaaattgaaaaggaaatatacatgatggtttgcttagtaatattaaaatgaataaaaattaaagttgggtatgttaatttgtgtaagagtaaattttaaaatcttctcactgttgatcatataatgttatgtttatatttacctaaaattttcatgagtactgaaatttttagtacaataatttctaaattcagactaaggctatttgactaaagttgattaagtttgattaagtttccagtgttccatataagaattttccctgagaaaacatccttttaaagccacttatttgttgatgtagttattaaatgtaattttaaactggtttctatgctgaactgtggtagttataagttgtgttatgaacagcaaatactagaccgatcactcaggataagacataacatgggctgaccttcccagtgtggactgaagcgtgagagatgggaggttatagacactggtgcagatactgcttttccttggaattaagtgatgtcaggtttcgtggggttttctttttttctgataatgataacaaaatacacaaataggattattttgtatgacaaattgcatctttgttgtttttgcttcacatttatttgttttatttacaggtgttgacttcaaaatcaaaactgtagagctaagaggaaagaaaattagattacagatctggtaagtgggagagtgtgcacccagtaatgtgctgtgtgtgtttaacagtccatgtacttgtctaataaaatgaactgtttgagctgatttgcctctcctactttctcctcttttgctcattttaaaattaaatggacagtgtttccatcaagagagagaatttagataaggctgttatgttatatgccacttgcacatggggagcagttgtggacagaagaatgttactttaatggtagctagtttggaacctttttgcctctattttcaaattatttacgtgatatcaaaactgtctccactaaaatgattgctcaaatgtttgtcttcatgtctttat

SEQ ID NO: 21419 - DNA, 1050 bp, Homo sapiens
gggtgggcatactccttccggctgtactgctgattccacgggatgtgagcccccactaatgcctactagaaatgaatccaggcccctttctcaaatcacaattggaatgagagactcaaccagctgtgttataactgcactcagcactaagagctttctgttagctattaacctgttaacagcccgcaggtgctagcgacctgtctgtggaagaagggataagatctggtctggtggtctggcggtggcttaaaagtagccccattgaggtgctctgagaatgccgttttgttttgaatgctacagctgcggtgtactcagcttactaactcctcttggcaggtcaccctcagctctgattgtttgtccaccatgtgtgtgtttgctttcatctgcgttaattgctgcttcatctgtggcatcatcggtcacctaatgcttgaatgttagtgccatgtcttcattcttcatccgtgtccctgtctgggccgcagctgcagccaagccgcagtgcctgccttctggaggtgtctgaggtaatatcttcatttggtcacccttcactgtataacacacttctaagattttttgatttgggtttttgttcgttttcttttctgttgtgcatttggtctgcatattttcatttttggcttgattatgaaacattaggtcttgtctaaatacttgaataaacaacaaatagatatttcttcctgtgctagtcccgcagactttttgtgcattgctgcccagcttttaaacgctggaaatggcaacaaagtgtttggcacacaagctgctgtttctaattataagctctataaggtaaagaccatcttcacaaggatttgggatatgcctctctctgttcctagtacctgtgtgaggtactttctgatgagaatattgccccacaaaagtgatgtaaacattattagaatgtgtgacgcctgccttggtgacagccatgcctgatgactgtggcacatgtcttaattaatgcattaatacttccatcttcatctttggcggcagtattctttataa

SEQ ID NO: 21420 - DNA, 1031 bp, Homo sapiens
aaaagagggaaatattaggattctgccttttcatagaaaggtgaaagcatgatcagtgcattgatgtaatctaattttctgaaaaggagagatttgtgtgggatttttatggtgctggcacacggtagatatttaagaaatacttgctgaatggaatcaacatttcatttattattctttggccgtacctgatagtagataatttagtatgtaagggaaataaatcaagcaaaggcacttttgagaggaatagaaaataaaagctttctcaacccaaatattttgggagtgtggaatcgtctctcaaagaaacatgcttttctacccccagccttcagagccaggcccaaacagtggcatttaaggaatgggcttaaatggggagtgctgaactagttcatgtttcctcattgggatttttgtcaactaaatcagtttgctcatttgcgttaggacgattgcctcaggttttgaattttgaggtttctatcctctttctttacattggacttaaagtcagtagaggcagctgacttcttaatggtgagcttcttaatgtttctaagattcctgagtatgctattcatgcaaaaacattttaagctacatcaaaattgccttttactatccctgttctttgattgtttttattaaaactcctattatctgtaatttctctggttttgtgcctccagtttctggattcttaagtcattgaatgtgaatggaagtgcatgtgagttgacttatactgaaaaccagattaaaattacctagaataaaagtttattaaagtatgtaattcctaaaatgcttattgaagaccttaaatctgattgttatttaaatttgtggttcagcgatattgtgttaaccactgatttcagagtagaaaaaatgcttattatttttaactttttaaagaaatggggaatgttttgtaacagtactcaaatagcacagaatatttttcaacattaaaaacatttgattgaatcctaatttagacaagccataacttgggaggatgg

SEQ ID NO: 21421 - DNA, 1047 bp, Homo sapiens
attgtaacagcatggccaaggggtgtttctagggacccagtcccacaggtgcctaagggaagtgttctcctcccctttcaggaactccctgctgtgtggtgagaggctctggtggccttgcatggaagagcctgttgccccccagcttactccactgtggcgcacttggttggggttctttgggtaaagctaaatcatagatggtctttaaagaaatcgctttgcaagtgttagtccttcctgattggaagccttctccattgagccttattggaattagaaatttgcagtggttctcagtttctaggcttatcataatataagatataaaccaaaaagtatctgagacaggtctcaatcaatttagagagtttattttgccagggctaaggacacacctatgacacagcatcaggtggtcctgacaacctgtgcccaaagtggtcaagagtacactttgcttttgtacattttaaggagacataatacatcaatcaatacatgtaagatttacactggtttgatctggacaggtgagacagctcaaaggggctggggcttccaggtcataggtagatttaaacatattctgattagcagttggttgaaagagttattatctatagaaagcaatgtctgggttactataaggggttgtggagacctaggttttatcatgtagatgagcctctaagtagctggcttcagagagaagagactaaacgtttcttaccagacttaaagtgtgtgttcatgttcatgctggagggtagagtgaggaatgtctgacccccactgctcatcatggccagcaccagcctttcaggttaaattttagagtgccctggccgaaggggaggtccattcagatggttgtgggaggacttcaaattttatatttggtttaaaaaggagaaacagggctcagctggcatctgtactgattgatgtgcttacattcttcatgtggatgtggccagtgtcagcctggagaaaaaagaacgcttttagatttcaaaggagcagttgggtaataatgaactttac

SEQ ID NO: 21422 - DNA, 1050 bp, Homo sapiens
catgtcactgattgcattccagcctgggtgacagagctagactctgtctccaaaaaaaaaaaaaaaaaaaagtaattgggacttattgatgtttttgtttgagtgtaacttgttcagaaaagctactgtggctgacagtagtggctgtgcacggatgtcagtgcagacttgaggagcttccagtggccggacccagacagaggcattctcaagagctggctctgcttgtctccacagactcagtgctgctggcctgactgtgcctgctagggttgtaactgtggatcttcttttcttcctgaagtggtcatcgtaagctgccacatgtgccccacgcctgcccccagcactctaggtggtggttagtgagctctgagaaatgaattctttgtggcttggagggcattcattttcacaatcctaggatgcccaccatttattgtgtgtgtgagcggggagtgggtcatgcatgtgtatcaagtgtgtgtttcttgtgtggcattgttgctcttgggtatgacaaatggttttgtaaatcacctacaatgtgaattcttagggattgattgtttggaaactctgtattttaaaaacttttcccccattttattttaggaaaacatcatatattttgatgttatattagcattcctgttgctgattttctgtcttgagggaaaaagttattcaggagagtatgttgatcttggttcataatccatctccattaatctaatttagttgttaaatataaaggtattttctatgtcatagttttagtcaacctaaatttttcctactttctttaagtgtggtcatcaggtcaaagggaaataggggttactctcgttcttttttcgcagaaaaactgcagcatataatctatgtttgcattggaatgtgatggtgctcactttgggcattatttgggaactgactttggctgctttttcttagggacacagcaggtcaggagagattcaacagcattacctcagcttattacagaagtgccaaggggatcatattagtatatgatatcactaagaa

SEQ ID NO: 21423 - DNA, 1028 bp, Homo sapiens
ttgtaaagttaaaacggatttttttttgtttgtttatacgttagatgcctctggatattttaaggaatgagttgtccaatagtatcctgtcgttacaaccagagcctgagataccgccagaactgcctccaccaagaccacatgtccgatgctgttgatttcctactttggagacaaagtggaaatgattcctggaaaggggaaaaaacgttctattctgcactacaatcattttgacaatttcctttcgcactttgtaatccaagtcagagctatacactaacttgtaaatatgcatatatgcaatcctgggtaagttttggttataagttacctatttccctccaaattattatatttcattcattaccccagtgtctagtgtacatacactgggaaacctagtacttctaatatgaagaatgggagaaatgaaaggtataatgtttcttgaaataaataatataattgtccttattaattatattatgaggacagaagatattctgataagagagaacgtggtgctttgcttaccgttttaaagaaaatttgtaaaactaaagactttttgaaaaaaagctatcttaagtgctttttctttatttacaagacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaa

SEQ ID NO: 21424 - DNA, 1079 bp, Homo sapiens
gtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatgaagttgagttgccatatttatttatccaattataaattgtatatatgacagtattctccatgagctccacagcttaatccttttgagtgtttagacaggaaaagcatagtcctccactggggaaaagagtttgatgttttctcaaagggctgaacatagagctaccatatgatccagcaatttgacttctaggtttatatctaaaagatcgaaagcagagactcaaacaggtacttgtacaccagtgcccacggcagcattgttcacgagagccgaaaggtggaaaccgccccaatgtccatcagcaaaataatggataaacaaaatgtgtgttctacaaacaatgggatattcatccttaaaaagaaaggaaatgctgtcacatgtgcagcgcggatgaatcttgaagacattacgctgagtgaaataagcaggcccagaaggactgatactgcctgattccacttacatgaggtatatggagcacccagattcatagagatgacgtagaatggtggttcccaggagggcgggagaggggatgaagcattgtttctgggtgcagagtttcagctggggaagatggacggtggcgatggcagcacagcagtgtgcagggacttctttagtgccactgagctgtagcaaactggattgtcgtgtcctccagaaaagatttttagttcgtgtatatgcctttatcagccacagtcgattacgactgctggtgatttacctaccctcacctcccaccctgcccttctgtgttctgctctgtgatgctggggttgggactcccaactatatttgccaaaccctcttgctcttcctgttaaaatctgctgatggagagctagaagttggcaggagggaagaaggggcttgcttgccatttttccgttcccatcagcctccctggagca

SEQ ID NO: 21425 - DNA, 1024 bp, Homo sapiens
tacctaggataaacacatcttcaggagatttctttttgttcatttttttttttttttttttttgtctgaggctcggatgttgggcaccttgttctttattgttagtcaattcctgtttttaagaataaatacaggattagcatgagtggtaaaaatccaggaacaaagggaatagcaggacgagaatggacaattagggtgtctgagtataggagagatttttttttcttgaaccttaatattaattgaataaagtaaatgggaataactgagtgcatgctattctggaggcatctgaaactatcaattatgaaactagtcaagaaaatccctagaatgtttccttaatcttcctccttccaaattgttcctcctttaaatcttgtgtaacccttcagtagagtgaatatctcatacctgcagctacatctgtgggtttgggaagaagctttcatcactgggctgcaagactggaacaaagcgagcgtgcagttgtgtctgatgttagtcgcctttctgacttggtgtttgtaagtgttcactggcgcacctgtgtattcattcagcaatatttattgaggacctaccgtgtgctccatgctgctcgggatgcagagaggagaaagacagacaagcttgctcccctctgaagcttaccttgttagtgtaggtgacagacagtaagtaggaaaaaataccaatactattagatggcactcagaggtgggaagaaaatagagccagcaagagactagagactcgggctgatgagggtggccaggggaggctttgcatgacgtcagattatgtgatggaatgagctctgcagagatctggagcggggagtgttttcagaagtgggaatagcaggcgaggtcttgaggcctgaagaagcaaaggtgcgagcagtctcagaccctgtgctagtcgtgggcagggagggagtgtggccaggaggcctggaaagaaggaagcccctggagggtttgagtagggagtgaggtggtctgatttgcacattaaa

SEQ ID NO: 21426 - DNA, 1054 bp, Homo sapiens
atctgtgagggaggagggttatccaaagtgggctttaaaaacaatttatttattttaaagccatttaaatttagcagtttgggggggttggataccaactttagtgacactaaggttagcacgttctgataatgcaccaccatcagaccagccagagtggccttttagcccagatgttgatttcatttttaaatgaatctcctcctccttttaacaataagtcagttgtgtattgccagggtctttgctatgtggtgtaatatattacttaatgattttgcctctgatgttgtctgatagtacccttagcacacaaaaagcctcatatcctgataatgatctctgtgggtcgatgcaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagaggtaatccaaaactgtgggggtcctgcccccttggatttaataaggaggagcttggaactccaagtgcccccttctcattgtggtcgaaagctggggttggcaaatcgtggcctgtttgtttggctcataagttagattgtttttacatttttttcctagcgtggtaaacaaacaagcaaacaagcaaaactcacaggaaagaaagcccccaaaagcaaagaagactatggattcaatactgtgtgatgcttgcaaagcctaaaatattttctatctggccctttgcagaaaacgcttattgggccctggtctaaagctagtttttgtaattaccactcagatgagctgaccattaattcctttgatgtgtccaagtggagcctattattgctagaatacagagttaagaagtagcttttttctccagagtcttctccagtgagctggaaagtatgttatggttgtctgttaaagctgtgtaaacagacaatgtatgtaacaccacctgtgtagctaaaatgagttaaatatagacat

SEQ ID NO: 21427 - DNA, 1055 bp, Homo sapiens
gaggtttaattgactcacagttccacatggctggggaggccttaggaaacttacaatcatggcagaaggggaggcaagtccttcttcacatggtggcaggaaggagaagtgagagctgagcaaagggggaagccccttataaaaccatcagatctcctgagaactcactcactatcacaagaatagtatggaggaaaccaccctcatgattctgttacttccatctggtcccacccttgacacgtggggatcattacaattcaaggtgaggtttgggtggggacacagccaaaccacatcaccgtcgtttcctttatgctgactatttcaaagcaagtctcagatacctacacacgtgttatttagtacttctgaatttcttatttttgtatggaaaatgtaaagcatataacaaatggaagcagtccatggtttatacagttttcccttaacaaagctcacctttagggaggaagtgtgacaccaataatatgactacaataatactgtggactttgaaaacacatgcaccactcatggacctgtatgcctttgactttcactttgaggttggcaatagaagttattactgttgcttttctacttatcacaattaaaactgtatcaccttattaaaactatttagaaaatttgaatgagttactttaactacttgggaaaattgagtaatttactttaaactgcttttggtggagctgcagatggagaagtcccgtgtggaggagctagagaagatagtctaattgtgattcattgatagtttcctgttccttagtacaggacattgttctagctggctagtaaggctgaacaatttttaaatgacatatccacatgcaaatatataacatacgtaaatgaattgataaatgtaatcacatgttacatattggcattttatgttttccttttctttacttttccttttacttgcatgattctgtctttcccagcacagtataggtccagtcctaagcacagaaggtcttagtactacagataaatatattagtttactattgatgctgtaacaa

SEQ ID NO: 21428 - DNA, 1044 bp, Homo sapiens
agttttctgcaagactgtgttccttctggaggctctagggaagaatccattttcttgctcattccagcttccagaggccatctacatttcttggctcatgccctctttcttcatcttcaaagccagcaatggcgggctgagagctttccctgccatttgtctggtgctctctcctgactccctctttcatttttaaaaaccctatgatggcattgggtccacctacataatgcaggataatctccctatttcaaggtcagctgattagcaacctctactccctttgccgtgtagcatgatacagtcacatattctgtggatcaaggacgtggatatttgaggggcattattctggctactatagtaggaaagcaaaacttcagagctggtgaggttggagttcatttattctgtcttacatttgcatagttgagaaactgaggcccagggcataccatttattctgcatgactggatacttccaaatcttcatctaatcctaggacggccctttgaagtgggcatttttatatttcatttttatatgtctttaagataagaaaactgaggcttggagtagctagcaaacctgccctaggtcccatagctagcaaatgacagagagctgagtctcacagctgtgactggcagctgcccgggcccactggcaccctttccgccgctagctaggtgcatgcggttagctgccaggtctccggtttcccggctggcattcttctcctgttctcccattctgctcactcacatttgcctccagtgacatgagtaataatacattttccagaacttcctctttgaaagattgaagtatcatcggtgttatcaaaccttttcaatttttgtagcttctgacttccttctttaagggacactgtatattcttcatccccttggaacattaattttattgtgttactcagttcaaacacatcagatttttgtggaaattctgagataaaaacttctcctggttttcatttctcaccctgcttcctgctgcttcttgtgactacgtcccatatt

SEQ ID NO: 21429 - DNA, 1041 bp, Homo sapiens
taaggaaccgccccactgttttccacatggcagcaccgttttacactgccatcagcaatgcacaaggcttccaatttctccacatccttgccaactctggttattttttgttcggttgtgaggacttgaggtgaaatatctaaagtgctgaggctacttaaacaggggctgtcactcttatgagcattgtcattctttgaagtgtggagagggggaatcccatggatttgaatctagaaaccctggatatgttaaagtgggcattttcttgtcctatgtggagtaaaaataagatagaggataccttggttttccttcttgcacggaagccttctctcgagctgcactgtggtgtttgcaaaccctgctgacaggggcccctgcactgctccccatctcctgcccatgttggtgcaggagagagggggtctccacaatgtgccagagctgggcctgggcagtgatggatgtggattatggatgtgggattattaaacagataattatctcattatatcaaacaacagtcatgaatatatacccgaggaccgcgtgcacctacaataaatgcaaaaagggtggtaggagtgggggcagttctattctcaaagaaaggagacaaaagtggaatgggacagggaagcccatttaagatttagctggagaacctggactgccagttccgtctctccacccacactgagcatcgtcacctggggcctgggtatcgcgacgatgctcacccttccgatgtcctgtgttggcccggctcttccaggtggaaatcagagatggtcagctttttggagagacaggtccagagcccacaccatgcctcttgtggtctggacaccactggtccacacaggtactgactctgtcttttctagtacggctgcaaccaagggcccacccactgaacggcttcagaacctgaagcttattctttcacagcagtggggactgcagtccaagatcagggtgcctgcagggcatgctatctggaaaggccctaggggagagtctgttccatgcctggtg

SEQ ID NO: 21430 - DNA, 1017 bp, Homo sapiens
tgtttttcctgagtggctccagatggatagcctcagcagccctgcacaggctcctgtcctcattgtgtcctccttgtgtgccccatgctggagtcccactggcaggttgtgaggagagctgcctggttgtcacccacacacctaagctctgtgtcctacctccaggtcatgttggtgcccctggtcttccgtccccagaccatacccctcagaactgcttgtggccgcctcacttggggctctgcacccctgtcagctctctccctcacacagtttcctggttctgccctgttgctttctagtctctctgcctgcactgaactgaggtgcccagacctcacaccaagccggacccctgcccccatccctcccctgcagtcagttttgcacaaagctgccaggtaggtcttcttgaagaggcctcacaacactaaatatattcgtatattagtaggtgccaaggcaggaggatcgcttgagcccccaggaattggagaccagcctggacaacatagtgagacaccatctctaccaaaatttaaaaattagccaggcatggtggcatgcacctgtggtcccagctacttgggaggctgagatgggaggatcgtttgagcgcgggagatcaaggctacagtaaatgataattgtgccactgcattctcacctgggtgggtgacaaagcaagaccctgtctccaaatatatgtatgtatgtgtatatatatatatgcacacacacacacatatacacacatatatatattctgaatatatatattcgtgactccccgaaataaattcagtttatatatatgtaaataaattctgaagactctacatgtgtgtgtatatatacatatatatttttgtattaacgttaatagtaatattaacatgagttcagggtattagccagttctgtctttcgggatgaagtcactggattgaggcaagacttcagtgaaggaagccatgtggtttgtaaaatgaaactgacaggggacctttgtatctt

SEQ ID NO: 21431 - DNA, 1021 bp, Homo sapiens
ctcttgtctcagcctccgagtagctgggattacaggcatgcaccaccatgcctggctaattttgtatttttagtagagacggggtttctccatgttggtcaggctggtctcaaactcctgaccttaggtgatccgcctgcctcggcctcccaaaatactgggattacaggcgtaagccaccacgcctggccacacccactcttctaatccctcaggagttatgccagatctaccaccaggagatctttccactcatctagtcatggctcactccttgtttcctaggtggaaataatttcacacattttcttcttctatggatttcaacagtgtccttcacctggggtttccttcattcataggatttggggtaattaaaggcaaaggatacagtctttcaggttgattaatctcacctgtgataagcatagtgcttctgctttaggattctaggtaggctccagaacttgataaatctaacatagcctggtcttgcataagttgtgtgactgcgttcctttgtgctgaagttttcctgagaaaggtttgtacttatcccatatttgggcgctttctcatctcccaagggccccggggacttcagtaattgtaaattcttggttatcaggagtttgcgatcagacaataatgggtggcacaaggaaacaaaactattgttgcaaattctgctgatacccagggaaaccagatgacaagattcaaaacagagatgagaggaccaaatatacctatcttgcagatttctctaaaaaattcctccctttccccctccacttactggagttagtgaaatccagttgaaacacctcctccgaagtttcagtccaaggtagtgacagtagaggggcagaaggacaagaggacagcagggggtgtggagagcatcctggaggaaaacggggatgttgttactgtttgcaattctgcatttgcgatcacactttgaagaaaattgcctgtgagcaaagtcttcgtgtggaaagacttaagtagcagatca

SEQ ID NO: 21432 - DNA, 1048 bp, Homo sapiens
ctccattccttcatgggaacaacaaagacctgtctatgtatttggatttcttacaaatctgtgtttaacaaaaattgaaaaggtgcttgtgtttgctgtacttttgaaagttctaagaagctggggttgtttaaaagtaacatgccaacttctggtacatactaggtacttaataaatatttcctgaaagaatgaatgaacaaggccaggtgtggtggctcatacctgtaatcccagcactttgggaggctgaggtggtggatcatctgaggtcaggagtttgagaccagcctggccaacatagcgaaacctcatctctaccaaaaatacaaaaattagctgggcatggtggcacactcctgtagtcccagctactcgggaggcagaggcagggggcaggagaattgcttgaacctaggaggcagcggttacagtgagccaagattgcgccattgcagtccagccagagtgcagactccagagcaagactccatctcaaaaaaaaaaaaaaaaaaaaaaaaaagaatgaatgaacagataaacgagcatgcttttcctctagtattagtattaaacacaacgtatgccttttacagcccatgtattctgtgtaggttctttcaaaaaatacgtcattaccccagcagcgatgatagcatagcccatttgcctcagtagttgtgagtagggcagacagccttacttcaagttagtcacaggattgctttttatgtctacctaacccaaacccaaccaaatccttcatgtgataagttctcagaactcaaagaccatgtgacatttatatgttattctcctaacgtgcaaagaaggaaaaagactctttaccggctcctttacccaatactaattgtgtttcagacaaataagaaaattaatttcagggagctagagcatggtgatttatcatacacaaaccagtttatatataataaatacactttttaggtttatgatttatcatatacagaccattatttcatttgaccctcacaacgacgttgtggttaagtgagcattcctgctt

SEQ ID NO: 21433 - DNA, 1032 bp, Homo sapiens
tagtacccaataggtaatttttcaacccttgcccctctcctcgcaaccccttttggaatacccagtgtctgttgttcccatctctgtccgagtatacccaatgtttggctcccacatataagtgagaacatgcggtatttggttttctgttcctgcattaacttgcttaggataatggcctccagctgcaaccatgttgctgcagaagccatgatttcattcttttttgtggctgcacaattttatgtaaatacaaacatccatccaaagtatcttaaattcctcccatatatacttaaccatttttgtgtatgtttagtggatcaactagatggatttagaagcatgactgtggagtgaaggccagtgtgtgtgtagaacctgaaggaggggtcccagtgtacttgctgaaccagggaggagaggtttatcaagtttgggggatgaggaattctgagagggtggggctctgtttttccatagtagagcttatctatgtccagtgggacttagagagcttttataactcttgcttcatacatgcaccaaaaaagaatgccctgagaccgccctgagagcttgtgatgtgctttccgtgctggttggaagagatgggctcacgaggcttttattatcaaggtaccataattgattcagcgtgtttcattcatttggccaaacccttctgatataatgcccttgctgaaatgtactaagacagaaatcatggctttgaaatttgacttcaaagggctgggcaggtttcagaacatataaaccattttaagttagatataagcagattagtaataaaaatccactcttcatttaccagacacatttgcatgcttaacatgagccaaggattgtgccaaatactggaaatgtgagggtgggtctggcttgtcctttccaagaggcagaaaagtgggggctgatagttctatctcaagggaccacaataaagccttcctgaacaggttatgcatttcacctttggctttaattattaaacatcaaaatgtttaataa

SEQ ID NO: 21434 - DNA, 1050 bp, Homo sapiens
gtggccgtatgaagttccagccacaaaagcagcagggagcatgaagcatagtctccagggccactgttccttttctgctgaccccagagggaggcagggaaaccgctcgccccattgctcttctggaagcctgtggctcccacgctgtcctcgggccatgctgtctctgccgtgttccatcttctcccgagtgacactgcccattccgtgcagccgtctgtccttcccccgctgctgctcccctgcaccactggctgggctgtcctcatcctggtcttttcagttgcttgtcacatctttttaaatcctccaactcacttcctttctttgagggtccttgttctctgtcatccttcctgtgccttccattcagttcacctcaagcttccagtgtctgagtgtcattccagccagcgggctccatgctgggcaactcagttttctcatgccacagctttttacatttctgtgtatcagcaaattccaaatttgggtgtcctggttttgtaacatgtaaggacaaggagctcaacattctttaaaaacaaagtagcttgagaataaggattctaggtgatttgcacatggttgagtgtgtcttgcatcacctgctcgcagaacattaggatgcctgaaacacaaaaccaccagtacattctgattctacctttttaaaatgctgctgcaattgaacagtcattaaagaaaaccagacccaaattaaaatttctgcctgcagcatttttgccatgttgtgggagtttgtttaagctactcccagtcaatttcaaataaacagtagcagagttcgtttaagacgactgccattgctaacacagctgaatgaaatcagaggtctctttgtgggctcccagtagatccaggccctgtaggaccagttcacttgtccactgtagctaaatagatcatacaaaagggccaaatgaacagatctaccagataggaatatgatgaagtggcctgtggagaccgctgccacagtcactgtgtcatgccttctgtataccccagcccaattctaaaggagct

SEQ ID NO: 21435 - DNA, 1039 bp, Homo sapiens
ccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggcagcatgtctc

SEQ ID NO: 21436 - DNA, 1118 bp, Homo sapiens
ttacggctggagtttcagaactaatttagtaaaggattgaaaaggaaggaggatacagttgactcatttgtacagagtatatgactcatttgtacagaatgaaaacatgtttatgaaggttcacactaagtgaaagctggcatccaagttgattcagacaaaagtgaaagtcaagaagttaatagtacattaattctccaaatgcatgccagcagagcgtggcaggaaggtacacaagtcagcagatctgggttgtcctggttctcctattgactcgtgtgtgtgatgttaggtgggtgaatcttggctttgaatctccatttgtaaaataactctcctgaaatagagatggatagggtagaataccatatttcttaagatcttttataagttgattccattgttgtaaattatgaatcctaaagtatttctttatgaaaaattttttaaggctatgatttactaaactttcttaaaattttaaattttagggaagacatgtaaggaatttgcataagacagttatgcaaaatggagctggaggagctttatttgtggtaagtaattacttagatttctttggaaagaaaagacttggaaattggggtaaatccattgtaaaaatccaaaatatcttaaataccattgtctttgatatatgatggtcatcgtgagaatttacatacagctaattgaatttactacatttcaaaagatgttggttccagttgaacctcatgagtttaaattagtatcaggaaaactctgggaataagaatttatttccagtgaaattactgtgtgagccctaacctgattctcatcacactttgggttctcagtcatgttggcttactgagagtttggagattgtaacttgttgaatcccaaaatgacactagtttgaaactcatggattttagtaatgtagtaactagattagcagctggtctttatatttttagtttccggagttttaactataaatagaagtctgtgaactccccagattagttgcacaatttggaaaggataagatattatatctcccttttctgacaaggtgctgttttcagggattaatctagtataaaggcaatatagtggacttgtgtgat

SEQ ID NO: 21437 - DNA, 2191 bp, Homo sapiens
ctttcaaaagagtattgtgatatgaaatagaagtagtgtgctggattctgggagaggagtgtgtgattgtgtatgataatatgtgtatacatatatgtagagatataaaattttgagtttacatatttaaaatatgggccaatagtgagctttgattttcaacctttttttctgttgctgtaccatttgtatgtaggctgtttggaaaaaattggtgagagtttaaaaaatctaattgcttcttttattggggtttggccatcaattttttgccatttagacagattataaaatgtgagttgacatgatcaaagtagaaattcttaatagtgaaatacttaaagatttagagaaaaagaatatccttttacagaggtgagaagtagggtagaaggaggaagtgctgttaactccattaactttcgggctctgtatggtttaagtgtaagtacattgtctgcaaaaattgaagagtttatatctcccagttatccaagacaagtatgttttctgctcttgaagaacttttctgtttttaccaaattgagacaatattgaaattatactttgtacaacataattaaagctccattactaacactgtaattatcttatttttaaatgtcctaatattttaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggtagggaatacatgatatttgtaacactgataaaaagtagaattgtctctctagatttggtacatttctatctaaaatttccaacttctgccatcttattggatctgtacttacctagtaatattttgtgttactgtgtttccacatctttatttcttcctatttggtattcttcctcagttcttagtgttaaagctgagtttttaattttttcttttttaatcagtatgtttgaaatgcttgtagaagttataaaatattcgttgtttagaagattgtttcacttagaaaattgtttcacttactattctatgacagcatgtggtatattaaaaagtgacccattattgtctttatattcttctaaagaagtcatggaacaaataagatacaagcatagtaagaatgctttgggaagggaaatttgaaacagatgttattacagtagcatttgaaaagtaaattagcattttaaaagtaaatgggcattttcccctacaaaactgccattgctacacttctaactatatatgtcaaatgaagtaatattttgttattgaatataatatgtgcatgttgtaaaaatagctgggtggtattgaaatatataaaacagctgaagttggctcaaacccccccacccccaacaccatcaaggtataaatcctgataacaattggatatattagttgtagattttatatcattttaattattaaatatataaatgtactacatgtatgcttgctttttagactttattttggctgtatttctacagcacaatatatatgtctgcctcattttttttttctgtttttttgagttgaggtctcactttgtcaccaggctggaatgcagtggctggatcatggctcactgcagcctccaattcctgggctcaagtgatcttctgcctcacccttccaagtagctgtagctatgggtgcatgctgccaagcccagctaattgatttttgtttgtttttgtagagaggggtcttgctatgttgcccaggctggtggttgtgaaatcctggcctcaagcaatcctcctaccttggcctcccaagtgctgggatcacaggtgtgagccaccatgcttggcctgcctcatttttcttttacaaacagttactttgatgtacacacacatctttgcgtacttgtcctgttgtatgctgagatagtttacaagaagtagaattgtagggtcagactttaccgtatttttcccaaatgccttccctaaatgtatgagactacccattttcttcacatcccttgataatctttgacgttaggagttttctgagtctttgccaaatctgataatgtgactgtgattttagtagtttaattattacaatcaaaatgaaaataa

SEQ ID NO: 21438 - DNA, 1028 bp, Homo sapiens
agccactccacctggcctaggatttttttctttttaaaaaacttttttttttttttttttggagatggagtcttgctctgttgcccaggctggagtgcagtggcgcaatctcggctcactgcaagctccgcctcctgggttcacgccactctcctgcctcagcctcccgagtaggtggcactacaggtgcccgccaccacacctggctaattttttgtatttttagtagagacggggtttcaccatgttagccaggatggtctagatctcctgacctcgtgatctgcccaccccagcctcccaaagtgctgggattacaggcgtgagccaccgcgcctggcctctttttaaaaaacttaatagtcttaaacttttaatatacctctataaaaattcttttttttttttttaaaccaaatgactattaaaatataacctggtccttagagtgtttatttgtatttttaggaataaaggttggggagactacacctgacaaacttttcactcttatagaagtggaatgtttaggggcctgtgtgaacgcaccaatggttcaaataaatgacaattactatgtgagtatttcaggtaatacaagttaaagttgtatgatgtcatatttaaaacattttaaatatttgattttgtgtccttagatgttggtttctgaattactcatttagaagaaatggttaccataaatatccaggttttaaaaaattctttaaacatttttgcatttaacttcagaagacaaattttaaaactttagattatgaaaaatttaataatttggatattaatacagaaaataatcctagtgtagccaactatcaggacttaactgagagtaatattttgccacattttacttcagatactatcatcatcatcatcatttgtagaaataagctacagatacaggtgaaatactccatcccaaatctttttctcttccttttatccccagagataaccattatcataaattgtgtctatatatgtatgcagctatactaatatgt

SEQ ID NO: 21439 - DNA, 1044 bp, Homo sapiens
cattttgatttcttgctattagctgacacgtaaacttttctttaaaccattcttacgttttaggagcattatttcagtccaaaaagaggatggttaatgcaatcatttccatcatagttcataagaggtttctactgctctctgtatatagacttagttatgttaaagtaacgtgtatcagatgggcgtgaagaatttgtctaataattgctgtaggttgcttaagagctattgacactgctttctgacttggaatttgttgctaaaaacatgtatttgtaagatgcctgtgccttgtaaagggtgcagtgttgagatttatccttgggacaggaagggacctctgattttctttattcatttcctttatttttacacatgagaaaataaggtgaaaagacttaaagctagtctgcagctagttaaaaactagtctgtggtttggccgagaggtttctttctgtgaagatgctaatttgcctctttctttagaagttttacggagttgtggaaagaacattgaaatataagtgagaaggcctgggtttaaattcttgatttatcacttcctcacttcctaacagtggtttttgacatatcgcattaactttcagaaccttgccttctatcagctgcaactttaaaaatacaaaaataatagccttgtcttcttaacctgcaaaagtaattttcctgcataatttaatgttttcatgtggaacaaatgagaatgctttagaaagcacattgtacactgtaaacttctatacaacgtggtgatgttatttttaaagaaaatacaattcttaaagtgtaacaaggtgtttagatccctggatttttgcgtagccctacctttattgttttcatcttctgctgttttacagataactcctgtagatacattttctgatccccacttagttctaaccttagttaagctgcttatgaacattttaaatattgcagttattagtctgactttccctggagaatatgaagtttctttagcctttgaaaatattctcatgtatactcatgcat

SEQ ID NO: 21440 - DNA, 1022 bp, Homo sapiens
gtggttaaattttgtgattttgtgattttttttaaaatttatttttattttttattattattttttgagacggagtctcgccctgttgcccaggctagagtgcagtggtgtgatttcggctcactgcaaggtccgcctcccaggttcaggccattctcctgcctcagcctcccgagtagctgggactacaggcacctgccaccacacctggctaattttttgtattttcagtagagacagggtttcaccatattagccaggatggtctcgatctcttgacctcgtgatccacctgccttggcctcccaaagtgctgggattacaggtgtaagccatcgcgcccagccaattttgtgattaaaaaaaaaatgatgctaatttcttgatctggaatgcaaccatgagctttttgtgggaaaatgttatggaataactgccagaaaacattgtggtgaaaattaactattactttaggaaaatatgataaagagagcatgttccctttttatagactgaattctcacttgaatggcttaaatagctaaggcagggagggaagtccagttaatatctcagaagcacaactatttgtttcgaggctttttccagtatttttttcaaaaccactttaaaaatgtgagggaattaagctgcttgttcggtttaagtaggaattacttagtgtttatgtctaatggtttattttttgcatgtgaggaaaacagcagaaaacatctaataatttatcattttgcattcatagaaaaaatactagaatttggagtgaaatcattctaaacctcttatttaagaagcagaattttggaacgagaggatcttaaatgtcatctaatttaattttactttcaagaagaaacagaaatactgagaactgatgaaggtcaaccaaaaagtctttggtagatctcagaatagaatcttggacctcacgctcccagatcacactacataaaaagtgatggtcactttcctaactgaatgacccttaaggaccattcaaa

SEQ ID NO: 21441 - DNA, 1043 bp, Homo sapiens
ctaatcagtcccagtgtgagaacctggacatttcatttgaaggtgctgaattcacttgctgttgtcattcttctctatgagagccatcttgtttctaatcggctatcttggcccctcctgcccccttcttgtcttacaggtggaaactgaggaataatcccagtgctttgtgaaactgctatgaagaatattcaagtcagacttaagttggaagatagtgactagagcaaacagaccaaagcatttatttatttatttatttatttatttaatttgttcattcctgagacagagtcttgctttgttgcccgggctggagtgcagtggtgtgatctcgactcactgcaacctccaccacccagattcaagcaactctcctgcctaagcctccagagtagctgggaatacaggcgtgcgtcaccactcctgcctaattttttgtatgaccaaagcatttaaagcattgattctgagggcctggaactcactaaatgctgccagactctaaagtgatctcaaaatagactttctgtagttggaatacttctgtagatattcacttgtattatacatgtgcagtctccatgtttgtagcattcagatatgcaaattctattatttctgttccccatagtcctctaggccacattggcaactagaggtgtttttttctctcagccctatcttctaaatagtctgagttgtctttctctgttattggattttctccctgattctccctccttttgtcagtgttcagtagtttttcgtccacagaaatggtcccaaggcttctttccttcttgatcacttgatcagtttttcaaaggctcctcttttttttttttttttttttttttttttgagacagtctctgtcatgcaggctggagtgcagtggcactatctcggctcactgcaaattctgccttgctggttcaagcagttctcaagccttagcctcttgagtagctgggattataggcaggtgccaccatgcccagctaattttttgtattttagtagagatggggtttcaccatg

SEQ ID NO: 21442 - DNA, 1031 bp, Homo sapiens
atgtttattgggccagtcactagtatttttcgaacccatttccttcactccctcctccatctcacaccaacacaatagtaagctgcttcctcaattccctgcctacaatcttgtccccatggtgtctgttcacacagagcagcaagctgtcagacctttcatggttctctgttacttaaccctaacatgttctacataatacctcttccacagcatgttatttaaatgcctcctgtgcaaatgggggaggctttcatggtcaaataagtttgggaagcactgttaatctaaaaataggttcactgcagaacttaccagaacctttgatgtattgggagttttctaagtgggtacatttatacaagtatacagtgttttccaaacttgttcttggaagcatttttgtagatctttacagaattgtaagattgtaaagaattgtaagagaaattgtgggcccaatcttctgtggaacatactttaagaaaagcacatttacagagtagactgcagcctgtattattttgcccctgctgatctcttctgcggtcttaagttcttagaacatcaaatttgacaaaatggtgtgaaatgatgacgacgagagtaatggcaaaaccgcaattacttttgcaccaacctagagttgtctgcagataccattctgtttgtttttgcatgccatcctcttttgggaattacctccctccctccttttcctttcttcccacatgattcgtttcactaactctaactctggctcttcctttaagatgcaggtcaggtatttgccctcttgaggaagctttctctggcacctcagtgtcagacagtagatatccgtcctctacattccttgaaataactagaggcctatatggttttccaaaactaaaacagcaccaaactacctacaactcatgctaagtttaaagcagttcacaggacgcagaaattaaacaaatgaattactgcaattagaggcctgagaaatggtcagttccagtaagttgtttgtcctgtagaatttt

SEQ ID NO: 21443 - DNA, 1066 bp, Homo sapiens
ataaagacacatgcacacgtatgtttattgcggcactattcacagtagcaaagacttagaaccaacccaaatgtccaacaatgatagactggattaagaaaatgtggcacatatacaccgtgcaatactatgcagccataaaaaaaatgatgagtttatgtcctctgtcgggacatggatgaagctggaaaccatcattctcagcaaactatcgcaaggacaaaaaaccaaacagtgcatgttctcactcataggtgggaattgaacaatgagaacacatggacacaggaaggggaatgtcacacaccagggcctgttgtggggtggagggaggcggggagggatagcattaggagagatacctaatattaaatgatgagttcatgggtgcagcacaccagcatggcacatgtatacatatgtaacaaacctgcacgttgtgcacatgtaccctaaaacttaaaagtataatataaaaaataaattcttacttgaattgtgcaatttgtagaactttaataaaaaaatgatacatcttactcgtatttgaccaataaacaatttagaattgtataatacttgagggcaactttaaatgtctgactgatacgagaacaaacaactttaccgtgtggtggctcagtaactactagctgcaaaattgcttgatattggccagctatgtcatacaagtatctccggccagctgtgtcatagaagtatctctacgcagaactgcagttaggtgtcatatagcagcagatctcacaactgcagggattttcttttgtttttttgagacagtctcactctgtcacccaggctggcagtggtgtgatcatcatggctcactgcagcctcaaccttccaggctcaaaccatccttttgcctcagcctcccaaatagcttggactacaagcatgcaccactacacccagctaattttttaaaaaaatttttgccaggtgtggtggctcatgcctgtaatcccagcactttggaaggctgaggcaggtgaggagatcgagaccatcctggctaacatggtgaaaccccgtctctact

SEQ ID NO: 21444 - DNA, 1026 bp, Homo sapiens
ggggcccggagaatgggcctgacaggagggtctgtcggaacctgagggactggggatcccggtgcggagaagcgcgaagggaaatcgcgttgagcagctggggtgggtgcgcctgggggcgtggcctgcgggccggcgggcgggcgggagcctgcggtggaggcgtggcacgagggaggggcgaaaccgggtggcgcggagggggcgtggcgttgggaggggcggggggagtgggcggggccgagatgggggcgtgcgcgctgacaggagcgccgggggagtgagagacgcctcctggcgggagctggcggctgtggaccccagcgggggcggaggggaagaggggagcaggggcggggagcaaggagccgggaggagggcggcgggcgggcctgtctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatggtgagtgggagcggctggggggttgtgcagcctcttggcctcttggttgggaaggggccgggcgccgagctcggccctctagaggcccggggccgcggcgagcttcgcgggggccgggagaagcctgggcccggctgcgcggaggacaaagtgggggtgctgggcgcgggcgcacaggccggacgccgggagccagcagcatctctgcgccgctttggtccagaccatctctgggccggcccgcgtcctccgcagcccgcgtcggccgagccggggtgggggtggttccgggtgcccggtcccccacaccgctaccggcctctgcctcgcggggcgtccggcgccttcggggccctggcaccgctctacagaggctcggctctgccctggtcgctgtcagtgccatctcccttaacgagaaacttgggcgtgatgtatgcgaaacaattttgatgcatgatggtttctaactcctt

SEQ ID NO: 21445 - DNA, 1044 bp, Homo sapiens
tcttgagtgctggtgtgcacctgtagtcctagctaactgggaggccacagtaggaggatggctgagcccatgagttcaaggctacagtaggttataatcacacaactgcactccagcctggataaccaagcgagaccctgtccctataaaataacataaagctgctataaccatccatgtgcaggttttgtgtgggcataagttttcacttcatttggctaaatactaaggagtgtaattgctgcgttgtagggtaggactatgtttagttttgtaagaaattgccaaactgtctttcaaagtggctgtaccattttgcattcctaccagcaatgaatgagagttgctattgctccacatcctcaccagcatttggtgttttaagtgttttggattttcaccatctaaataggtatatagtggtatcatattgttttaatttgcaattctctaatgacatatgatggagagcgtcttatacttatttgccatttgtatacctttttgggtgaggtgtctgttaagaatctctggcccattttttaattgggttgtttactttttttattgttgaggtctctgtatgtatgttttgtatagcagtcctttatcagaaaagtcttttgcagatattttctcctagtctatggcttgtcatctgattctttggagagtattttttgcagagcagaagtttaaaatttcaataaagtccagcttatcatttatttctttcatgaattgtggctttggtattgccagctaagatttaatagggattgcattgaatctgtagatcaatttggggagtactgtgttgccatcttagcagtattatgtctttgtttcatgaacatgtgtgcctttccttttatttggattttctttcatttctttcaacaatattttgtagttttctgtgtattacatttcttttgttaaatttatttatcagtattttattctttttgatgctattgttagtggaattattctcttaatttcatttttggattgttcattgcttctgtatagcatattagc

SEQ ID NO: 21446 - DNA, 1074 bp, Homo sapiens
aggcaggtggatcacttgagggcaggagttcaagaccagcctggtcaacatggcgaaaccctgtctctaccaaaaaaaaaatacaaaaattagctgggcatagtggtgcatgcctataatcccagctacttgggatgctgagtcatgagaattacttgagcctgagaggcagaggttgcagtgagctgagattgtgcagctgcactgtccaacctgagtgacagaatgagactctgtctcaaaatgaaacaaaacaaaaacaaaactctgtgaggcaaaaactaacagaactgcagtagaaatccactcttatagttgaagacttcaacccccctcaacccaggaggcagagaatcaatagggacatgtttgaactcaaaaacaccattaatcagctgaatataatggatatctattgactatttcattccacaacagcagaatatccaagcatgtaagctttatctcaagcttatgtgaaacattcaccaagatagatcacattctgaaccataaaacacaccttagcaaatttaaaagaatagaaatcctacaatgtctgctctcagactacaatggaattaaataaaaaatcaataacagaaagataattggaaaatcccaaaatatgtgaagattaagcaacacacttctaaacacatggatgaaagaagaaatctcaagaggaatttaaaccttttgtactaaataaaaaatgaaaacatcaaaatttgagggatgccatgaaagcagtgtttaaggggaatttataacattggaatatatatattcaaaaagacaaaagatctaaaaatcagtaatccaaactttagaaaactagaaaaagaagagcaaactcaatccaaagtaagcagaagaaaagaagtaatacaaattagagtagaaatcaatgaaattgaaaataagaaatcaataatcaacgaaatcaaaagctgtttttttcaaacagttcaataaaatggatgatcttctaactaggttaagaaaaagagaggacacaaattactaacagcagaaatgaaaaagagaacatcactatagatcctatggata

SEQ ID NO: 21447 - DNA, 1025 bp, Homo sapiens
acaactttgttctcctcagctcttgccatgatccttaaactaacaaaatgaggaaatagatggtttttttctcctccctgaatttataaaaacaggaatttataaatttggtttaactttttaaacttttaatctgaggaagaagtgaaactccatcttacacctaatagatgcgaaacaaaaatgaaacataatttagctttcaaaagtatagccataccccacggaaatattgctgatttggttccagatcactgcagtaaagcgaaggtcccaataaagtgagtcacgcaaatactttggtttcccagtgcatataaaagttattttacactatagtgtagtttattaagtgtgcaattttattatgtcttaaaaaatacgtaccttaaatacaaaatactttattgttaaaaaatgcaaaaaatcatctaagccttcaggcagttgtaatctttttgctggtggaggctcttgcctagatcttgatggctgctaattgatcaggctggtggttgctgaaggctggagtatctgtgacagtttctttcttcttcttctttttttttgagatggagtctcgctctgtcgcccaggctagagtgcagtggcgcgatctcggttcactgcaacctccgcccctccaggttcacgccattctcctgcctcagcctcccgagtagctgggactacagatgcccaccatcatgcccggctaattttttgtatttttagtagagacggggtttcaccacgttagccaggatggtctcgatctcctgatctcatgatccgcccccctcggcctcccaaagtgctgggattacaggcgtgagccactgcgcccagccttctttcttctttttttaaatagagatggagtctcactatgttgcctagactggtctcaatttcctggcctcaagcaaccctccagccttagtcccccaaagtgctgagattacaggcatgagccatcacactggctggcagtttcttaaaatatggtaacactgaagtttgct

SEQ ID NO: 21448 - DNA, 1050 bp, Homo sapiens
tcccaccttggcctcccaaagtgctgggattataggcgtgagccactgcgctcagcttattattattttaatgctcaaattgtctattagccagtaggagccccttcagttgtcctcctgtgtctcttcagcatgtcccatcattcatggtgcacttccttactttctggcacaaatgtgttcctggctcactttgtactttcctgacccagccttcaaatcagtctttcctccaaggagctctggttcctattatgtatttaaaaaacaagatctgagcgttcagtatgcttgaagctactggggtagaagaatatcatcatttaggctcacccagcaaaaaaaaaaaaaaaaaaaaaaggtaggaaaatatccatgtgtaatcctagaagttacataattttaatgtgttatagctctgattgcaaggcagtaactaacaaaatcttatgatattacccccaacccaggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaaggtaactgccaacagttgactttttccattccgccccctcatgtggtctgtccatgtaatctataaaacctatataagaccatcttttggagcagccttttggttttgaatttgtatcatctcacataaattctagactcaataaccctgatcccatcatatctagaggcacatgccagaaggataagagaaaaaaaatatctccaatccttgagtagataaaaaggcatgtcggctgggcgtggtggctcatgcctgtaatcccagcactttgggaggccgaggcaggtggatcacgaggtcaagagttcgag

SEQ ID NO: 21449 - DNA, 1033 bp, Homo sapiens
tattattgatattgcagcctggtgtcagtcacatgtttcagtgtaatctagaaagtttttttttttttttttttttgagacaggatcttgctctgtcacccaggctggagtgcagtggcacgataatggctcactgtagcctcgacctcctgggctcaagggatcctcctacctcagcctcctgagtagctgggactacaggtgtgcgccaccatgctcggctcattttttattgtttgtagaaatagggtcttgttatgctgcccagactggtctcaaacttctgggctcaagcagtcctcccaccccccaaagtgctaggattataggcataagccaccatgcctggcctagaaagttttgttttaattaaaaatgattttactaaaaaatttgtcatttcctgcttggttatacctgtaaacagggctttctatggatgaaaaacaggctggatggtgacacacctttggggactgctggggaatttaaggcatttagaattagtcagctctttggaaatgtagtgatgagggtcacctggaaggccttgaagatcaggagagattctatttatgtaataataataagagtggcctgcaatacctgatgagtttagggtatgccagtcagacttttgagttccctcttgtttagtgtgtgttgcttggttctgggactgtgagtgtaccagccacagcaatggtaaaatcccagatctctggatcaccttaaaatccacattgcagatcaactgcagcatctaaacagcacatccaaggaacattagttagcccttgcctgaattggggaacatgatagtaggtctctgttgtggttgtgttaaagagacaaagacaacctgaatacttctgtttctttgaggttagagatttgtattaatgtggaggatagctttgtcacacggggcacattcatgggacttttacacgtgcgctccaggatatgtaatgtagcagaagccctctgcgtatttttcttccttctttttcctagctcactaggttatcta

SEQ ID NO: 21450 - DNA, 1050 bp, Homo sapiens
taaaaccaaaagcgaacccagccaagggggtgaaagccgagggcgcggccggggtggaaggtgaggcagtgacctgtgcggagcgcgccctgcaaacttccctgctgcgggtgaaagaagctgcctgggaaagtcctccccaccatcactcccctaaagtggggttttctccgcccgaagaagccttaaagcagccagaaacaaaaaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagccattagcatctggtgtacccgcccgtgtcattggcaaagctggtctcatgaaaaccatttcctaaaaaagggcagcgaaagggtcgcattcttgtgcgaactgatctgtcaagatgggggtacaagaactgtagaaagaggaaatgatttcggtgaggactgaattgtgccagcgtctctaggcttcctctaggctcttgtggaacctccggcaggctcccatcatcggctcccatcaccggcctcttccaaaaccatcccttacgctaactcgattgtccggttggcttagaattccagaggatctgggaaggccctgccctccctgctagcccctggcacagatccgcacagatccccacctcccccgacttgctcagccacagccaggatctagtctggtctttctctgttgacctttttgtgtggcaggagtgggttttcctgttccccaggccctctaatatttccagacataaattccaggaatcccatgcttccctcttgaggggccatttcagcctcaggaaaggccttcagagacttagaaggaatgtcgtgttccaaggaatgaagaggcagccttgatgtgccgtgtttgtcaggactggccttgggaaaggtgaaataggacatatttttgcctttttttctgcaac

SEQ ID NO: 21451 - DNA, 1048 bp, Homo sapiens
taaactctttgttatttgtattgcatatgtttttcctcagtttgttgtttcatgtttcactgtttactgtcttttaaaaaatcataccgatatttagaaatcttcatttagttaactatatcaatcttttgtgattttgatgttttatgtcttgcttagaaaatccttctctactctaatattataaaagtatttagcgcgatggctcatgtctgtaatcccagcactttggaaggctgaggcgggcggatcacgaggggaggagatcgagaccatcctgtctaacatggtgaaaccccatctgtactaaaaatataaaaaattagccgggcgtggtggtgggcacctgtagtcccagctactcaggagactgaggcaggagaatggcgtaaaccagggagggggagcttgcagtgagccaagatcacgccagtgcactccagcctgggggacagagtgagactccgtctcaaaaaaaaaaaaaagtgtttagctatattttgtcctagtactttcatattttcttttttacattttaaattatttgagcacgtggattttgggataaagaaccagctagggatttagtctcccctcccccacccccctctaaatgcctagctggttgctttaataccatgtattgattaattcataatcattatctactggtctgacatgttatctttgtcataaatgagatttccatgtgtatgtgtgtctgtttttggactctatgttctattaaaattttaattaatttctgaatttgagaaaaatcagagccagtagtgtccgaattatgaatttacccctggttgtttttttactcttctcttgatgtacttctcacacactgcattctgttgcataaaaagaataacatggtgttgaatgacagatctaaagatggacatttgtctatgtggtaaatacgtggtagattctgggtgatttttcatatgcttcatataaaaaatgatcgtacataaaataacttttttggaaggaacataatctgagccattcagatacaacgaaatccagc

SEQ ID NO: 21452 - DNA, 1044 bp, Homo sapiens
tggccaagtcccctagagaacctgttttctgcccagtccctgttggattccaaattctgatatgttttccatgagaaacaacccatttaaatctgtggcgagaacctgacactgctcgtttgaacctgacaccaggaatttagccccaggtgaatagcagttaaggacatgtgttattaagtaggtgaggccccttgggagcagaaattctttgctggtacacggttgtcaagtgctttagctgtaagtgcttagatcattgcaatgtgttattgtctcagatatttgctgtgaagggagtagctattctttgtttttttcaaagaagtttattttcgtttttttccttctcacaggtaaaaatccaagtgtctgtaagaactagcattttaaacagagattttgctgctttaattattgttaaaatggttgcctcatctgtgtgttacatagacatcttgggtatttagagaaaatatgagctagggggagcataacaaactctgattattcatttcagtgggtgcttgccggaacggggcctgctgtgagaacgcgtcagagcacacacagccctgcagccctcctctgcttgattttgatgagatgttgtgaatgatttcccttgcttttggctgcaataccttaaacatgtgggatggttttgacagaaaataattccaccacacagttaacagccgtctcccgctcaccgctgctgtgctgctcgtggccggcttaattggtcttttatgcttgaccttggaagggggctgtggctcggggagagagtaaaaatataatgcaaaaaacatgtaaggagacgttaaatgttacattccaggagtctggcagaatataatatacttagttttttctgttacagtattttagaactataatatgcatgctagaacatgtatgaaccaccagagaatttgttttaggaagcgctaatgagtccactcttctttttatttttatttttatttaactgtaaaatggtgcctgagcagtgtatattttattgtgccctagctatag

SEQ ID NO: 21453 - DNA, 1044 bp, Homo sapiens
tgaacccgggaggcagagcttgcagtgagccgagatggcgccactgcactccagcctgggcgatagagtgagactctgtctcaaaaaaaaaaaaaaaaaaaaatctcaattggctttattcatgattctagaactggcaacaaatcattccataaaatagaataagtgttcccatgggctgagcagaggggattggctttatagacagagaagggctgaagaaagcaggaacaaggaacagtagcctgctagtcgtttcaaagatacttttcttgggggacaggcagagggagggacggggaaacagaacgatggaatatcagatgagttaacatgtcatgtaaggattaaagccaagggaactgcattccatggctactgaagatttcagctggcctatttgggaaattggctgttacctcttgtgacttctcagaaggtcagataactacttagtttgggtttggtgaaggggaacttaagcatgggtgactacttttattttcagtctggtctcatggggcctaatgcaggagcttaggcccgaaacaaaggcctcctataatattaatttgacatacagttctgttgttatggacacaactcaggagtagctaaatggaagagatagtgagggcgaggggtgggagtgggacaaggagcttccagcctctcaggggtagcactcccagcacaccagtgtgctcagcagcccggaccctctcaagccttgtgttcaatagttcgtattgaggcttcattacttagatgactaatgaagattgattaaatctccagccccagaggctggcgttggggctgaaagattcaaccctctaaccatgtggttgattcctccagcaaccaggctcatcctgaagaggccacaggatggtctagggccacacgctatcaaactcagtcatggctgaaggggctcttcaagaataccagaagacactcctatcacccaggaaactctgagggtttggggagaactgtgccgggaaccagggcaaagaccgaatctgtatttttttatta

SEQ ID NO: 21454 - DNA, 1042 bp, Homo sapiens
tgagttatatgaccttggactactgtttaccttctaagttgaatcatttgtaaacttggtatattaaaatgtaatgaaagtatctacttcatggacttgtgagggttaaataacatagttcatacaaagttattgatacatgagtgcccaataaacgctagctgttccgttagtagatattctgtgtactatatagtattaatatatgttttgtatatatgattaccttaacatgatgccacagatactcagcagcataacccttgtgtaactgggaaacagtttaatcagtgatacaacttaattagctaaaacctgttagaaacattgaaggtagtcatcacctgcattgctgtggctacattgtttgtgtatttgagcagagcacccagccttcctcattagtctgcactgcatagctaagaatttacaaagaccttgtcaagaactgtgaagggactgaaaatttagcctgctgcagttttgtagatgttggtagaagacatgagatttcctgagttagacagtggacatcattgttcatggcactgcaagtggaatgggctttatatttgtgttgttttccttgccctcctcaagttccatggaggtgacagaggtgttcgggtagatgctactcacatagtgagtttgcatcataactagaaaccctgagcttagagaaccggaatctttcatagtgggctgcacagaaacctacctgacctttgttccagtagaagaccttatcttgattatattggtcagtgaacaaacctgcccctctcctcagaagggaggtgttgtcttctaagacagttcactatttaatacattcttgaaaagatagcctgggtaaaaacccccaggactacttcttgcaagatgtgcagaaatgctagaggcccatggagaattgtctcctaaacacacctctgagtaactagcctaaatgggggtcacagagttcataaattaatgttcatgtgcattgtctgtttattcttaagttacattttagaagtgttttctgttttctgaa

SEQ ID NO: 21455 - DNA, 1078 bp, Homo sapiens
gagtggaggcccatttttcacttgaaggtgcttcttcaaatggtaaaattttaatgataaaactgtgtcagcagcatataggatgatgtggatccttttatttcttggggtaatgattgcattttatggttggattatgttgggtaattcaaaatgtgcaaaatccaatactgatcctgagaagaatgggcgggtacttctatgaaccagctgaagtggtgtttcaattacagcaatacataaatacagcttatgactttgatggctcactggcctcgtcattatgatttttgatggatgtttttgagtgtttataatttacatttcaagttttacacatagaatgagacttaaagattgtaatatatcaccatttcaaatttatgtaattcaaacttgcaaaaattgtgtctatactatttaggctggaagtggccttaattgattaatgtgtatgttaaagagaggctaaaacacaattgtgtttttataaggcagtatttcccagtgtattaggttggaagtgttctgtagacaggtgagcttggaaaaatactgtaaatgtctccaagaggaatcacattgcgtatttgcctattaaaggctctgagaaaacgtaacggtaaagaaatatatttaacccagtattttttttttaatttaaaataacctaattaacttaggaaatatctgatgttctgaaaaaatatactttgggaaatactattcctgcctaaactcactgttgtagtattaactaccctgcagattgtacaagaaatgttacttactgagaaatgtgtttaaactcagtgcaacctggcacagacccaactccatctgggttgttagttgattatgtgactttcaagttaatcagtttaatgttgcatctcatcttttacagaaaatatgaaatcttaaggtaccaaatctgaagtcttatgatagtacaaaatatataagaagtttttgtttctaacaattaaggataaaaccttttatgtctatctaaagataaacaaaacacctcttaatattttattcatgtggtaataagaccctattgataattgta

SEQ ID NO: 21456 - DNA, 1026 bp, Homo sapiens
ctcggctcactgtaagcgccgcctcccgggttcacgccgttctcctgcctcagcctctccgagtagctgggactacaggtgcccgccaccacgcctggctaattttttgtatttttagtagagacagggtttcaccgtggtgtcaatctcctgaccttgtgatccgcccgccttggcctcccaaagtgctgggattacaagcgtgagccaccgcgcctgaccttgaaggtgacatattttctagaaaaaaatactgattttttttaaatgaagactgaggggctgtaaagaacagggatttcaggggtcttataaagggatttcaggggtcttatcataaaatggttgaatatacattattttctgttgagacagaacaaatggggtatcagtaagtataattagggaatccctttcccacctgtttgtataatacagtattttatctattaaaggaatttgaaaagaaaggaagagaactatggacttaatggttatatgagtctttaagtgtttattggcctgggatgtgtgtgagagagtgagtgtattgggggataggctttaagtacaagagaggtttatgaaattgttcagattgagtgttatcaaagataagaagacatacaagtgcttgtttttcagattattgacaattattaattagtaaacattaaaagccacaaagaattagatggtattcattttaaaacaatgtaaggctggcataaattttaataaagtatgtacatttaataggtgcatgtaatgcaagtagattataactaattttgtttgggaaatacaaaaagcgagttcagaaactacttttgctttaacatagctattattagtattgtttcttatgcattaatgcatttttataaagtgttaatgtttagagcctaatgctttctgtgtcagtcattcccaatatcatgcagaagaaatcagagttcggtgagaatctgagaatatgtttcccatgccatctcagggtataactccaccagggaatgctccgac

SEQ ID NO: 21457 - DNA, 1077 bp, Homo sapiens
atcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctatttttacatcatttgtcttaccttgttgagagaggagactggcttgttggcttctggttgttgcaggaggcatgtggcttcctgccttctcagtagacaggatcattaggaaaatagcaacatcaatcctgttacaca

SEQ ID NO: 21458 - DNA, 1104 bp, Homo sapiens
ccaataattggaaaagttgtaaggaaattgctttagaaaaaagtaatattttatagttttaggatacttcctaagtatttgaagtaagtatgtttataatacttcatataaaatgcagatttcagtaatgattcatttgaggtttttaatgatggaaatagtcaatttttttttctatttcagctgttgcttttaaaaatgccaaacagtttgagcaagcaaaagatgcctgcctgagggaagctgttgcccatgaaaataatagggcgtatctttttcaacttttaaaaagaaattaaacaattagatgattttgacaagctgttttctcttgctgtaaatttactttactacctgtgaagtaaaatgtttttaaattagaaaatgattagaaaaattctgtatttttaaactatgaaggagcgtttataatgaagtttgattataaggtccacactggttcgcagagctacaatacttactttctattgtttgtgattttacttgatgatggttttacttgggatgaagtaaagtaaatctgtagacatgtgctgaagaatgaagaagtagcacaggtattgaaaacacgtgaactactgtatcaatttttttaaatacagttttccttaggtatttgaaataaaaattataagtagtttaaaacagtacattttcttgaggtgtttgcaaacttatcaataaaaaatgtttctcttatttgcaaactgtagtcataataactttgtacttcagtaaaacttcagattattgcgtaatagaaatagtttaaaatctgtgcagtgttttgttagtggttttgggaattatgtagttttaaactatattgacaggtattgaattacttcttttttacctgtttgtaggatttgtcttttggaaccaactgggtcagtgatttagttaactgtctttaaatagttgatctatagaaactattgatttttttcttttttccttaactttgacttcgttacttccattcagtctttttcatgctgccaagtaagtattcttcatgttttcatgtatttgcaaattatgttttaaatgttgctgtttttctgtaggttggtaattttt

SEQ ID NO: 21459 - DNA, 1034 bp, Homo sapiens
agtccggggtcattatctttattcatcttattacttactcgtcgcttcccagaaatcagtgaatgaaatgctaactctgacaaatcccaacttaaaaatggttcactttagtttctgaaagtgtttgttacagcagcagagctgttcttggtgatggcgttatggctgtggcaaaatagctgaactgtgaggtgataccaaggttctgacttgtgagcaggggccccatgtcttagaaacagtgtccttcattcttttcagggcagctaggaggcaagttttagcatagtttacctcctttctcttctgttctcatctcctgatgctccccgacaagactcccagtgcctttctagagcgctaagccccttactataagaccccatggaaggtgaaggaagtgaagttgcaggaaggggcagaagttaaggacagccctgtgtgaaagtccagactgcatcagctcccctgaagtatttctgctttccacatcttctttccttttgtttctcaaggtatagattatctaaagctgtgttgtagagggagtagcaggaaaggagagaggccaggatcttttcgggggaggtcagatgaggaacgttttccagctgcctgtgcatattcctttagaaagctccactagggatgggggccaccatcatcctcaaaacattaccagtgttgccagtcggtttggacacatctgatgaaagccattgttttaaagcaattactgtgttaaattcttcaaagcctcagcagaggggagaatgctagttgagtgagcagcagaagtgagaatgctgcgtagatgtgctcaaagggcacatttataaatccagggcttttattcgtgactttgttttattggttttttttttttctttttaggaaaaatgtattttaaaatggtactttctactgtgctcaacaaaaatgttatggaaatatatttttgaagtgtattaacaatataaaaattaatttaaatttgtgcaggaacatgaaggaatttgatcttttgaaaagtg

SEQ ID NO: 21460 - DNA, 1052 bp, Homo sapiens
ggcaggcagatcacctgaggtcagaagttcaagattagccttggccaaatggtgaaactccttctctactaaaaatacaaaaagtagccgggtgtgatgacgcacacctataatcccagctactcgggaggctggagaatcgcttgaacccaggaggcacaggttgcagtgagactcccatctcaaaaaaaaaaaaaaagaaaagaaaagaaaaaaagacctttccagcaagttgatcatgaccttgtgcctctgagagaaggtctatgcctctgagacaaggtgtgtggtctcagtgaacccaaatccctcctagaagactcacttagcaaagaaaagagctgcttctcaccagttgtctgagacagtcactagatcctaaacacaaggagggttgggtgtgtatatgttcaggggtgggatgtgtgctattaaggagaatcactgggtttctgtcttgcataactgttctgtccatggtgccatcaataactgagataaggaatatagaaacaaacttatcagtgatgataataaacttagctgggaatatgacacataaactaaacatttctgtaggtagttaaaaataggttttggagttcaggaaatagttggggccagaggaacagtttgagttgtggtgtagaaggtgtctgttgaaagcttggggatgaatgaggttctgtgacagttttctgccatttgcacataacttctgtggggtttcaattttgttacatttggggaagataaaaacaatttattcttttttcagcaaaaccaaattcttgtcattttgttaggaatattaagtattacctgatggaaaagttgaaagcatctgtgtttcattataataagtaactaatacttttctggatacatttaaaaatagatggctttgtatgctaatttcatggccttttagcaaagtcgatcaactttttcgactacaaactcatgtaagggcttggctcttttgttaggtaactatatattagcacatagaaatgctaatattatgtcaaggaaataaacagtttatgcgt

SEQ ID NO: 21461 - DNA, 1045 bp, Homo sapiens
tgcgcctgtggtcccagctactcaggaggctgaggtgggaggatctcttgagcccaaaggggcggaggttgcagtaagccgagatcgcatcactgcgctccagcctgagtgacagagtgagatcctgtctcaaaaaaacccttgttggttcccaattaggacactatcagctaattttatggtgttgggtgcaagtacatctgcccattgataacacagagatcacaggcctgcacattgcctggcaggtgtgagctgttggtcccagtggggctgaatatggctggaccagtcccagctcgtcacctggaaaactcagcccggagcctgcagggaggggctgtccagtggtgggtcactagcatccccttaccccacagaggattgaggcttggtttacagcatgcagcccctcaggtacatttcagagctgcatctcacgttgtttatggcagtattctgctaccccttttcttccctgtggcatatttttcctagtcatctgttgcccttctgttccatccacgctggctataagtgcattggcctggacaagtcacattttcttgggccgttcctgaagggtctgaaggctgagagcaaatccaggaatctgtgggtgtggttgaagctcagttctgaatgcagtgcccttgggccgccccccacaccccgccgtgcttatgatctgagcacagcccctcctgcagctcagaacctgtgcccccttctctcttctgcaccaggacttaatgtggtgctctccacatgcaggtgttctgtagatgtttctagaatttcctttacttaccatgtgttgctcccctgccccaccattgaaatccgggccttgccacatttcccaaaagccacaacgccacattcctgggtgccttccttgcacccaaagccgccaaaggagcctcctggaccgtcccacggccccagcgcagccctccccacggctgatcgccacactcttgactgccccacggctgtgcttgtcctccctgacaccacatccccgcacccccactcgcttctc

SEQ ID NO: 21462 - DNA, 1007 bp, Homo sapiens
tctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttcaccatggctatctatacctgtacatgaaatgtgtttgtattgtgctgaagagcttaatgtcaacattacctgctgcttactctgaaaaaaggaatgaatggtagctgtagaatttaggatattttatcaggttggcactttataaaatactccctgatttaaaaaattgtaagttatacacgttaatcatccacattctatcgacaatgtaccaacatcacaagctgttgcaaccacctgctgttacttctctgagctgtaaaaacctgaactcaattcaggggtacaaattgcaatctaatcttttcagg

SEQ ID NO: 21463 - DNA, 1030 bp, Homo sapiens
ggcgggtggaccacttgaggtcaggagttcgagaccagcctgaccaacatggtgaaaccccgtctctactgaaaatacaaaattagctgggcatggtggcgcgtgccttagttccagctatttgggaggctgaggcaggagaatcacttgaacctgggaggcgaaggttgcagtgagctgagatcgcgccattgcacaccagcctgggcaacaagaacaaaactccgtctcaaaaaaaaaaaaaaaaagtgattgttttcggggattttagagacaggaggtgtgctgagagcagattggccttttatattcaaacatttgttttcttttttgaggtctgacagtccgaaaatgctctaccagtttccctagatgttgaaatcggactgttatcaatcttaaatttgaagtgagtcgtcataaagtggatagtgctttaccttggtgcaaatcctctaatcctgtttaaaaattaatctgcaatactaagtagactcattttttgttgaagggccttccttccctttgtagtttgaagaacccaagcctcagaccgtaaagaatgaatgaatttaagagtgttgcgaaactccaccctttgacctttccctcctgtaggaaaaggaggaccctaaaccttcctgcaaggcagatgaagcttgtagcttcagtgcaagcgttcttcctggaaagcagagctgctgtgtgcatggaacacgggttctccttccatccttccctgcctcccagctttccttccagagcaagcatcagccagatatttaggaacttttaggttctactgtaaaacttttcttccttgaggcagtgaaaagccagcttaggattcagacattgctgtgtaaaccctggcgagctaagttaggagtttctgtggttttcaaatttagatccttgaagaaacagaagattttaaaattttatgttattatttaacaaatgtgcataaagagcttgcaatagagcaggaacagttctaaggctcctatgacttttaacttaagagata

SEQ ID NO: 21464 - DNA, 1058 bp, Homo sapiens
gagggtggatttgactggggtgcatgaagaaggtggtgaagaagatttactttggaggctgagatgacagcctctgagttggatgtggggtgtgagagaaagagaggagccaagggtgacttcaggggtttaggcctgaaaagctggttgaatggatttgccactttccgagatggcaaaactgcaggaggaacaggtttggagctgagagtcgagtgttctcttctgtgcaggttaagctcgaattgccagtagatttcttattttatttttttgagacagggtatcgctttgtttccctggctggagtgcagtggtgcaatcacagcttctacctcctgggctcaagtgattctcccacctcagcctcctgagtagctgggactacaggcatgtgtcaccatgcctggataatatgtattttttaattttttgtacagacggggtttcactaagtggagatgttggatttgcacccaagctgacggcagagatgcagtgtggaagtcatattcctggagatggtatttagggccatgtcccggacaggaggagagcaggcttggccactgatgggctttgccgtcggatgagctcaggtcaggctcccattttcctccttgggagcctcacaaatgccagtttgtggaggtcatttctgaagtggttcatttctccagaaaaggcttccctgctcttcctgcctgggctgagcgcacctgtcgctggaggaagaggaggcaggagggggagaggaggcggtggtgatggcctccagctcctgcctcgcctggtccacacctgcagtgtttgcttagctctgcagggtggggtcagcctacgtgagaaattcgaaaactcaacaacatttcaaacatcagcagagacagaattcctgtgagacagcagctggcaggcacagagtagcagctgtccctttggtggggtgggggtcggtacatggtctccaagggtccgaggcccactgctcctgaccctatctgagaggtccctatcatttcctacccattttgctaacaaaagctgtctcagaagaa

SEQ ID NO: 21465 - DNA, 1029 bp, Homo sapiens
acccagcatagtgcctggggcacagtatcctaaaatgagaaccattatcaaagaagaaacttgaatctttgcacaaaaccaatcaagtcatgccccgttgttaaaattaggacttgtttctggaggacacagtcattaaaacaagcaccactaatctctctctctttctccctctctctttctgcttcccttggcttcccctttcttatttctattatgccttgctggaatatcttcaactcacaagttaaaaaacagcactggatagaggtaaaggattagaagaaggcaagaattttattagctgcttcttcaaattctaccatgcaaatttcagacatacacaaagtacacagaaaaagcaaaatgatgccccatgacccctcacatggcagcacgcctgcttcgtgtgtgtccaccagctcccgccacccccagctgcctggagccaatcccaggcatcaggtcacttcctagtcagtacttcagcgtgtctccaaaaacagactgctctcttacaaatacaatcacatcatcaatatcactctctacccaaaatgcatccctaaaatcagcaaataatcccatcagtgttcaaatttccaattgtctcgtttttatggaaagtggcctcctaaggtcatagtctgcgttctggggggacttcctgttcctgggtcagtctttgttgccttttcactggactgtgctaggaagtacgtattttttatttgttttgttttgttttttgaaacaggatctcactctgtcacccaggctggagtgcggtggtgcagtcttggctcactgcagcctccacatcctaggttcaagcaattctcctgcctcatcctcctgagtagctgggactacaggcatgcgccaccacatctggctaatttttttgtattttttagtagagacggggtttcaccatgttggccaggctggtctcaaactgctgacctcaagtgagccttttgcctcggcctccgaaagtgctggggttacagttgtgagccactgcac

SEQ ID NO: 21466 - DNA, 1089 bp, Homo sapiens
accttttcctcaaatattaaatttggaaaacaatcttgtgattaagagaagaaggctgtccaccaatggacttaccctgttatttcttccttattgtgagttgaatggcatgacaaagcagaggcaaagaggcatacatcagttcttcaaagtattaagtcagaaaggtcagagcttccacagcgtggcaacagctttgcagatgcccacatcatggtagttgaaatagcaaagcccagcaaaggttaaagctgaaagtgccagaagctctgccttgggagctttctgcaaggcatccccatgaacatagtcagtaacaacttgtccaaggcccgagtaactatgaagagtgagggttgcagcaaggagtagagtccgtcacagagccaaggattcaaataagcagctggaagcaggcccaggagcaaaacactgacgaccctctcactagtccagtggagagacgcaacctgggaaccagaatggtggcttggtgacaagccaatgtactcactccacaccattcgggggtaggtcggttctgaagtaatgctgagataggagcaggtgtgaccactggggttcgcagcaacagagctcagcctccttgggcaccgcgaagggtactcagtctccagagaaccgccatctcattcctgaaaactcaaggtcatccaccaacccccactttgtattttagttatagtcggttaaaacataaactcgcttttgaaaccttaactgcatgttttatgaaacctgtattatataaaactgtttgtctggggaaagagccagaatcagagaagagtttacacagctgttgaaaaatgaaatttgtcagaatagtagaggaagacatttcagatataatgaacggggtgtatatggatgaaggtataagcagtaacagtcatattggaagttactcataataagaagcaggtttagtgtgttattataaaggtaatattaggaagtaaagaacaatatgtagtgttagtttatctgttaatactggattttcaaattttgtttttctgatggttttgttcatttatattgttgggtggattcatttgtgagcga

SEQ ID NO: 21467 - DNA, 1048 bp, Homo sapiens
aacattcaggaaatgcggattttaccctgaagaaacaatatttaaaatactcagttgtatcaaccagaataaaatagttccaaataaaaaagtaataataatagtcatcctctgcctttctttttagcagaagaccagagggtaatattgaaatgattatcccacactgtgtgacaaactaataagaggcgcgataagctgaagagcatacccctgcgctttccaagttagagccttgaaaatgcaagcacagcctcggagccagccttctccaggcgagagccttgcctgaggccatcacagcagacgcatttaggaactggaattttctgagccatcagagctcatagtggttccatacaaagattgagagcccctaaggtgtttgagaaccaagtactgggctagggtgagtgaggctaacagtttctactttgtagtttttagagacagaaactaaagttagcctggtatcatctgagacttccgaatgtatatatcagagtctcctcggtgcctttccttccttagaactcggctcacttttatttctgtagctctcttctctgtcagtctcgtgctttcaagttttggcatggcatttttctcatagttcttggttttagggtgttaggagtaatttttgcatttattggcaagcaggaaactttttgccttggtgtatctccatctcatcactagcttgaggcgtttatagtatgataggagactatgttttggagttagagagacctaactagatatagttagatatagagaccttactagatatagaactttgggcatgttaactatgtattaaatctttttttcttcatttgcgacagagtcttgctctgtctcacgcagttctcctgcctcagcctcctgagtacctacaggcacatgccaccatgcccagctaatttttatatttttagtagagacggggtttcaccatgttggccaggctggtctcgaactcctgacctcaaatgatttgcccacctcggcctcccaaagtgctgggattacaggcttgagccag

SEQ ID NO: 21468 - DNA, 1061 bp, Homo sapiens
cttctaacctcaggtgatctgcctgcctcggcctccaagagtgctgggatgacaggcgtgagctgctgcacccagccagaaacccttacattttccttccttgcaattagcttttttcacttaaagatacattgtgggcatttttccatatattaatatatctagtcttacctcatttctttttaactgctgcatagagcatgactatatgaatattaccatagttgctttttattaaactgtttttaaacaattataagaatcacttggtgaagaaaaaaattgaaataatccataagaatacaaaaagaaaggtaaagttcctttaccccctaaaaacaaatgctgtcaatagttctgttttcagactttaattctggtagtcactagtatatttttaaaggatttacttatacctttggttcttgctatgttatcttttttttaaaaatttttattctgctatttttccacatgttcttgctatgttatcattaaagaatatccaaactgatagaaaagatgaatagagcacatttatacaacttccacatcccaaggtatgactagatagatatcttatttgtggtgatgttgatagttgttggagttatactggtaattattataatttcaaataatatatatatctctacacatatttatcaatttttagactatatatttactcccgtctcttttttttttttttttttttgagatggagtcttgccctattgcccaggctggagtgtggtggcatgatctcggctcactgcaagctccgcctcctgggttcaaacgattctcctgtgtcagcctcccaagtagctggaatcacaggtgcccgccaccacatctggctagttttttttgtatttttagtagagacggggtttgtccatgttagccaggctggtcttgaactcctgacctcaggtgatctgcccgccttggcctcccaaagttctaggattacaggtgtgagccactgtgcctggcttcccctctcttaaaaaagagggaattagtttattgcttccccctcacattgccccttc

SEQ ID NO: 21469 - DNA, 1057 bp, Homo sapiens
aggatgtgtgagccaagagcaggctggggcaccctccaactgacaaagcaagaaagattttccgttgagcacgatgaaccattggggcgcagttccttcctccctgcccctttccctgttggttttggagtgctcctttatttccagctcttaccttttctttttcaagttctaattgtctcactaagacaatgttttttgaccaaatcactccatgattgtccgtgactcatttatattctttgcatttattaattggaggttggaccttctggaattttctacttactgatggtgatacggactcttttttcctttgtattttctttctcagtctgatctgcttcctgacttcctggaaaccctccaaatttcttgatttctaatggcactctttctagatttctagccctgtacgataatattctttcatcatttcagtgggcttttggagggaggcggagatccaggtgatctgtctacactattcagtcagaaagctggatggtttttctcactgtttagctgtgactcatacttagaaagtggtttaaatgtgaatatcttagttctggttgtacaattgaggtaatcctcaattcaggttgctgtctggacatttcatgactggatttaaaaatatttttaaggccaggtggggtggctcacgtaattccagcactttgaaaggctgaggcgggcagatcacctaaggtcgggagttcgagaccagtctgaccaacatggagaaaacccttctctactaaaaatacaaaattagctgggtttggtggcacatgcctgtaatgctagctactcaggaggctgaggcaggagaatcattgaacctgggaggtagaggttgcggtgagctgaaatcacgccattgcactccaccctgggcatcaagagcaaaactctgtacccgcccccccccccccccccacctcaccaaaaagaaaaaacaacaaagaatttttaaaatctcacatttttttagctgggtgtggtggtgcacacctggaatcccagctacttgggaggaggattgcttgag

SEQ ID NO: 21470 - DNA, 1050 bp, Homo sapiens
atgtggactggaaacgtctcttaattctctctttcagcctcagtttcctcaataatagggatgatggctaccttacaaatttgacatggggattagaaaaatgtatgtgaaataattagcacattacctaataatagacacagtatcagcaaactaggggttatagattctttcttaaaactcgttttttcaatttgtatttccagttctctgtcaggtattgggaatatgtggatgaacaagatagacatttccccaagaagctgctcttctaaatttataggggttaaagttaaagtagagtttacccactgactgagaatgttgtcattcattcgtttcacagatacttactgagtacctgctgtgtgctaggcattgttctaagtgttaaggaaatagtgatggacagataggcaaggcccctgctcttagggagaaattatttcattggaagaagacagataaatacaagaataaatagtgataaatgctgaagaaatttaaatggatgtgattgactgtggcgctgtttgacttaataataagagataaacttctcttagaaggtaacatataaattgaggtgaacgtcaggaaggagctagctaggcaaagatctgggagaagaatattctagacctgtggtaggggtgggctttgggggtattacaagaatagaaaatctagtatgtggtgaatgagcctgagagggtgggagagagtgacaggcctcatagagttttcaggagaggcatggcacttgattcatagttaatggtctttttgcttgcttcttggataattaattgtagggtggcaagaataaaaacatggaaaagggtgaggaggcttttcagtagggtaaggtggtagtaatggagataggaagatatagactatttcagggtgtgtttggaacatagacatgttttgccctcaggaatggactacaccagtagatgtgttttgtttgacaacagtgtattgaatttaactagttttaggtaaagcctgtaatttccagctgacctcagtccttataattct

SEQ ID NO: 21471 - DNA, 1030 bp, Homo sapiens
ttgttctatatctactttttttttcctttttttctgttttagtgcaaaaagacatcgttctaggtaagtttctttttttctcatgctcattaaatcatttggcaatcataattttaatcatgagagctctttttttgacctttttttttaatgggccctttttgtggatgtacacttgacccttgaacaacccgagtttggactgtgtggttccacttataagcagatttctttcaaccaaacgtggatggaaaatacagtattcatggatgtgaaacccgagtgtagtcagtgctaactgtaggacttgaatattgcatattttggtacatgcaggggtcccggaaccagtcccccatgtatactgagggttgactgtaacagctacatggatacttctgaagattctgattagaaattttgaaagttctgtaaactgttccttttctccggggctgcttgcatagtttgttcatttttatttttgtctcttgaactgctcctttttttcttgtctgatttgtggctgtcttctaggctgcctagtgtgggcatccttatctgttgtgtatgtagctcttatttctcattggcttccacacaagagggacgttgttcctggccatttactgtagagtgtgcaggttggagtcttcaattttatgccagatgtttaatgctttcttctgggccgctgtaactgccatcgcttcgttctccacaggcattttctgtgccttgattgcaggcaagcccttccctccccgttgtcaggtgttcactgtcgtgtgtgcatggctgttgtctctggagtgggaaagaagggtgggtgctcctgccatgcttcatgccgggctttccgtccccactctcctgccctccccgactcccttctgccctctttctgactgtagtcaaggaacatttttgtgtttctccctggcagatttgtttccttttctgcttccgggcccttctgttcttggattgtggctttctctccccctgcacaccccatctgcttttcaga

SEQ ID NO: 21472 - DNA, 1088 bp, Homo sapiens
tgggaggctgaggcaggagaatcgcttgaacctggtaggtggaggttgcggtgagccgagatcgcgccattgcactccagcctgggtaataagagcgaaactccatctcaaaaagaaaaaaaaaagttgtacaaatggccagtaaacacatgaaaatatacccagtatcattagacatccaggaaatgcaattcaaaaccacaatgaggctgggcacaatggttcatgcctgtaatcccagcactttgggaggccgaggtgagcggatcatttgaggtcaggagttcgagaccagcctggccaacatggtgaacccctgcctctactaaaactacaaaaattagctgggcgtggtggcgggcgcctgtagtcccagctacttggggggctgaggcgggagaatcacttgaacctgggaggtggaggttgcagtgagccgagattgtgccactgcattccagcctgggtgacagagagagactctgtctcaaaaaaaaaaaaaagaaacaataaaaacagaaccacaatgagatgctgcttcacactcactaggataactataataataaaaaaaaaggaaaataacgtctttgtgaggatatggagaaattgaaatcctcatacattattggtagaaatgtaaagtggcatagccactttggaaagcagtttgacagttcctcaaaatgttaaatattgtgttaccatgtgactccgcatttgcactcctaggtatatacccaagagaaaggaaaccatatgtccacacagaaactttgttttgttttgttttgtttttttttgagacagagtcttgctctgtcacacctagtgcgtggtgtgatcttggctcagtgcagcctctgcctcttgagatccagtgattctcctgcctcagcctcgcaagtagctgggattacaggcatgcaccactacacccagctaatttttgtatatttagtagagacgggctactaaatatacaaatattggctaggctggtctcgaactcctgatctcaagtaatccatccacctgcctcggcctcccagagtgctgggattacaggcatgagccactgtgtccga

SEQ ID NO: 21473 - DNA, 1045 bp, Homo sapiens
tatttggcctctgctctcggacaccttagtcaggtgcagagaagagatgcagagccaattgtcagattggttttcataaacccaacaggccccaaatgtgcctgggaattatagggggtgagaaattaactctgattgaggcaggtactgaagctttctagaaaaaggatggagcctgtgccaggccttagatatgggaggaggaggaggacatgtcaggaagcaggaacagcatcagcaaaggccctgctgtaagcacgtgggttgtgttttgggaaacagccaggggttttgtgtggcaagtttacagcacctataggaggccacactggtaaataagcccagaaaagtagactggggccacattatgcatgactttgaaagccaggctgatgagcggagtgagcatcacatccatggagagcaggttttgctatcaaaggagttttcagacttttttggattttggaatagtggataaataatcattgacctgaatgtatccaatctttgattgctttagtatgctggattcttgtagacagaattgctaagacataggtgatgagtgttgttgagactcttaatgttgattgcaaaattgacctctaaagtgacattgccaacttagaagaccatgactgactgaggggtcatgttttattttgtgcttgctgagctgggtgttacagtgttgaaaactcctacagtggcctttctccttccctccctcctccctccttcctccctttctttcttttacttctcctgtgataggctcatctatacttttttgaaagaggtaaccatttgccacaccattttctggaaagtctgctttcttctcattgatttgtgatgccacatttattgtatcctgacttttgataacatgccagggtctgtttctgtcctgtcttctcaaagaggttaaatatttatcttgtattaaaatgttcataatggtttataattgactgaagttacaatagttttctcatgtcaaacaaaaaagacaccaaaatcttagtccattgactcattt

SEQ ID NO: 21474 - DNA, 1064 bp, Homo sapiens
tttatggagcagtaaaattgacatctttataatattgagtcttctaatccgtgaaactaacatatcacttcatttatatgttttaatttccctttgtattttatgagttttgtgcagatttttcacatcatcttgttagatttcttcctaagttgttgaaacttttatttttaatttttgtgggtacatagtagttgtatatatttatggggtacatgagatgttttggtacaggcatgcaatgtgtaataatcacatcatgggaagtggggtatccatcccctcaagcatttatcctctgtgttatgaacaatccaattatatactcttagttatttgtaaatgtacaattaaattattttgaccctgttgtgctatcaaatgaaacattaatattatgtttcttaactttattttctgtttgttttggctaaacaaatacacaattgtatttgttttttaaatatactcaccttatatccagcaaatttacttattaactctaattatctatcaactctttggatttcctgcatacatagttttgtcatctgagaataaaagttttatttcttcatttttaatttttatacctttgtttctttgtcttgccttccttgactggatggacctcaaaagagtattgatgtcatgatgttgggtttccctcattcattgggaactctttttggtatttcatctttcaatttgatgcatggtgtaaggtttttgttttgttttgttttaaattactggatcaacaacgtggtcttctaatctttgttcactagttttttgttctgttttggatttggttttcaccttgtaagaggattgaatcttgccgagtgcttctctagatctgttaagaacatgagcttgctctgttttgttgatgtgatgaattttgtcaaatgatttttgaatattaaactattcttttatacttgaaataaacctcactagggttgtaatgtgttatcttttgatatatcattggatttggcgtgtgctaatagtttgcttagaattttgcatttttgtgagtgagatgaatgctcttt

SEQ ID NO: 21475 - DNA, 1034 bp, Homo sapiens
gagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtggtaagtgtctgagtcgttggtcacattcataaaattacaaagtttattttctcttcttactggaaaatacccctttctgatagatttgaaaaatacctctcctgagcatggtggacgtggctcagaggatgagcaggagagcttcagaccttccacgtcaccactgagtcattcttctcctagtgaaatttctggaacgagttcatcagggtaagtgtgtaccttcttttttaaaaaataaaaatatgcgttcagtataggaactgggaaaaaaatgtgtaaagaagaaaaattatctgtgcattcgtctctcaaaggtaactcttgtaagctgtgaatttctttccagctatttttctgtgcaaacttttgtatattgcttttttttttactctttataaca

SEQ ID NO: 21476 - DNA, 1021 bp, Homo sapiens
ccgagcaagagcaggaatagctaggatccatgctcccagggacttgcaggtagcctcagtcctcctttctgccgttactgctttcattcatgctgatttcactttgtgacagttcgttgaaatgtctgtcttgccccatcctccagacgatgcatttcttggccaaagtggcttcctcaagaaagcagcacttacctttgaaaaatgctgggaacattgaagtttatttggatatcaaggtatgcacttccatgagagtgccataagatagtctttcctcagactgtgagagctccttgctttctgcaggctgttgtgctcttcctggcccaacagagtgccctgaacctcagatgaaagaatcgctgagagtttttaaaaactgggtgttatatagcataaaatatatgctgtggtgctttttaagtttaaagttcagtgtcttgaatatgagaaccaagttcttagattagttcctgaaaaacatgcatgtcaccctttggttagagttggtgaagaatgatccgcacacgttgacatcatttctgagacctgagggtgaatgagagggggttagtgatccaaaattgtgggtgaggtggaagataaggtttgttgtagaagagaaagaaatatcctttccaagagaataggacaagttgagaccgtgacagacaagaaggggacaaacaacctgtcctggtaaatgagaaacgcacgtaaggcaggagccactgagcgaaaactgcgtttttgtaagtcggcattcaattatgattatgtaactatatttaggtcccagaacaaggaagtcacttttcagtggatccaaagaatctactccttaaacctggagaagaacatgaggttattgtttcatttactccaaaggatcctgaagcctgcgaggaaaggtaatataaaaatgttataatggaccgggcacagtggctcatgcctgtaatcccagcactttgggaggccgaggtgggtggattacctgaggtcaggagttcgagac

SEQ ID NO: 21477 - DNA, 1100 bp, Homo sapiens
attgctgggtcaaatgatatttctagttccagatccttgaggaatcgccacactgtcttccacaatggttgaactaatttacactcccaccaacagtgtaaaagcgttcctatttctccatatcctctccagcatctgttgtttcctgactttttaatgatcgccattcttttgttgttgttgttgttgttgttatactttaagttctagggtacatgttcacaacgtgcaggtttgttacatatgtatacatgtgccttgttggtttactgcacccattaactcgtcatttacgttaggtatatctcctaatgctatcccttcccctgccccccatcccacaacaggcccccatgtgtgtgatgtttcccacccagtgtccaagtgttctcattgttcaattcccacctatgagtgagaacatgcggtgtttggttttctgaccttgtgatagtttgctgagaatgatggtttccagcttcatccatcttcctgcaaaggacgtgaactcatcctttattatggctgcatagtattccatggtgtatatatgccacattttcttaatccagtctatcactgacggacatttgggttggttccaagtctttgctattgtgaatagtgccgcaataaacatatgtgtgcatgtgtctttatagtagcatgaattataatcctttgggtatatacccagtaatgggattgctgcgtcaaatgtatttctaattctagatccttgaggaattgccacactctcttccacaatgattgaactagtttacactcccaccaacagtgtaaaagttttcctatttctccacatcctctccagcacctgttgtttcctgactttttaatgatcaccattctgactggtgtgagatgatatctcattgtggttttgatttgcatttctctgatgaccagtgatgatgagcatttttttcatgtgtctgttggctgcataaatgtcttcttttgagaagtgtctgttcatatcctttgcccactttttgatggggttgtttgtttttttcttgtaaatttgttcaagttctttgtagattctggatattagccctttgacagatgggtag

SEQ ID NO: 21478 - DNA, 1050 bp, Homo sapiens
tactggatatatacccaaaagacagcagattgttctactaaaaagatacatgcacttgcacattcatcacagcactattcacagtatcagagacatggatcaatccaccgttgatcaccggtggattggatgaagaaatggtggattggtacatgtatatcatggaatactgtgcagccgtagaatcaaatcatgacctttgtagcaacatggatacagctgaaggcgattatcctaaatgaattaacatgggaatagaaaaccaaataccacattttctcacttataagttggagctaaatattgggtactcatggatataaagatgacagcaatagaaactggggactactggaagtgggaaaagggctgaaaaattaactattgggtactatgctcagtacctgggtgatgggatcattcatacctcaaacctgagcatcgtgcagtatacccaggtaacaaacctgcgcatgtaccccctgaatctaaaataaaagttgaaaaaggaaaacggaacaacaataagcccattttccatagtggtaaagatacaggtgtcatacatctattttaaaaagaaaaaaaattgaaattaatgagctaagcagtcatttgaagaatggtgaaaataataaatccaaagaaagaagaaaaaaaagttctaaagcaaaacatagtaaaattaaagaaatgagagaagattaacatctccaaagctgcttttttggaaaaaataataataatagacaaacctttggcaaaattgaccaaggcaggaaagagacaattttacacgaaaagcatttgtcaagtgagaatctagcagaatgagattagttaaaaattcaaaaaaactttaaaagaattaaaggtaaataaatgtgttgcaaaaagaatgacttaagtatcaaagacttctaaaatgcctctttcatgaacccctcgaatatgttttccaaaatggtctttatgggttgtcctgagaatttatacaccttataccattgtataactttgtcccctgccctgcaaaaaaattgcaccaaa

SEQ ID NO: 21479 - DNA, 1061 bp, Homo sapiens
gcctcctgggttcaagtgattctcctgtctcagcctcccgagtagctgggactacaggtgcccaccaccacgcctggctaattttttgtatttttagtagagatgggggtttcaccatgttagccaggatggtctcgatctcctgaccttgtgatccacctgccttggcctcccaaagtgctgggattgcaggcgtgagccaccgtgcccggcctgagttgacacctaatattaaccatcacacttacctagtaccatatacagagattcaccgaaaatcaaccatagaccataaacattagacctaaagctataaaacctctaaaagacaacataggaataaatcttcatgaccttaggttaagcattggtttcttagatttgacaccagtaaagcacaagccacaaaagagaaaataggtgaattatcaaaatcaaaaagatctgtgcttcaaacaacaccatcaagacaatgaaagacagagaatagggacaaaaatttgcaaatgatgtatttgacaaaggacttgtatccagaatacgtaaagaactcttacaacccagtaaaaagaaatggcccaattttttaagtgagcagaggatttgaatagacattttcccaaagaaaacatacaagtggtcaataaacatgtgagaagatgcttagaattcctagtcattagcaaaatgcaatcaaaacgagaaatgaagtatcacttaatacccactaagatggctgtgagttttaaaaaaacagaaaataacaggtgttggtgaggatgtggggaaattggaaccctgatgcattgctggagggtatgtgaaatggtacagccgctatggaaaataatttggcagtttctcaataagccaaacatagaattactgcatgacccagcagttccacttctggatatacactagaaaagttgaagcagattttcaaacaaaaacttgttcacaagtgttcacagcagtgttattcacaatagacaaaaaagtgggaatcacccaaatgtctgatgggtcgataaacaaaatctggtatatctgtaaaatga

SEQ ID NO: 21480 - DNA, 1471 bp, Homo sapiens
tagagtagttcctctttcaaatgttatttgcactggtatgctgagagtcaaggacttagattttcattaactgggacaaaaacctttccgagttaattgggaaaacttttattgtggtgttttccagttgccattctttagacactccttactgttcttaatcagggcctcattttcttgtcgctcttgctaattttcttttctatatgatgcacatttaggttgaacctcgaactgggttgtcactgttatttagaacttaatagttagggttctgttgggcttaatgctgaagaataattttaatttcatctttgaatctttaagtcatttaattattgtaaagtctctcattttagcattaggagactattccagaaacgtgttctattctatgaaaatttggaccactctgcaaacattctaggcctgccatttatgcacttactaagaccagcggtgctgtacagttgaagctcacagccctggatactggaaagatggctcgattgaggactgttccttccaccttactctttctttttattcgtttatctctcacaccacctcttccttctcctatggactataaaatgttttaatatgcttgagggctaaacccttcctttccctcccaggagactgacctaaaggcacaaactatagattttagttctgaaaattcaacaatgaatacatctaaaaattatcataaacttgataaactctttggcctcaatttccttatttgtaaaatggagatgccagtgctagctactgacagcatagaattgtgaggaatgtaagagacgtggtaataatgcccagacatagcaagcgtcaggtgttaacatcatcatcatcatcatcattaaatctcccctgtaggtgaccttggctggcaggatgcatcaacactcactctacagattttgatagaacctcattttattatcagtgtgtcttcatttaatccctatgacaactacatagaagagaaaggcccaagtttaaaaatcagccaaatccaagttttccaacttctgttctccaagttctcctctcatagtagtctgtggatctccagttattgtaggctgccccaattgatttgagactagtgatgctctagtgtgcgtaataataggttggaactactaaaatacatggtagcacaactgcagaggcaattagtttattcagaaaaagatcatttaaatttctaattgttgtaactgtttttagtaactgagtacaaatagatactgaataaattatcctgaacactgttattatctaaactcaaattttatcataactgcattattcattctgcttcctcagattggttcacatcccacatcttcaccagctttttgcagggtatatttttaaacatgcagtggatcaatggaatacttctgttcaaactggcatacatctgtcacaaattggagggactttagatttt

SEQ ID NO: 21481 - DNA, 1056 bp, Homo sapiens
gggtcatactgtgcccgagcccagggaataccagtggctcctgtgtgtggaagcctggcgtgggtgcagggcttcttcaccatctccctgcaaagtcagctgcatcgtgcatgtcacctggacttactaataacatcaaacatatcttccctatccagtggcttgtacacaaagttaaatctgtagaagaagcagaatgtgttttaaagaatcaactggcaccttgaaatgttaagcattgtatactgactgagctatgatggtggtagtctggtgactcccaagggggaaaagtaactttgtgtggtttttcagggaatacatattcttgaatacctgcaagaaatagcatagctgctgtggcttaaatatacatgctcctatgaggctataagccttctctagtagaaataaaccatcatgtatatattttgatatgtgtgcttttaatgtttgtacaaaaagaattgtatttggggttttgtgtgtgagactgaggactgtgtgctgaggaaggcagaatttgtaaagttggagctttgggactcccaagtaccctggaagatcactggctcccctctcatactgtgcaaagagaagacctgaggctgcgaggcggggtgccttgcccaggaccccaccggcagcccagggtggaggcaggagcagaaccagcgctcttgcctcttccgtcaagggctcctgcgcctggcgggcatctctcgtgcatccctccagcgcggtttcacgagtgctgtgcccagaagccaggaggcatgacctgtcatgttagagcaggaacagagtgccgtagatgacttctgcttcgcaagaggcgaccgccaaatcagaccgggctgtgattcttctgtataagcttgtgagatgttttagggtcctctgtcaggataggctgaggtatatgaatctgctagggctgtcctaacaaagtaccacagaccgggtgacttaaatgacagaaatgtattttctgtcaggtctggaggctctaaatccaagatcaaggtgctgtcagggttggcttctggtcaggcc

SEQ ID NO: 21482 - DNA, 1072 bp, Homo sapiens
gggaggcctgcaataaggcacccggtgccagcatggagccccattgtcctcactcttcctcctgggcctgtcccggtagagatacccggaaccctctccttctcctggcttatttcggggtgggtgtgtgagaattggctgtgagatgagtgacagcaggatgaaggaatttggcatctttagttcatctttatatgatcagcccctgcacccaagaatttcttggtggcgttcacactaagaagtgtcagagtgggcagagggaatgcattgggttgtatttcagtgaggggtctaggctgctgaggatttctctctggaggcctccatctggtcttgcatttctgaggctgaacagacacctctcatgatcagagatggggtgtgggaaggaaggaagggtggtgaactgggagccggcagcgcgtcccagcgctgaacccgtggcacctggctgcttggctgtgagggctgatcttccagtgcccgagtccccgctgtgagcgccctgaggagcatgtgtgtctccgcactatgccctcagcggccgctggagtggggctcgtgtgtgccctgcagctgaaggggaaggaggccgaactggccggggtgtccgtggttgggggggtacaggtgttgggagtgggaagcatttccagccagtgagtttagggatgctgcctactcggtcctatcttggagagcctcagtgtacctttagcgtgctggagacgccagtggtccttctgtacagaaaacctcagtgttatttaacccagaatgtcctaaatgtatgcgaacccagaacactctttccccacaactccagtcagcgcagagtaacctgtgctggaccagatgagcttgaaggagacttcccgctggaccattctcgaacttgagagtggagtagagggtgctgttgcatatttagagggtgatagggtgacagaaggctggggcttggggcgaggggggtggggaagattctcttaacagagctctggctctgcattctaaaattaagtcctgtgggtcacgtctgcacccacagtgccagcaggaaccgtag

SEQ ID NO: 21483 - DNA, 1024 bp, Homo sapiens
tccagaaggcacgatagtgaaaggagggagaaggatgcccggtgcacacactagccataaggaagctggtgcaccaatgtcaggtgaagcagacatcaaagcatcgggcattgccaaagatagcagcttctcacagtggtaacaggtgaattcccaaggatgatagtttactgtaaaggcagggtctatagccacaaaaaagatatttcttaaattgcccctacacgtatcctaagctctcagggatagcttcaacctgtagagactcccagtttctttagcccgaagcctaaggtacacatccccaaagcaatttggatggaagatcctgacctgctcagctattcagatgatttttttactgaaagagtatttcatttttgtctcaattcattttgatggacttacagataagatttcttcactagaaggcattcatcacttaaaaaattaatatttgaaattggttatcctttatctttttaataaattgaacaattaggattggtagaacaatggtacacctgtctattttccgtgggtgccactgggaagaccttacagtattgttgaagtgtatctgttgaacctggcaacattcaaggcaggctgagttaaagaaagcacgtcacaagacagtatgtgcactgtgatcccacttcagttaaaaatgtgtatgtttatattcatatagagaaaagtctggaagaataacccaaaatataagtaatgtttctgtctgagtggtgggattatgggtgattttatcttctctgtttatttctatttttgtattttctccaatgaacgtttgttactcctataataaaaataaaagccatttaagaaaaaattttttatcatatgacaccaactgtttctactagaggaatctatgtcttcttttaatctttatcagtgtacacagttgaatttcacattatgttaaatatttgtctctctgtgtcatctggaatagaattttctgcattaccgtgtggttgagtatacatctgccactcgt

SEQ ID NO: 21484 - DNA, 1025 bp, Homo sapiens
aatgatggtgcatatacttagaacacacagacatccactcatagactttacatcatctctagattacttatgataccacatacaatataaatgttgtgtaaatagttgttatactatattttaaaaatttgtattgttttttattttttagacagggtcttgctgtgtcacccaggctggaatgcagtggcgccatcgtagctcactgcagtctcaacctcctgggctcaagtgatcctcccgtcttggcctcttgagtagcttggactacaggcacatgccaccacatctggctaattgtttattttttgtagagacggagttttgccatgttgcctaggttggtctcaaactcctgggctcaagcgatcctcctgccttggcctcccaaagtgctaggattacaggtgtgagccactgcgcctggcctattttttattgttttattgttatttgtatttttgcctcaatattttcagtctgcagttagttgaatctgcaaatgtagaaactgtggatacagagggctgacggtacagctgtagagattgtacagaagaaaatacattaataaatgtttctagatgccatattgtattttaaagaattcctttaaagaagctatattccagttgccaagtagacaacaggcctccagactccctaaggagatgggggtgtgcccatttcacacgagggttctgtcctaggcttgctgggtccgccaaccctgagggagagaccagccacagctgctgttgggtttgcctgacttttatttttttgtttttgtttttttttagacggagtctctctctgtcgctctgtcgcccaggctggagagcagtggtgagatctcagctcactgcaagctccgcctgcctggttcatgccattctcttgcctcagcctcccaagtagctgggactacaggcacccgccaccacacctgcctaattttttgtatttttagtagagacagagtttcaccctgttagccaggatggtctctatctcctgacctc

SEQ ID NO: 21485 - DNA, 1045 bp, Homo sapiens
aaatgctttgaccagaagaagccttgctgttggtgtagggatgacggaggaaaggacgtggttcacttacgggccatgaggtgagccgcggaggcccactcctagatttattgacttcacatgtgttcctggagcacttgctgtataccagacactgtagtaggcactggggacacagggctgagtaaggtggaggcagaccccatgttcatggaattcacacatgtctggggagacagaatagagtaatcaaatgtatcctgccatttcagacagcattcaggtcccgtagaaaatcaagtatgggaaggagatgggcaagagatggggggaatggccgttgctgataggagggcaaggtgaggcctcgctaaggacaagggagggcaagggcacatagagagcagggagtgtgggctcaggaaagagcagccagggcagaggactcgggctggaacagagttggtgtttggggaacagtgtgtcagttgtccagaggccacatgcccaggagcagacaggcaggtgggcagtcactgtaatttcattcatttccaaaggaagggagaagctgggtaagactgtcagttttggctaggaatgtttgctatatatttaatacatttatattgtctttttctaaatcatcgctttgaaaaaaaaaaaaaaaactgtccctttctccaacactgagtttcaccacagtagaagggctttatatttagggttactgcactttatgtatttcctggctccttgtaagtgcattgctcagatgtgttggtgtgagcgtgagaggagcaggttgggggttgggcggactctcctgtgcgtccccgaggccctgggaaggaagtcacccaccccgtagtggagaggatgccccgtgctcaggtctggacagcctgggcctgtcttcaggagagtctggtgcaggaagcaaatgatgatgttttgcttggtctttgtcccccagatgcaggctgcagccatttggggtcagacacgtggagaatggggtctgctcccagcctgggttcacttc

SEQ ID NO: 21486 - DNA, 1041 bp, Homo sapiens
tctattataacatttaccatggtgtttctatttgaatgaatgagattcattcacttctctctcatccattcatatgatattgatcaagtgcctattatggactaggtacatgaggaactagagagacagcagtgaaggttcagacagggtccccgactttatgggcctccactccagcagggcaggtggactgaactagctatataattacggtggtgagaaaaggatttgtttacctgttagcatttctagattatgagctcttggagggcatggatttttgtcttccttgtttttgaagccccagtgtcttagaatagcacccggcagccagtaggcgctccgtaagtgaacgaatgaactgagcacttaatgtaccaatttgtacatgatcttatggacgatcactttgctcccagcagcttctcaaatttttattgatctatgaaccgagctgagaagttcatagttgaagactgtcctgagcttcctggatgcgctgcttccttctcctggtacgtagtaagggcagcgtgtgtgacctgacaggatcacagcaaggctgtgcatcagtcaggattcttcttgcaggcaacagccaccaccagcaggaagggctcctcttgagccttgctgtcttctcatgtttccagtgccacgtcaagcccaggatggtgctttgagtggagcttgggtcgcatgactgtgcttggctgtaaggaaggttggaatccagtgctgtgcttgtatctgcgttttctgttgcaaaggcactccctttcccacagacctatcaagtggggagggaaggaggtttcagtgcttggcaagaaatatcactgtacgtgttcactactcactgacatgtaattggtcaactgttcgtaaattccggctattttgtgtttaagctgatagagaattctgacaaagtaaatgtgagcttctgcggaagtttctatcacagtatttttaaacatgcatcaatatctttgtaaattgaattgctccgtttaacctcatctcatagtgtgatcaatc

SEQ ID NO: 21487 - DNA, 1028 bp, Homo sapiens
gttgactggagactgttgatcctttctctgctgcctcccagcatcctatgagcatggctgccaggtgaacagtgcccatgaggctctgtggtagacttggtgcctgccacggtgcctggcgcatgtagcatatggggcatggccctgtaaatatttgctgagtgtagggatgaatattattattttagaaaactcaagcctgaccagaggatgaaaaaggcttttgcttgcaaggcctagtaccttgcaagtggaagcagggattgaaaatatccacgtgatgctggcagcctgcatgagaagacaaaggaaaagactacataaggctggtgcccacaaactgcctgtccttcccatgtgtgtttagactgccataaacacccaaaccaaccaaagtagaagcctactctggtaagcatttattctgggaccagcagtgtgataggcttttactgtgcgtgtgaccagtcagggcttcccagtgctgcagccctggagggacagacctttggcctctaaatatccatctgctgtgtaggaaggaccagtcctgccaagcacagaggaaatgtggagtgcttctggccggccctaaagacatgtaagtgtgtgagcaggtgtgagtctgtgtgtgtatgcatgagatgtgagtatgccagagtgtgtgggactgtgtgtggtatttgtgcacaagtatgtgtgagaatgtgtagttgtgtgcacaagtgtgtgggtgtcagagagtgtgtgtgagtctggtgtgtgcatgcatgtgactccatgtggtgtgtgcatgcatgcgtgggtgtgccatgggtggagtgtgtatgcaggtgtatgaatatgtccatgtgtgtgagggtgagtctgtggtgcgtttgtgcatgaatgtgcacgtgtgtgtataagagtgcatctgtgtacatgtctatgtgtgtgtttgtgcatgtgtgtgtgtatgcgtgagggtctatggtacatgtattcatgagtgtgtgtgcgtgtgtgtgtgagagagtctgatgcat

SEQ ID NO: 21488 - DNA, 1028 bp, Homo sapiens
ttatgaatttctgcgaatttcttcatgctgggtctcttccgggcagctccacaactggcagagctgtaggaaagcgggtaaaaaaatccccagcgcctgcctggctgcgcttgggtgcctgcgtagtcgtgatgcttgtcttcctaattattttctgagtggcggggatggagtttatgtgatgtcagaagtgagtttctgctcatgaagactcccagtgtaagtgtggtgggagtcgggaaggagatattgaggtaaagatgagattggggggcggaggctgggggaccaccgataaggcgggaggtgacgcagcagcttgccgttcggctgggaggtgctttgtcgcttggtttgatggccgctaatcacgtcttggtcttgaaaaaaattatccaaaagggtactacggtgaaacttggaagggaccatctttgagtaactgaagaaataaagctgaagtctaaagctgccatgagatacgtcgtggactgcagaggtgggtgaccctccgagggctggacttctggattcatcctctgggctggtgcctctttcagtcatggcagctttaacatgggaaagaaaccccaacaacctaaactttgcagtaatcattttttcactccttcatccattcttgttctgtcccaagagctaataacagagggaaaagaagatattttttgcttccttcccagaaagaaaacagagatcaaagataaaaaatattttcaaagtagacaatcactggagagggaagaaagaaatcttgtttcaggagtttgcagtagtgagcagcgagtgagtctgtcctttttccagacagctcctagaaaaattgccgtggtcctccggaaggtccagctgtccttagaggggcaccttcttgccctagaccctttgcttgctgttcacaccaggaccatccactcagggcagaaacttttcattccctgggatggcctgtagggaaggggcacatggcagggggctgggctgtgggcatcagcacttctcctgccagc

SEQ ID NO: 21489 - DNA, 1062 bp, Homo sapiens
tggtgaaagctttaaaccctaagacaaggaacaagagaggatacccacttttaccaatgctgttcaacattgtactccaggttctagccagagcaactagacaagaaaaagaaataaaaggcatccaattgcaaagaaaagaatgaaaactatccctgttcaaaaatgacatgatcttatgtatagagtatctccgagatgccacaagaaagctactagaacaaatagatgaattcagcagaattgctgggaacaacatcaacatgcaaaaatcaagtgtgtttctatacatgtgccatgaacaatctgaaaaggaaattaacaaagtcatttcatttaaattagctctaaaagaataaaatacctagaagtaaatttaacccaggaagaaagatttgtacactgaaaacaatacaaaatattgctgaaagaaattaaagaatacctaattaaatggaaagacgttccatattcatgggtaagaagacttagtatagctaacacataaatactacctaaagccatctacagatgcaatacaatccctatcaaaattctaacagcctttcacttttgcaaaagctgatcttaagattcatatagaatttcaaggcacaccttacagccaacacactcttgagaaagaacaaagtcagaggactcacacttcccagtttcaaaatttacaaaagtactgtaatcaacacggtgtggcgtggacttcaggatagatgcatagacctatgaagagaactgagagtccggacatccacacagctatggctggatgattggatgatttttgataagggctccaagtccatttaatgggaaagaatagtcttttcaacaaatgatgctggggcaactgggttcctgcatcaaaagaagggagttggaccctatctcatatcaggtacaaaaattagcttgaaatgtatcaacgacttacatttaagagccaagagcataaaattcgtaggagaaaacataggggtaagttttcatgatgttggatatggcagtggattcttagctataacacccaaagtatgaacaaca

SEQ ID NO: 21490 - DNA, 1052 bp, Homo sapiens
ttctttctctttccctcctccggaggttggcattgtgtattttcaaattgtgttgctttttttttttgcagaatcttgtagggtgtgttgtgaaaagtctgccagccaggtgggtgggtattattaataatccatagaaacccaaggggtccggagtgagaggagaaacatgacgtgcctgtgtgtgcacaggacgcctgacactcgctcacacacgcatgtccctctctctgagagccagggaatggggtgggggttggtttggtttaatgcatgataaaaacaggggcattctgtaataacagagctttcatttcaagattcttaacaactaaaataatattttgaaacatttggaattgtactagaaatgtgtgtttgatatgttcaacctaagaaaacatcacacttaaaatgcttttactccactggcttcagacctctttgaaattggtgcctacacagctgagaagtccgggtaggtgccgtaggcaaattgaggggagaaagtgacatcttgtgtaacgctgcaaattcgcggaaggctttgaaccgtcaccagagtagcaaatactcattgtgaaagtttttgcaatgaggtacggaaaaccatttcagctgctctgattgtcagctctcctgtgttttctttagctcctgacttaaagttacgtgtcctgtcagttttgatactcttactacttagtgctttaggttttatcagctggtgccacatcttttaaaattctgtcccactagcctctgtgctggtcctgaccgattcaccagctcttgggactgtgtccagatgccttttgtgatgcctcttttctaaaatgcttttatttgggtttaagatgtactaattctttcacacacccatagctgaataccaaatattggtatgcatactaccaaacttttgtgtatgaagttcgtacaaggcactaagtcatttaaaacattttaattgtgtgctgagctcgtaagtgtacaatatgactgtctagtaaattcttaattatttgtcgactctttatcgaagaaaaaag

SEQ ID NO: 21491 - DNA, 1091 bp, Homo sapiens
ctcctgccctccatgtaggaggctgggacactccctcctggcttcctagtgactgtcgtctgcctttctacccaaagttgtggcttctgcacctggcctcacacttcactgcctgatatgctgccctggacaacctacctgggctttcctacagcagcctggtagcagatccctgagagtgggggctcttccccacctgagtctaaaagtatatgggggaaaacacagtgactcctagcccacatctgccagtagtcttcctctgccagcactgagctggagacgccttacctgcgttaccctgttagtcctcacagcagaattgagcaccattattactattattattttgagatggagtcttgctctgtcgcccaggctgtagtgcagtggtgccatcttggctcactgcaacctccgcttcacaggttcaagcaattcttctgcctcagcctcctgagtagctgggattacagatgtgcaccaccacgcctggctaattttcgtatctgtaatagagatggggttttgccatgttagccgggctggtctcaaactcctgacctcgggtgatccacccaccttcaccttccaaagtgctgagattacaggcatgagccaccacgcccagcccagagttgagcgctgttattatcatctgttttcaacctctcaacaaggttagtataatttacgtaagtttgcaaatttatgccactttcaaaaagaatagtttgctcttctacaactagcttgttgcagagttagattctgcagtaacacccgtggttcccattgcacaccccactggctcctgcatagcagcgttcccccaactgtaggatacatgactcccagggggttccaggaagatgcagattctgattctgatgttgggagtgaggcctgggcatctgcctctctcacaagctcccagtgatgcccctgctgttggtctgtggcccacgctttgggtagcgagagcttagatcctcggccgtggttctagcttcccaatgctttggatcacaggaggccagagacactggcccaactgatgtcagaatgatgggaagtcgaaatagcagcat

SEQ ID NO: 21492 - DNA, 1035 bp, Homo sapiens
tctacttttttctcttctggaatatagtacagtagaaacatgcattatgtcatccttgcagttttgcttctttcatttagggttatgtttttgagactcatccatataatggtgtgtttccatggttcattctgttgtactgctgagtagtgttctatggtgtggatgtaccctactctgttcatccactcatccattgacggaactgttcattgtttccagtttggggctattagaaataatatttctgtgaatattcacatagaagtctttgtgtgggcatatattttcatttttctttgttaaatacctgagagttgactggccgggttatatgtgtttaatttaatgggtaacgctatactggttttcaaagtggctttaacattttgtattccagccagcaatgaatgggggttctgattgagccacattctcatcaacacttgatattatcagtccttttacctttagtcattctggtggttgtgtagtgcatcttactgttgtttgaatatgcatttccctcatgactagtgatgttgagcatctctttatgtccctcttgcttatctgtgtctttacttttgtgatatgttgttttaaatcttttgcacattttttattgggttgtctattgatttgtaagaaaactatatatgttttgaatacaaactttttgttagatatatattttccgcaaatattttctcctagtctgtggtttgttttttgtttttcttagctgttttcaaagatgaagagctttttatttgtatgaggtccatttcataatttttcttatataaattgtggatttcatgtcctgtttaagaaatctttgcccaacctaatgtcacaaagattttctcccatgttttcttctataagtttaacagtttcagcttttatgtttagttctatgatcctatcaagttaatttgtggatatggtatgagttaagagtcaagttcactttttgaaataaagatacaattgtttcagctccatttggtgaaaaggccatcttttccc

SEQ ID NO: 21493 - DNA, 1030 bp, Homo sapiens
agattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtcgtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcat

SEQ ID NO: 21494 - DNA, 1050 bp, Homo sapiens
gagcagcacatcagaaagcacagagtgagaaggaagggactgcttttcttttacttcctttctatattgtatgttgaagttcaaagcaccttagagaagattttcagttcagttgagaaatatgtaattttctgaattactaattttttctgctgttttataggacagtaataccccacttttattcgctataatttgcaagaaagagaaaatggtggaatttttattgaaaaacaaagcaagtacacatgccgttgataggctgagatggtacagtagttctttttttttttaaataaaaactgtgtattctagagtggtaacagtcactgaagtcagaaatattaataagaagattaacgtaattattggcatatagtgaaaaatatcaccatgaataatcagatagatcagcaaatatttggactgagtaacataaagaacagtatatagtaggattcatcttctcctaaatatagagtgtttgttatttataattggatgtttttggtactgtaatcttgtattagctaaagggttttgtattagctttattaagtttttttggagatgcaatctggctctgttgccaggctggagtacagtggtgtgatggctcactgcaacctccacctctcaggctcaagtgattctcctgcctcagccttccaagtagctggggctacaggtgcacgccgccatgcccagctaatttttgtatttttagtagagatgggatttcaccatgttggccaggatggtctcgatctcttgacctcgtgatctgctctccttggctcctcaaagtgctgggattacaggcatgagccactgcacctggccagttttattaatttttaaagtgtggacttttagtttatgactactagcattgtcattattattattgttgttgttgttgttgttgttttcagcctgcagatagctcttatctgacccctagctgatttgaattatatatcagactaggaaagcaatggcgaaatcttcatctaaatctttacctactttagataagtgacctcagca

SEQ ID NO: 21495 - DNA, 1023 bp, Homo sapiens
tgaaagatgcacaggtacagcttgggtcactgctacagagggtgccgcctagaagccttggtaacttcctcatagtgttaagccactggtggacgcagcatgagactagaggcttgggaaccttgctatagattttggaagatatatggaaatgactggctgtccaggcaaaagcatcccaaaaaggcagagccttatatgaaacttctactagggcaacacagaaggaaaatatggtgttggagcccccacactggaggccaccatcatgcagacccgagattcatagaccccccaacaacttgtattctcagtggggaaaagtcacaggcactcaacaccagccgagcccctgagggcagccgtggggcataaaccctgcaaagccacaggtgccaagctgcccaaggccttgtgagcctagccctcacacccctgtgccctggatgtgggacaaggtttcaaaaaggctgattttggagctgtaggatggaatgactggccttctgggtttggagtttcatggggccggtaagtcctatctgtgttttgttgttttctggcaacattcttccttttggctgggaatgtttacccaatgtgtgtacaagcattgtaccttggaagtagttaagttgctttatatttcagaggctcatgggcctaagaaactgtagccttgtgtcagatgagacattaagctttgaacatttgtataaatgctgtaatgatataagattttgggggactgtaaggaagacatcattgtattttgcaatgtgagaaggacatgagatttggggagccagggacagaataataaaattcagctctgtgtctctaccaaaacttatgtggaattgtcatcggaatgttaaaggtggtgcctggtggaaagtgatttaatcagggtggagactgggggttggaagatgaggcatagggggaatgggggatttatggtgcgggagaggagtgaaaattgggggtggggggcggatccttcacaaatgattaaacact

SEQ ID NO: 21496 - DNA, 1032 bp, Homo sapiens
aacaccatgttattaaaaatcaagttgtagtaaatatctatgaaaatagtgttacatatgtcgtgaaactatttctattgtagaatctttttttttttatttaggtagataacttagttacaaggggtttggggatcactttttctcttgtcacaaacgcacatgagtatgacagagctttccctttttagcctacagctcttatagtaggatgggttgactttcactaaaacatgagcagaggcacttgagaactctctaaataacatccgtatcagctggattcttgttagatattcaaaatctcaggccccatcccgagcttactgaatcagaatctctggcaggacccaggaatctttattaacaaactgtctgcttactagtggtatctgccttctatcactgaattgctcaagcttcagttgttttatcttggccaagttaaatctgacctctgtccaggtactgttgttaagtgctggggatgctgcagggaagaaaagtgagagatatctggccgggtgtggtggctcatgcctgtaatctcagcactttgggagaccaaggtcggtggatcacctgaggtcaggagtttgagaccagcctggccaacatggtgaaaccctgtctctactaaaaaaaaaaatacaaaattagccaggcatcgtggtgtatgcctgtaatcccagctacttgggaggctgaggcaggagaatcatttgaactccggaggcggaagttgcggtgagctgagattgcgccattgcactccagcctggcaacaagagcaaaactctgtctttaaaaaaaaaaaaaaaagtgacaaatatctctgttctcaggagaatcaaacaatgaacaaaagaaattgaggaaaatatgatgttttttaggtagtgagaagtgccagagagaaaagtagagcagaaaggggaattagaaagtaagctggaggttgcaattttctacgggtgtcattgagaagtgacttgagtgaagacacaaagaggtgagggactgagccactgg

SEQ ID NO: 21497 - DNA, 1031 bp, Homo sapiens
tctcattttattcaaaccatgttcctcaaaccattactaatataggaaaatatttatataacataatatgtaaaggtgttttttgtcctgtttcccaatacctaaattacaaaagaattcaattgaacttatatcaaatggaattttatgcccatttaattttttaaaaactagaagatgtttttaacttgttcatgaggcatcgaacgtattataaaatttgaaatggtattggtgatgttaagaaaatcatggtatgatccttaagttgttagtgacacttcatggatattaaggtacctataaataatactaaaactgtggcattccttttttttcatggtgggggtatgaatttgaccactgttcaactcatatcctttttttttgtcttattgagcagaaactaactttagttagtataccgcttttgagatgttctttatatagaaatttaaggcatgagaaattatcatttagaaagaaaatgaatgaaagctcatttggaccttcagactatgtttaaagcacattgtacacgattaattagtacataactattctactgatgtagattatattgagaaataaatatttgaaacatagatcttaaagcattttcttataaattcactttttagaaatttggattttcagcaattttatatcactgaaagctgtgtgtactctaatttggtccttgatatatttctcatcatgagcagtattaaaaaacaatagacaaaatatttaccataagtatgttatttttaaatacatttccttttaattgaatgaaattaaattttctacctgatttgtggaccatcagagaaaagaagatacatattaaggagggaaaaaaaggaaagagactgaaagattaattagaacttattccttgtacaataatattttagctttaaactgttagtcctttatattaggatccactaaaaatcttaagttagcctgctaaattttagctcctcacagtagctggttttccagagacttaacatgcaaaggac

SEQ ID NO: 21498 - DNA, 1032 bp, Homo sapiens
ctcatctctttacagttgaattgccttgtgactccccagtgcagaattttctctgaaaccactgataacttcaaaatcaagcatctgatcaaaataaactgctttgagatctaacctataattcatttgtgtagataaaggtatgttgtttaggtagaatcaaagggcctgatcacaagaaaaaagcttaattgttagttccttagggatctaattatgtagcagatgggaccacacagcacagtttgctgttatttagtgtaattaattttagatctgcatccagaaaaaaaaaaaacgatgacaacaaatgacacaaaatcttagtttgcatccatatagggcactatccacttataattgttgttcctcttctcttttggatcactttaatctactccttactctattcgatgctaataaggtctcagaattgcttatttgctttaaatgcatgagtagtttggatacactgatattaagggtgtcatggatgttcattggaatagaatactcggatttagaggattggttaattaaactgtaaaataagccagagttaaaagctacaacaacaacaagaccaagacaagttctactttagtttccccctgctttaatccgaaactagttcaggggactagttcgaggtagaggggaaggtcttatcctttctccccctccccccctcctggtcacccttcacccccgccccacgccccccaacctctgactctccttcaaatctcactgaggaattatagtctctacagaggcttggttgcagatgcctggaaagtttacactgcagagagttgttttgtttggcatagctaatcaggagccaggctggaattgctcatagctgtcattcaggttttgtttcaaagtccaaggacctgctgggaaaaacaaaaagctaatgaaagctgactgtatttaggcctcaaatctgtagaaactgaaatgatgtcctgacagtgtattcttattcttccacattcttgctgttactaaggtaacagattttta

SEQ ID NO: 21499 - DNA, 1086 bp, Homo sapiens
tttttgttacaagtatgttattttaaaatttttaattatttatttttttagagctggggtcttcttcttttgcccaggctgaagtgcagtagcagtatatataataaacaaaaagcctggccaacatagtgaaatctcatctctactaaaaatgcaaaattagctgggcgtggtggtgctcgcctgtaatcccagctactcgggaggctgaggcaggggaatcacttgaacctgggaggcagaggttgcagtgagctgaaattgcaccactgcactccagcctggatgacagcctggatgacaggattaaataaaataaagtgttaatattctctacatataaaacattcttccaatcaattttaaaagaacaaatacctcagaagaaagggatctagggcagaagttgacaaactcatcctagaccaaatccagtccatgtcttattttgaaaataaagttttattgaaacatggccatgcttgttcacttgcatatcgtctctgactgcatttgagctacagtgacggagttgaatgtgacgtcgttgaatgtgacgtcaaaaccagcgatgtttagtctcagtttcctgacctcttatataaagaaaaatccactgttggtggtcttggaagacaatgtagagtctcttctctttgggatggtttttggtggttccgtttagcttcaggagaatggaccagttgggctcttgaggttccttcctcattctcattctgttttatcttgaacttgtcttgggtcaggtttttacatgcgaatgcctacataagacctgtcctctcttatgcatttattcccattggatcagtcctcaatcgaccagtctttctaccctgatgaccttcttctgcgacaccacctcttccgtggtaaaccagtcccggaggcctcggtgtttttaagacccattctctgaccttcatcaatacctaactctccaaccatttattcttctttgctcttgcactcaggttgttgagttttattgaagaaattcacacaacctgggaaatgggtggttcattcccacccgttctacattcacggtctctcccctgggct

SEQ ID NO: 21500 - DNA, 1021 bp, Homo sapiens
tgtttgatatctggcaggatgctattcggaaaagagaatgtaaatattcctgcatgttgtcttagaagcatttaatgtaactgactgagataatttgccatttatttcatggcttcttaaagggattttgagcctccttatctatgtgcattgttagagtgaagctgacaacaggttattttgtttgctttgtaaaacttaacaggaggaggccatccttggctttccttgaggtgctggtatcttggaagggaagctagccaaacttttcctcccagaggctgtcttttgacacagaacattttagttcctaccagatttctctgagaggctttcatggagcccagttaccccttcccagttaccccttttagcaaatgatattcatgaatactgtgctcacaaagaaatttaggtcaataaatggaaagcatttgagatatctggactcttttcatgttctagaaccccagatgctagggaaattttgggagaaagcctagaagtggtagaatttaaatattagttaggtttcttatggccatctttcctaaggaaactctagaaatagctcatgggatataatttaattacatggtcttagataaatcctcatcagtcttttatagctggttatgatatttgatgagataaaacaaacgaactttttttcagatttattgaataagaatcactaatcttgaatatttattcagctcagctcaaaccaattagcaaactttaaaaatggccagttctaatatggtacaggccattgaagcatattcataacttaatttttggcctgcgtttgcatgatctggccattgctggcacgaggaattggaaggaggttgcttaagggaggaagaatggactaagggagaaaaaggaggaaactcaggaagagaggctgagaacatagataccctggtagacatacttttgacagcatttaccacattttaactctggtatgttgaaatgaacattgatagccttttactttcttccttctctg

SEQ ID NO: 21501 - DNA, 1139 bp, Homo sapiens
gcctcaggcacactgggacatagcggcttccttaaagcctcagtttgatgatgtgacatttaacatgagtgacttcattttggtttggtctggtctgttggagcttagtgcaggagttcattccaaacaatggccttccataatgtttgtttgtttgtttgttttgagacggagtcttgctctgtcgcccaggttggagtgcagtggcgtgatctcggctcactgcaacctccccctcccaggttcaagcaattctcctgcctcagcctcacgagtagctgggactacagtcatgtgccaccatgcctgactaattttttgtatttttagtagagacggggtttcaccatgttagccaggatggtcttgatctcctgacctcgtgatccacccgcctccgcccctgaaagtgctgggattacaggcatgaaccactgtgcccggcctaatttttctgtatttagcagagacagggtttcaccatgttggccaggctggtctcgaaatcctgacctcggatgatctgcctacctctgtctcccaaagtgctgggagccaccatgcccagccctatgtttatttagcattactttcactctacattggcaagccttttgaatgcaatgtgttcttgaagtctaggttttcacatggatacctttaaggtgaacttgaagtttttatgcactgtattttcaccctctgggtgcagttactgtcatctgttagacttgcacagaaatcaccaactaatctcttagaattaaacaaaaaatagggggagaaaagttcccaaatggaaaaattcttgttcttttgttttttaaaaaaattctgaaatatattggaaataaatgtttgggagaactaaactattaagcataaatataacatttttccggagactttataattgattttgaaattgtcactaaagaattggttagctgttaatggttttcactcttcacttactgattcaaaggtgtgatgttagttttaccctgtaggctgttactttgcttctttgcacttcaaaaagatctaaggtcattcactgattatgactttgccacttccggccctattgtccttacaaagggatttcgtgagtaaccttactgtaaagaagtcagccc

SEQ ID NO: 21502 - DNA, 1090 bp, Homo sapiens
tatcaggcttaaagattggtctagccacaaaatccattgagacattgagtttatgaaataaatcatgaaaccttgaatttctggggcaacttaaaaattacaatcaatagtgtgtgtcataggattccttcggaaaagaagtaaaaggatagcttactacaaacaaattttaaaatgttattttcctaaggttccaatctgttcttgaattccctcctggggagtccaggtgttagtaacacaaggtaaacagaaaggccctcaggcatgtcatgatgcaaattcaactcacacacatacaaagggcaacactcccatccaaattaatgggatgacatttgctgaagtcctcaaactagaaacttcccagttatcctaggcttccctcccttcctcatgtcccagacctgttgggtcactaaaccctgtcgactcagcatcctacgtaagccttaaataaacgacatctcagctccactctccttgccagtccctcctcatctctcatctagaccattgtagtcatctccctactgggctccctgcttttggactgttcctcttcctgttcccactcttccatttttatctttgaattatctttttgaattatctcctgtgaattatctttttgaaaagcacatttgatcacaccattcttttgagtacagtcttcaaggactcccttttatctgttaaaaaaaaaaaaaggaagaaagaagaaggccccaacctttctttttttttcttttttttggtggggtggggaggtggggggcacggagtctcactctgttacccaggctggagtgcagtggctgcgatctcggctcactgcaagctctgcctcccgggttcacgccattctcctgcctcagcctcccgagtagctgggactacaggtgcctaccaccatgcccggttaattttttttgtatttttaatagagacggggtttcaccatgttggccagaatggtcttgatctcctgacctcgtgatccgcccgcctcagcctcccaaagtgctgggattacaggcgtgagccacagcgcccggccaaccccagcctttcttaacctagctccact

SEQ ID NO: 21503 - DNA, 1044 bp, Homo sapiens
gatagtgtagtcttgttcatgtgtgtatcctcagcatctgtcccaatgcattgaatcgagtgaaataaaagcaagtacaggatatgctttgtgtatcccagtaagaccccaacctgaaaatagtgccaagacaaccaggaaactgaccagtggtccagctgagctgcatgaagcagaattaggcacagaaagtctgcagtagttcaaatggagtcctgagaaattgtgtccagccctcatgtcaccctggcctgccctgatcttctttgcttgttctgcctaacttcttcattctattctctcacttgctcaggggggtctatttggcttaatctgttggacctgctcctttcttagcactgaaggctgatgcatctgatacgtgcatgtgtgtgtgtgtacgtgcatatgtgaatatgtgtgcatgtgtgtgtatgtgtctcaagatgaactcccagacatagaactgggtgtgtccacttagggggttgtatgaatcagggggaaaggggaaaacaggaaatgatagtaatcagttattatgtactgtttgccaaatgtcaggatttgtatttaattgttaaaaccaccttgtgaatggtagtcaccattattattatccccactttacagatgagttaactgaagcaaagagagactgagtcacacacacccttgaaatgtgggggagctgggatccagtcagcatatgtcttaatccagagtcactgctgtaagcacaattagacttaaaatattgtaatggaggccaggcacagtggctcacaccttgtaatcccagccctttgagcgaccaaggcaggcagattgcttgaggctgggagtttgagaccagcctggccaatatggtgccacccccatctctactgaaaatacgaaaattagccaggcatagtggtgtgtccctgtaatcccaaccagttgggaggctgaggcacgagaatggcttaagcctgggaggtggaggttgcagtgattagagatcaggccactgcactccagcctgggcgacagagtgagact

SEQ ID NO: 21504 - DNA, 1050 bp, Homo sapiens
tagaggcagggttttgccatgttggccaggctggtctcaaactcctgacctcaggtgatctgcctgccttggcctcccaaagtgctgggattacaggcgtgagccaccgcacctagccaccattatcattttttaaatgccctgttatgtttttatttggaatagagtcagctaattccttttattctaccaagtctcagcagggaatagatacttcccattgacttcatctgaatattgctaatgcttttgtaggattctgtatgtcttctgtaatggtgaaactccattgcccatttttaaattaatttagtgttttttttttcggggggggacaggatcttgctctgtcacccaggctggaatgctatggcacaatcatagctcactgcaacctccaactcctgagctcaagtgatcctccctcctcagtcttccaaagtgctgggattccaggcatgagccaccaggcccagcctgatttaatatttttattcagcatgatatttatctgttgtttatatatgttctgtcgtattactccttaaactctaagttgaagagattgagattatgtgatcctccatgtataactgggtactttttaaaaattaaactaaaaagacctgttggagaatgtagcttttcaagattttcttttttattttgaaaggagtttcgctcttgttgcccaggctggagtgcaatggcatgatcttggctcaccacaacctccgcctcccgggttcaagcgattctcctgcctcagcctcccgagtagctgggattacaggcaggtgccaccatgcccagctaagtttgtatttttagtagaaagcgggtttctccatgttggtcaggctggtctcaaactcctgacctcaggtgatctgcccgccttggcctctcaagtgctgagattactgatgtgagccaccacgccaggaggttttcaagattttcaatgatgaaaggaagataacttgttggagtggtaatagattaagaggcagcaatatttccagacattggtgctctggaaaaaggctg

SEQ ID NO: 21505 - DNA, 1035 bp, Homo sapiens
tttttttttgttttgtttttttgagatggagtctccgtctgttgcccaggctggagtgcagtggcgtgatctcggctcactgcaacgtctgcctcctgggttcaagcaattctcctgcctcagcctcctgagtagctgggattacaggtgcacgccaccactcctggctaattttttttgtatttttattaaagacaggatttcaccatgttggtcaggctggtcttgaactcctgacctcgtgatccgcccgcctccgcctcccaaagtgctgggattacaggcatgagccactgcacccggccactggactccttttttaaaaagtgggattcttgttttagaagtggggattccaaatcttgggacctctgagataaattggctaaatgttagaaaatgctagaccttttttcttcaattatgtctttcagaactgtgcatttttccataagcatctttttattaaatctgctgtgatttatttgcttacccagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtgggtttcagttgtgttttctttttgctattttgtctctaatattgtctgacatatttctaattattacatgaggtgctcaaggctggaaactagtaattatcgtatggagaggaatgagaaatgattatgctctcattcacattatctcctgtgacttcacaacagatgtctgtaagaaagacaagtattatcatcccatcttaacagataaagagactgaaattcacagttgttgacttccctgagatggtctgtttagaattgcagaggcaattctaaacccaggtcaaggcttttccagtattccaagtactttctgcaagaatgctactatttt

SEQ ID NO: 21506 - DNA, 1072 bp, Homo sapiens
tgtgtttatagctggttctgtaaagttttccctgccctcttttagtttactctgtaaccttcaagttggagataattggagaatgctaatctgtttctgtgaagtgaaatctttggctgttttcttaaggaaatgcagatgaagtttataaagaagacctgtctactattattcctttttaaaaaaattaaaatcatttgctctggttttagagcaacatttcagtgttatcttcagaaaatgaaattatttcaggggcagatttgtcaaaaaaattatttgtatgcctgttatcactaacttacgtttctttgcttgtagagtatgaacaggcttagatcctcccttaggatactcttaaccagatcttctcgtagcctctaaaagaaagatcacatcagtccttcagaattatttagatgtaattcagaattaccctgttggggagtcctaaggttttgttttgttttttcatttagttcaaggttttaactgagatttaatatttgatgtttattagactattaatcagacatatttctagtagtgggaaaatagaactacctatcacactggatattgggatcctatgtcttgagatagaatgtttcatagattttgtttttagctatccactcttttttacagacatacacagcttattttccatctgaaaaaactaaattaaatattgctgtttgcataatgtttttactctcgtagggatccctcatgatatattttgtatatcattagctgatctgaatcccagcaatgaggatttggaggaaatagtaaatagatacatactttacagaaatagaccagacccttggcaggcgaacttattcttagaataactacaaactgaattcataaacttttgcttgacttaatgagcatttttggcatggagttgatttcttctggaccctgttcctagacacagccctgctgtgcctttctttcctattctcttcttaattaaattgcctgtgtggcttgtattggcaaatagctacatggtaaaagataaaatagaactattttattttatttttgaagaacagct

SEQ ID NO: 21507 - DNA, 1027 bp, Homo sapiens
gcgccactgcactccagcctgggggacagagcgagactccgtctcaaaaaaaaaaaaaaaaaaataataataataattagctgggcgtggtggcgcttgtagtcccagctactcgggaggctgaggcaggagaatagcgtgaacccgggaggtggagcttgcagtgagccaagatggcgcccctgcactctaggctgggcgacagagtgagactgtctcagaaaaaaagaaaaaacgttttcactttgtttagtgaaattgagcagatggtttaatatagaagtctaatgataaatctaatatgctggagtaaattagcagtgaagatccaactactcgttttttcattcagcagtatttattcaggatgtactgtgtgacagaaatcacacgaggctcttacgtagggacacaacagttaaaagactcagtcctgttcctcacagagcttactacctagtaggctgtagtagaacaacttcagaaaactttttagcatttgaaaagcattatcgtctcatctaatgataaacagttcaggtgtggctctgactgtcgacaatgaaaatctctcataatgcattttttgttcaatgattctttgtgactagagaatcctcttagaatatgtcatggaaaagacacagaaaacaccatcagtataatagacttcataatccttagaaattaggagtgagaccaaagaccatgtgctttagaatcagaactgtgttctaatcccagatttgtcacttagtactttaagaacttcagcaagtattttaagaacttaaagtcttagattgctcatgcatataatggggccattaacgcctaccttgccgggtcataaagatcaaatgagatgatgtccttaaagcacccacccagcacagtgcttgggacatagtatttgctcttcaaatggcagttatttactattgtatttattaaatacccttacagacttggaaccttgcttactttctctagccttgtaagtggacataattttttactaaccact

SEQ ID NO: 21508 - DNA, 1072 bp, Homo sapiens
cagagcagatggtaaacagcacagggctgggagtcagagttctgctattaagatactgtacctgacatatattggctgaaaattggggcaagccaatcaatttttctgtgccttggtttcctttcctcatttgcaaaaactgaaattaacaacgcctgttttgcatctttgtgaggaatgacttagccttgctaccacacttctgcttgtgtgacactgttccctgttataatgatttgcaaaccatgtatattctcttatacgctagaagctttatgttctttttgtttatctctgtatcacctagtaccagacaaatgcctggaaataaatgttatttgaattctgtttttatttaaattagaaattagcatttggggattattaatttagtctttattaatttattaatagtactggtatgtactgtctttctaaatgaagataatatgctcatccaccattagaagaacacatgttttatcccttagcttgtagggaagcatggggtgagcctcctaagctctgcccctgtcactaatagtatggcttttaggaagactctatgaagcagggccactttatgattttcttgggccctagatatctttgcctatgtaggctcttcctctgtagaaaaatatgtcaaattatgttttataactgtcagtataaaggtgaatatattattataatattatatataaaggccagcacggtggctcatgcctgtaatcccagcactttgggaggctgaggtgggtaggtcgcttgagccccaaagttcaagaccagcctgggcaacatggcaaaaccctgtctctccaaaaacataaaaattaactaggtgtggtggcaagtgtctgtagtcccagctactgggaaggctgaggcaggagaattgcttgaacccagaaggcagaggttgcagggagccaagatcgtgccactgcactccagcctgggagacagaaaaaaaaaaagacaaagtgttgatcataaaggaaaagactgatattttactacattaaaattataacttctaactattaggagtcaccatagagtaaaa

SEQ ID NO: 21509 - DNA, 1098 bp, Homo sapiens
ctgaggcaggagaatcactgggaggcagaagttgcagtgagctgagatcatgccactgtactccagcctgggagacacagcaagactccatctcaaataaataaataataaaaatataaataaataaaattgctcaaaagcaatggtaaagagaaaaatcttaaaagcagccagagagaaaaggcatgtaattagtacaggggaacaaaaagaagcctgacatcagatttctcatgggaaacaatataaatgagaagacagagcaatatttttaaagttaacctagaattctatacccaataaaaatatcttttggccaggtgcggtggctcacgcctgtaatcctagcactttgggaggctgaggtgggtggatcacttgaggtcaggagtttgagaccaggctggccgacatggtgaaaccccatttctactaaaaatgcaaaaaaaattgccaggcatggtgatgtgggcctgtatttgggaagcggaggcacgagaatcgctttaacccgggagacagaggttgcagttagccaagatcgcgccactgcactccagcctggatgaaagagtaagactccatctcaaaaacaaacaaacaaaaaataatctttcaaaaatgaagatgaaataaagacactttaagacgtacaaaatatggaatagttcacaaccagcagactcacactacaagaaatgctaaaggaagtcattcagatagatggacttgatagcagatgaaaatccgaatctttacaaggcattgaaaaccactgaaaataggccaggcacagtggctcacacctgtaatcccagtactttggggccgaggcgggtggatcatgagatcaggagatcaagaccatcctggctaacacggtctctactaaaaatatttgaaaaattagccaggcggggtggcgggcacctatagtcccagctactcgggaggctgaggcaggagaatggcatgaacccgggaggtggagcttgcagtgagccgagattgtgccactgcactccagcctgggcaacagagcgagactccatctcaaaaaaaaaaaaaagaaaagaaaaagaaaaccactgaaaatag

SEQ ID NO: 21510 - DNA, 1064 bp, Homo sapiens
tatcttctacttccattctttccctgaattcttgacaatgagttatatgaggatattgatagtagctaatgttttgtcccgatcacatttgccttccctacatgcacaagatcattacaactgatctgaattcaacctttggcttaatttcaacccatagcattgaaaagccattcgttatatgggacacaatgctaccaacccaccatcatagagcatatatggacttgttttgctagtagtggtgttagattttccctgctgttatctggttctttatgtgacccacgcttattatttctgacctggatggttcagtctgtggctagaaacctgaaaaaccaaaaccaactggctctctttcagaacacctaactgtagccatttggtatccacagttcaaacatttgtctaccttgctgaacaaaccacagacaattgtaaatatactggttttaagacataaatgagttatttaaatgtttgtttaaataaatagttttaaagactacatagacatcttatatacacaaataattatgccagtctgtcactatggttgcttgtaggtagtactggttaatgatgagttcatccttcttcacacttttctatacctttcaaaatgtatgtaatgaacagatatatgcctttgataatcttggggggaaagctaagataccaaacaggatccaaaatattgcatatggaaaaaacaactggaaggaaaatcagcaaaatgctaaatagtagttgtagccacatgttatgattatggttaattttttttctccttttgtttttttcacttatcactttacacaataaacctaatgaaaaacacaacaaaccattagatttctaatgcttctctgttaaaagtattaaaactgcattgctttctattgtatttcatttagttttcacgccatctttcttgtcaaacttttttttttccagagccccttttatctgccccagttccacagaccccactaactggaattttacaacccaggcccattcctgcaggggaaactgtaattgttcctgaaaacctgctg

SEQ ID NO: 21511 - DNA, 1027 bp, Homo sapiens
aaatttagaagttgtaacatttatgtttcatatatagatacacgttcacaattttatgttatagtcatagactacattacagtggaattcctaggatgaataacaaaactccggaaacgcttcttacagtataattcatggagacatgaattacgggcttgagaccatttgaatattgctaatgatgaagaatttggaggctgggcacggtagctcatgcctgtaatcccagcactttgggaggccgaggcgggcggatcacaaggtcaggagatcaagaccaccctggctaacacggtgaaaccctgtctctactaaaaatacaaaaaattagccaggcatggtggcgggcgcctgtggtcccagctactcgggaggctgaggcaggagaatggcgtgaacccgggaggcggagcttgtagtgagccgagattgtgccactacactccagcctgggcgacagagcaagactctgtctcaaaaaaaaaagaaagaaaaagaaaaagaatttggaaaggcggacaatcagcagcaccatgctaagtctcccacatctgttgccagagatgacctaaatgcacgtgaggctgctgggtcttctcctggtctctgttgacactgattaagtgaagctacttagagagtcttaatcatgtgttcagaagggccagtcactaagtcagtataaatcagtctgtcctaaataatttacccctctggaccactgttggaaaaccacagtcaaggcctgaggttcttcacctggctgctagctcatcagaatcacctgcagggctttcagaggcacattagttgacaatcactgtgccctaaacgaagggggcctcaagttacgacttctcaaggcagtgacatcttcctcaattggtatgagtagctgccaggcaacaagtacgtataagagtgtcccatattctggctgctgtgatggctcatgcctgtagtcccagctacttgggagcctgaggcaggaggtttgcttgagcccaggagtttgaggctgcag

SEQ ID NO: 21512 - DNA, 1028 bp, Homo sapiens
gtccccaggttggagtgcagtggtgcgatcttggctgactgcaatctctgcctcccaggtttaagcgattctcctgcctcagccttctgagtagctaggattacaggcgtacgccatcctgcccagctaatttttgtgtttttgtagagatggagtttcaccatgttggccaggctggtcttgaattcctgacctcagatgatccgccctcctcggcctcccaaagtgctgggattataaataggcatgagccatcacgcccagcctcagttcttagaatgttttgtatgttgaaatggaaatatgtccaatataaactgctaaacgaggactacaagttatagacgtgaataaaatatgacccaatttatgtcaaaagaaatctgtatatatccttctgaatgcatataaagtgatctggaataatattcctacatacccacagtgcagggggttaggaagggagatttttactttataggcattataataagcttgtaatctttttaccgactgtaattctttatttctttttttttttttgagacggagtctcgctctgttgcccaggctggagtgcagtggcgtgatctcggctcactgagagctctgcttcccaggttcaccccattctcctgcctcagcctcccgagtagctgggactacaggtgcccgccaccatgcccagctaattttttgtattttttagtagagacggggtttcaccatgttagccaggatgatctcgatctcctgacctcgtgatccgcccgccttggcctcccaaactgctggaattataggcgtgagccaccacgcctggcctatttctttttcatggtttataatgagtctaagatcttgtatgtctggatttcaggtttgagaattagaaacgtccaaatgacagtttatgttagtattgttgtgttccttcataaaggttgaggatataattcaggaaagctgaaattgttatgcagattattgataggaattgatgcagatagcatctagcaaattttcaa

SEQ ID NO: 21513 - DNA, 1050 bp, Homo sapiens
tttttttgagacagagtctagctctgtcacccaggctggagtgcagtggtgcaatctcggctcactgcaaactctgcctcccgggttcacgccattctcctgcctcagcctcctgagtagctgagactacaggtgcccaccactatgcccggctaatgttttgtacttttagtagagacggggtttcactgtgttagccaggatggtctgaatctcctgacctcgtgattcgcccgcctcggcctcccaaagtgctgggattacaggcgtgagccaccgcgtccggccgaacattagtttttaaagaaatgtattatgaatatagatagaaaacccaaagtgaaggaatagaaaatgaaatatcagtttcttttaatctatcataattatgtgagcataacttagtattttgaaatagattaatgtagtcagcaaacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatactggcctttattaatgtgaaattcttgtggatctgtgaaataaagaggagtactttcttttcgtttttttttcttttctttttttttgagacagtctcactccttcatcaaggctggagtacagtggtgcgatcttggctcactgcaacctctgtgtcccgggttcaagcaattctcgtgcctcagcctcccgagtagctgggattacaggcatgcaccaccacacccagctaatctttgtatttttagtagagacagggtttcaccattttggccaggctggtctctaatgccagacctcaagcgatctgcctgcctcaggcttccaaagtgctgagattacaggtgtgagccactgcgcccagccaataggagtacttttgaaaaggaagataaattttttttttttgagacgtagtcttgctctgtcacccaggctggagtgtag

SEQ ID NO: 21514 - DNA, 1035 bp, Homo sapiens
agtctttaccgttgctcacaacattccataccatgctgttcagcttaaaaacacactactaacctgctctgtctggtttgaaatgttttcaatttacacacaaatacagatcgccctgaatttgtgaatgtatttctaccttcgttaaaaaagaagactaaaagaatatggaatccctaattcacatttagttcgcctaggaaaactagcagttagtgaaaaactggccacatcacagccgcacagctccagcagcccgggtagcttccccaccctcactttctccagccccgcctccaggacggcctaaccgctttcctcatagctcattgggcgcgcggcaccaccgggcggcaactccagggatccgcccctgggcccgcccctccatcgcccggggctggggttgggcaaccgtccgccctttttctagaccgcgcgcatgcgcactctccttggaccctggagagacgcttagggatcagttttctcctcctttcttcccgcgatcgcgcggctctctggaagccttcccactctattattgccgaggatccccctcctagacactctgagaaggtgccgctccggccttgggtacggcggtacccggatgtggagtcgctctcgcccggctgggactctgtggcggggcggagcgcggcggctggtgcgggggcagagagaagggggcctgagggcccgggcgctcgccggacgccgggaggtaccaccgctgcccacgggggaggaggcggcgccggcgcttgggtgcccgcccccgagcgaggggccggggtggcagaaaggccggcagttaagcttgctccccgccgcccccctcgggctagcctcccccggccccctgcgctcctcgcgctgccggccgggggagagcgtggtttccttgcggccgtcgctgtagcctggccggggagcccggaggaagcgggagagtccccgcccacggccccctcccctctgcccgctctccgccgccgcctccgagcagccgcgggccgccctccactccga

SEQ ID NO: 21515 - DNA, 1040 bp, Homo sapiens
gaggtggtggtagtgtgggacaacggcacagctgccaactaccgctgctccggggcttacgacctccgcatcctggacagcgcgcccaccggtaagccgcggccacctggccagggcttgcgcgcgcggggggaaggggcgagctgcggtgggcgtcggtgtcgcggggagaggtctgcagtgggacacctggtgggcagcgcccggctggagcgagcggaaaggcaaagcgccaaaggaattctaggttccgaacgggtgaacaaacactttcagaaaagaccctctacccccaagggaaatgatggcagcaccatcaccgggatgctttcaagcctggaagacacaaagcaccgggaagagaacagacacaggtcccccaacccgactcctcctcttgggaaggggtctggagaggcctatctaataagccattgaaattaatcagccaccaagtgataactgtctgaagggaggcttgctttgccatatggtgctcagctgaccgtttataattgccaaggggccttggtacctcggatttgtggagatgccttttttttttttttttttaacctcctgtgacacagaattacttggagttcagtagccaaatgttacttgggactctggaatgatttttcatccaaattgttctattttatatctttatatcaatagagagaaaaacatcctgagctcttgaaccatttctttgtgttaaatactttttccaagtggcagatcggcgtgggggacacctgatgttattttttgttacactaacgtccgtctcagtaaggtgatgtcagaatcttactcattcacccagcagtgagtcagggtccttgattagtgaatcttgattagtgaattttaggggtctgttattgacgctagagtttctaaatgattaaaccaaaggcttgctttcacaaaataaataacaaattcattttcatatagattcatctttggtattatttatccttgatatttatccttgattctgtagaaaatagttcacatttaaaattggg

SEQ ID NO: 21516 - DNA, 1049 bp, Homo sapiens
tagctgagcgttgtggtgcatgcctgtaatcccagctacttgggagactgaggcaggagaattgcttgaacctgggtaacagagtgagactctgtatcaaaaaaagaaaaaataaagcaaacaaagaacagtttacttgtgtggttacagaaagttagtaaacaggcttttatatgctaataaccatttggactaaggagaagaggatataatatgccaatattgtagaaacttacttgacaagggaacctttactcttggagttcagtgtggaattagggtaggtgttctgttatcaattgtggtacatctatttgatggaatattaagtagtcattaaaacgattattttgaagatgatagcagcgtggaaaatgcctgtataaagacatcagcattcaaattagtttgctacaatgattacaattatggtaaatatccatgcatggaaaattaaaactagataatatttttatccattaaattggcaatggtgtggggaaatggtacactcattgtacagcagtttggctctattggaattgtaaacaaatgtatgctttgatcagatagttcttttaagaatctctactgaaataccgacctcatgtgcacaaagatgtatacgcaggaatggtctttacagtactgtacatattggtgacaatttggaagcactttaaatgctagtcaataggagaatagttaagtacattagtgtatatccaagtgatggaatactctgtagcagttaaattgaattaaggtctattcaatttaggtctgtattcttagacctatttaagataggtctgtatctgtgacactaaaaaataaatcttccaagatgcattctttgaaaaaaaagtcacaaaatatatgtatgtgtccctatgtctgcgtatacatatatatgtatataatattcccatttatggaaaacaactagattatgaatgtcattcagtgtattgatagaatgtctgtaaggacacagagtagaatattaatagtggtttctagtgggatgggaatggtgatccagcgtg

SEQ ID NO: 21517 - DNA, 1032 bp, Homo sapiens
ttacactgtggcttcctgttctctctaaagtcagataatgcttttccatttgttttctctctttcacaaatgtgttactttttcttgttttctaatgttctccctttatctttatggatttttaccttttaaattattttattgtcattttagtgtggtttcaggaaagatagtatataaacatgtggccaagctaccatctttaactatctttaatgattttgtggatgggatgtaaaaggggtagaattaaagaattgcacttggccttgggtatgtccatgggttagttatacatgtccacaacatctgaagtgaaggaaaggttggaaattactgctttataatagttgtatataactaccttgctaacttatttatatatccttatttattgtccttgcagtttgcctgcaagttgatgtttggtatttttgttgaattgaatttatttatccctagcagctaatatcttttctaaaagttttcttttcacttcagtgctttttttcattgaaccatggactcagagattaatctaaaaagaaatatatatacaaaaccaacttaacttacttcctttctttctcccttctttcaactttgcagattgcctaacagttatttcgtaactctttggacaatgaaacttttgttttttaaaacaatgcttgcttcccttctcaaaattaagaagtctgtagttatctgaactatgatatatggaacaccaacctaaattattctcgtggaatcatacagtatactagacttaaacctacaccgtatgtatatattgcctgtttctgattattcattcattctttcattcttttttttaaaaaatgtaggtaaatgggcaatgtgctggccacacagctatgcaagctgctagtcagaatggacatgttgacattttgaagttacttttgaagcaaaacgtggatgtcgaagcagaggtaagtaaacttgaaaaatattttaagtaaacatttatttcctagaaataatacttctatatcatgagatgga

SEQ ID NO: 21518 - DNA, 1048 bp, Homo sapiens
aattgaccagaaaaagcatttgacataatttaacaccctttcatgataaaaacattgaataaacttggaatagtagggaattacctcaatgtaataaaagccatatatgaaaaacccacagtgaacatgatattcaatggtgaaagactgaaaacttttcttataagaacagggcaaggatacctgcttttaccagttctatttaacagtactagaagtgctgaccagagcaattaggcaagaaaaagaaaagacatccgaattggaaaggaaataaaaattatctctgtttgcagtgatcttagtgaaacctaaagatttcaacaaaaaaacttttagaacaaatttagcagtttagcagaatacgaagttaaaacacagaaatcagttgtatgtctatacattaacaatgaacagtctgttaattgaacaatctgttaacaatgaatctttcaggaaattgagaaaacaactccatttacaatagcataagaataaaatacttaggcatgaacttaacgaaggagataagacttatacattgaaaactacaaaatattgctgaaagaaattaaagaagacagataactggaactacttcccatgttcatggattagaaaatttatattgttaagatgtcagtactacccagagagatctacatattcaatgaaattctgtcaaaatcctaaagatgtttcttgcagaaatagaaaaatctatccagaaattcataaggaatctcaagagagccccaaacagccaaagcaatcttgagaaagaacagaagttggaggactcactcttcctactttcaagacttaccacaaggcaacagtaatcaagacagtgtattactaacataagggtggacataaagactgaaagaagagaattgagaattcagaaataagcctttgcattaaggtcaattgctttttggggtccaagacaatttaatgggaaaagagcaatcttttaaacaaatggtgcttgggcaactagatattcatatgtaaaagaataaagtaggaaccttacctaaca

SEQ ID NO: 21519 - DNA, 1067 bp, Homo sapiens
ctatttcttttttaaaaagttgtttttttttagggaaaatgccaatagattgggttttgattgggcagggagaatgaggacttctttgtaaaaatatcagcttatgaatggatttaactttattgatcatgacagtgagctcaacagcttaaagaagtgtaataggctatatttcataatagttacttcataactatttaaattattttaattgtagcttttattgtagcttagggactttgaatagtcgttagtgtaatcttcggagatttctgttttggaaaatgtataggattttagagttgatttacagtaggatctaatttttgaagcaatgattgcctaagaaatgattatccccagctacagttttataaccagataaattaaaccacaaatatatagaaaatgtagtctgtgtccattttctgcttagtttggttactaagcaacttgtcttttgtgcacctgtttgattaaagtttctatacttagtaattttgtagctcctgaatctaatttgccaacttttaggttccttaaccgaataggcttgaaacaacatattatttttaaataaaagtgttccctgaaatactatttgaatatgtaaaacataatttgtttccattggaaactcaataatgattttttaaaaagtagggcagtggttagaatcataagctgcttgtagtttagataatttacagcatccaggaattggttgctggattggatagatctcagagaagaaataaagaacagtagtagtgggaatgagggcttgagaagaactgaaagaatagattttgttcagctagataattattagaaattaaggtttttgaagtgcagctgttttggaactgttgggatctagagtatgtccttgtaagtgggaggcaggattggaggatgagggaagaattgggggggtgttaatctgtaaggagaggtgatttatacctgctgacgttttttgtctgaaatgggagacaagttcatctgttgagagtggtgggtagagaaagagtaattgagaagagtgataaggacttggggacctg

SEQ ID NO: 21520 - DNA, 1066 bp, Homo sapiens
agtgttttgtttactccagcacaggagtgtgggagccctgttaggctgtttttctcagatgcaacattctgcgtccttggtgctttcaactggcttatcttaccttatatttcacctgtttgataatctttctaaggaaacaacatctttttttattgtagtttgtttgaggggaggtgtgggggaggccccttgagtcacagaggtggcagagtggaggaaggcacattactccaaacagtcctaccccggtgtcttgtgtatcccaggtctgtgcttctcgtgggagcctcgacgctacctttaggacagcaagtcagtcctaggggccaggattccttaggataaaatgggacattcccaaccttgtccgcaaaagacacgctggaaatgcaagtggtctgaaagagagggaaccaatttgaacagctctctgatagcctgagttctttctgtcttcttccaagcgctgcaagacttggtctcaaaattccctctttttagttttgctctgtcgcccagtctggagtgcagtggctcactgtaatctctgtctcccgggttcaagcgattctcctgcctcagcctcccgtgtagctgggattacaggcgcgcgccgccacacctagctaatttttgtatttttagtagtttttgccacgttggtcaggctgtttttgaactcttgacttcaggcgatccattcgcctcagcctcccaaagtactgggattataggcgtgagccaccgcgcccagcgaaattccctctttttgcttctgctgcaaagctggccctggagaccatttttcccctgtgtgtggaatgggatcgggggaccctgttgagatttgcactgttggcttgggacttgagagtcagggctctcatccttacctctgcatagggacccgtgtttggctcccaggagcagagagatggagaggctgggaatctctaaggaggtaatggttgggtgtgaagcttattttgtcagtcggggagttccgtagggaatgtgcaagggtgttgtgagttgggtgaggggtagtatctgcagattgagc

SEQ ID NO: 21521 - DNA, 1041 bp, Homo sapiens
gtgatgtctgcgatctgaactaaagtcctttgaagggttgaattatttgtgggaaaatatatcaaccaattgaaatttatacgtgtgtttgtatgtgtgtgtattaggtccaggatcatagtatatttttctctgatttcccccctccgcccccccctcccaacacacacacatcgtgttgattctcagtaggcatctcttgactatcatcagtgagggaaagggacttaaaagatgaacaataacaggacaaagccaggcttcttaagaagagtagctgtgccaactctgaacgccttctacttttagaatattggtttagaggccaggcacggtggctcatgcctgtaatcccagtactttgggaggtcgaggcaggcggatcacttgaggtcaggagttcgagatcagcctggccaatatggtgaaaccctaactctactaaaaatacaaaaattagccgagtgtagtggtgggcgcctgtaatcccagctactctggagactgaggcaggagactcacttgaactcgggaggcggaggttgtagtgagccgagataccaccactgcactccagcctgggcgacagagtgagagaatatcggttttgagagctgaagttacgctgatgcatggagctgacgtgttgattgttttaacttgtatagaactgtgagattcacatgtgcgtggctggccaggccctggcctgtgccaggtggcagggagatgatttcaggggcggatgggggcccttctgacccgccctcctgttagtgcctcgactctggttccctcctattttttcaagccactttctgatcccatgaaggttggcttgtccctcaagtgccttgtgtttctggtactcatgtcttctattcatccccaaagttattaggttggtgcaaaagtaattgtgggttttgtcattactttcaatgccaaaaactgcaattactttggcaacaacctaaatagatttactatgcaattcaatttaagtattcaaagaaaaatattcaaagaaaggtatagatg

SEQ ID NO: 21522 - DNA, 1030 bp, Homo sapiens
atataagagctctgcagagaaaattctggtataatttgaactgtgatttacaagatattccaacctgaccttttcagttgttttgttttggtacaagaaatttgttatataaacacggtggagctcttagaattatcctgttaagagtatttttatctgaaaaacttatttattttttgacctttagagatgcacaaagactagaagaattcttcaccaaaaatcaacagctgagggaacagcagaaagtccttcatgaaaccattaaagttttagaagatcggtgagtctggcacttaggtcttgagtaagaagtgatttcctccataataagaagtacattgactttcatttgtaattagttttgggattgaaagtgatctttcccacagccttctctcacctttgaatgaatactttatgaaaacaaggatctattctttaagattttcattaattctgagatcacatcagtttaccctttaaatgatatctttatctggtgtttgatgtagtggaagctcaagggtagcaatgttctaattcatttaatgctttaattccagttttacttctaagtaggtggaaactgcttcacaattctgtttctgtcgtcttttcttgttcttgctgttctcttttcttctttgcagatttcctcactttgagggagtctagggatcttctttctgagtattcctgaaataatattatcacttacttccatacacagacttctttctttcccactcctatgaggttaacactgaggattagaaaaggcttccagcatttgctgttttcccttttctgaattgtaagtgctatttaggacctataaactacctacctgctatagtaaacaatattccagccaagcgtggtggctcacacctgtaatctcaatactttgggaggctaaggtgggaggatcgcctgaggccagacattcaagaccagcctggacaaacaaagcgagaccctgtctctacaaaaaattttaaaagctgagcatgatggcctgaacctg

SEQ ID NO: 21523 - DNA, 1071 bp, Homo sapiens
tgtactaatttaggtcattcactttctagactattctagaaagctgtcattctggatttctcttcattagatccctgcattaattcagttatttcatttctctcatgttaaacagtcaacaaatacttaatgaaccacctgttttgttccaggcactgttttagaccttggggatacaccagtgaatgtgatcgataaatgtgggcctttctattggttttttaagctcattttgttacagcttaccctcaagtaactgctgaaaaagaaggcacaggaactaaattttcaaagggtccttgcattctcgaaaatatttttattctactgtttattatatagttgatattttgactggatataaatttctaggtttaaaatagttttccctgaaaactttgaaggcatttctcattgttagcattccagtactgatacagtctgccattctcgtgttaattcttttgtaggtaacagattttcttttcctttctgaaatttttccttgttctgatcaaccttcgtgatgctctgtgtgtgtgtgtttccttcattgcactggacactcaacctgttaacctaaaaactagcactcaaagtctggtaatttttttctgccactttctctattttttaatggtctctctttctggagcacttcttagtcagagactgattttttatcatcttttctcttattttctattacttgtttttcttccatgttctgtgagatttcttttattctccaaccctactattgaagttattttgacaatcacgtacgtaatatccaagaactttttattatttgttgattgttgctgtatatttatatgtgtgtgtgtgtttgtgtgtgtgtgtgtgtatactcttgttttatggctgtatcatttcccagatttttccaggaatgctagatagcttttgcttttccccctcaaggtctttttgtgtggtaaaaatctatataagatgaactttctttttttttttttttttttttggtggtggttgttgttttgagacagagtctcgctctgtcacacacgctggagtacagtggtgcaa

SEQ ID NO: 21524 - DNA, 1010 bp, Homo sapiens
aaacagaattgcttgaacccaggaggcagagattgcagtgagccaagattgcgccactgcattccagcctcggcgacagagcgagactccctctcaaaaaaaaaaaaaaaaaaaaaatcaaagaattagctgggatgctttgaatcttgtttatttctttttttttttttttagagatggattcttgctctgtctcctaggctggagtgcagtgatgctatctcggctcactgcaacctctgtctcctgggttcaagcaattctcctgcctcagcctccccagtagctgggattataggcacgtgcgaccacgcccgactaatttttgtatttttagtagagatggggttttgccatgttggccaggctggcctcgaactcctaacctcggttgatccgctttgcatttttaaagttaatatcttaattctcttccgaataatataagaattttaaagcacttaactttgatgatcttctccacttacattctgctcttgcccagtatttcatttctgtatagttttggggttttttagccctacaagctagatatttttttaaaaaattacctttaagtaaaattacctttcaattagcccaagggagaatccttgctttgctgataataaatcttacagggaccctactctaatgactgaaaatgggagggaaagacaccttgctagagagcttttccgtatggatagttggtcttctgagcgtgaaagcgccttttcttgtgtctactataaattacttgggagcactgctctgattttcttgtctcggtatttattaatgactcctacgtcaaaacttttagagatctatcctcatgactttagcctaagggcaactattaggcaccttttatttacccgtttagcaatttgtgggccatgttgcctctgatactagaattggtatgagattcttctaagaatactcccttttttaaaggccctttttcattggattttaccatcaatctgagcctatttttaaat

SEQ ID NO: 21525 - DNA, 1044 bp, Homo sapiens
ttaatttctttcctcttgctttctacattatgtgcacattgagctcatggctctcgttcatgtaattccagctttcccttctccaacataagtacacagtactgcatgcctttcctcagactgtgggttctctcctgatcttgtctgcaatttgaaatacttttaatttcacctgaagtgctattgactatactttctacttcacttctcacatagtatttcccactgggtactgtaatcattcgtgtacttatctacttaggtttggaacattagatgcaagggattacatcccttagagcttcatgtttgtgttctactgtaactccatgccatgtagtaaatgttttaatactcattgaattgattttctttccattgtcattcttctctaggaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatggtaagagttggagttgtattttagttctctggttttgtaaaccagtgttcatctactagtttttatgttattcaatctagtgataagaagatagtcactattctggtatcccatggtacaactatgagtttaacttctatttgtaaagtgactgagaaggcgttttctgcccgtgttatgtatagatacgtgtcatctatatgacatgtaaatataccatattttataaatgtagtaaatagtttcttttttctttttattttaaaaatattcctatgtgtatatatccaagtgggatagaaggaaaaaggaaaggaacttaatgttaatttctacctcctgtgtaccaggtattatgctgagtgatttgcatgtattattgctatgttttaattctcgtaacaggcttgtgagataactatcagctcttttgttttatagatgaggaaagatatgtttagaaaggttaactc

SEQ ID NO: 21526 - DNA, 1234 bp, Homo sapiens
atattatggtgttgagaaatacttcctatgtcattttcctctgcttttccccttctcttttgtcatctaaatgaagagaagccaaaagctgtaccttgtcttaaattttggttaatcatttgcttctaagaggtagataagaccttactattaattctgtattaaagaattgttatcactctttatttagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaaggtttgtgttaaatgttcaaggattttgattaaaatgattgcttgtgatttcatttagagctaacaattatttctgttttagagtgctggttctcatgagccaataaaaatacaaaccaggtcagaccatggaggatgtgaacttgcatcagt

SEQ ID NO: 21527 - DNA, 1091 bp, Homo sapiens
ggcgtgagccactgcgcccggcctgttctttcctttagagattaagttattggggagggagtgctaatgggtttcattaacgtgatctgtagatccaggccacatctccttcatggccctatcctgggtgggagtcctccattcttgttcccgtaacaccagtcagtgcgcctttgttttataatgaactcttagtgtgtctcctcaccggattgttcttaaaggcaaggcttttgctctagtcatcctggattccacggtgccttgtagtgggtgcttagcaaatgaagggtggatgactgaatgcatcaatgagtgagtttataatgtgacgagctctgtcccagagtgatggaggataaggaggggccatgtgccttgagccttgccatggtctgcaccattctcatcagccctgcttatccttagccatgcctcatgtcttggtaaagctttacaaagtctgttttgtaacactttttttctttttgataaagtggtggtatttctccttgagatctttaggaatctgcctgtttttcagagcaggacctcttctcttctttcatgttgctttgactgttgtctctctttttccaagacccctgccaccctctgataaccctcgcatctaacggagccacagagtccacagctgctcataggtcactcacccacgacttgcgtccttagaggaactctgcttccccgtgaccccatcagcctcacatccctgccaaaccaggcagctcagagcttgcctgcattccgagctctggcctgtgagtgttgaccaaagggttaacctttctgagctaccatgagccacctagaacagggaccaagccttatgtttcttttttcggttttatttgagacagagtctcacccaggctgaggtgtaatggcatgatcacagctcaccacagcctcgacctcacgggctcaagtgattctcccacatcagcctcctgagttgctgggactacaggcatgtgccaccacacctggctaactttttgtgtattttttgtagaggtgggattttgccatgttgcccaggctggaacattttcttttacttctttgta

SEQ ID NO: 21528 - DNA, 1048 bp, Homo sapiens
atttggtttttgcctgattcatcagctggagactttaaaacatagccagattcaaaaccagtttcttggccgggcgtggtggctcacaccagtaatcccaacactttgggaggccgaggcgggccaattgcctgaagccaggagttcgagaccagcctggccaacacggtgaaaccctgtctctactaaaaatacaaaaattagtcgggtattgtggcgggtccctgtaatcccagctactcagggggctgaggcaggagaatcgcttgaacccaggaagcagaggttgcagtgagccgagatcgcgccactgcactccaccctgggagacagagactccgtctaaaaaaataaagaaaaaacggtttcttcccattgtgtctaatttaaaaaaatctaaccatccctccttttcttaaagataatcctgtcttccttcctttacaagaaaaatcccagtgactcccccaccccagggattttgaattcctttggtctgtattctggatatggatctggctttcagcgtgttagttgaggctcggggaggaggttttccttccaagccagctgtgtgcccagtgctcagaggtatggatggcatcaggctgactggtcaagaccaaatgctcctccagtcaccccagcctggtgacctggcccggccagtatgccactgtagtgtcagactctgtggctctcctcttggagttcctccagggtctaacaagcagctgctgccaggtgagcagtaagggccatgcttactttcatcggcacttttgctgctggacaaagctttagatccgtggacaacaaaacaaagcatgtgtctaatggatgtgtcctcaggctgaagggaaggccgttttgctttaagggtctgtgtatcttctgttaagaggtagcagctgacttttttttcttcatctgtgaacacgtgtactagggtgaaacagttttgttttgtttttgtttttatttttgttttttgttttttgagacggagtctcgctctgttgcccaggctggagtgcagtggcgcaat

SEQ ID NO: 21529 - DNA, 1051 bp, Homo sapiens
ctgtactccatcctgagcaacagagcaaggcttcatccctgaatgaatgaatgaatgattacttgttattactagagattattcctctattaaaagatattcattttctaggtggtctgtcaaggtagaagtgactactgtggcattaattctttcatcaccaacaataaacccagtaggtgtttaggataagaattcatttctcctaagaaaggggagcagcaaggagaggtggtctcatgcagcattagaaagaacccaggctggctgctgtggctcacgcctgtaatcccagcactttgggaggctgagatgggtggatcacctgaggtcaggagtttgagaccagcctggccaacatagtgaaaccccgtctgtactaaaaatacaaaaaattagccggccgtggtggtgcgcgcctgtaatcccagctactcaggaggctgaggcagaagaatcgcttgaacctgggaggcagaagttgcagtcagccgagatcgtgccattgcattgcagcctgggcaacaagagtgaaactccgtctcagaacaaaacaaaaaaacaaagaaagaaagaacccagcagctagatcccagcaaactgtggtcccacgatgcccagggaatgctctctggcctcatgttcattggccgtctctaggaatataaggggcctcatggaagagggagggatgtctgtaaaccatcagcttcatcttcaggctttctgttcagttggatttcatttatgtcaaagtggttgcaacaaggcatcactggcaagcgcccgaagagggacaacgggctgtcccatcaccagggctcacctggtcattttcatcggtgtgactgtgttgtctcatggagtaagcatcctcatggctctttgaggtgcacacaaaagcatttttttttcctctgacttgtcctcccagggacttgaagttggacggaggaagacaatcaactggtgcagtgagtttgaaagagatcattggtctggaaggtgtggagctgggtgctgatgggaaggtaaggctgccaggctgcca

SEQ ID NO: 21530 - DNA, 1078 bp, Homo sapiens
tcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggtggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccga

SEQ ID NO: 21531 - DNA, 1046 bp, Homo sapiens
tacaagtgtgagccaccatgcccagcctgttctagttttttaaaaaatgcaactactactgatcctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaacgctgaaattaactttggctgtaggtttgttactgtaacctgggatcacttttctctttctcacattccgtgtgacagtgatgatgaatattgcattctttgggactgacagtcacagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctagtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttg

SEQ ID NO: 21532 - DNA, 1046 bp, Homo sapiens
ggcagaattgctagttctcaaggtctgtgatgtgcgttgtggggcccttctccttgaccagccataacccttaatgttgttgttcccccttcaaggattcggcagtgctgttgagagagcttacgcacaaaatgattaaactttagtggaaaatgacttgtttattaatggttaatctatttccaccctgtaatctcctatctccctaagacactagaaatcaggtcacataagttctgagttggagagaggagagaagaggtccagctaatgtccctgagcctggaacaaaatactgccatgtgggaaaggagtacacgccatcacagagggcatgagcttcctgcttagaaaggctactgaaccctggagaccctggagaactggaggagttctacactgggtggttaattctcccaatacacatgtgtggaggtctccccaagccttggtgaaaggctcagtttggcagcaatccacttcaacatgactgcctgcctttccttgtctgctggtttgcttctgcccaacaggctgaacttgaacaaatgctgatgaaatccacatccatgatgaggtagaaatcttataacaatttaaagggattcagaaacttaatgggtagagccaagcctggacaatcagaaaaattacttgctaatgaggcagaacccaagaagaggggtttaaccaagcatgtgtaccatgttgaccttgctgcatggataagcggaaggacctcaaatttaattctgagcttcctagcagccaactcaaaaagggaaatctgcttggtttcatatttcactatgatcataagctaaaaagtaataagttacttagaaaaaacatgattgttgacactagtgccaaataacaattttccctaggggtggggcagagtggtcatcacgaagggaattctctaatcaatgacatctttaaataacatatttacagcaggtgtattattaaccatcagtctgggctgcaacagaggaaaagcagtgatttggcagtgccaatgggactcagatgggtaccca

SEQ ID NO: 21533 - DNA, 1033 bp, Homo sapiens
tcttagtctgttcagctgctgtaacgtctgggtagcttataaacaatagcctcaaagttctggaggctggtaagtccaagagtaaggcaccagcagattcggtgtctggtgagggcctgctttctggttcatagatgccactttcttgctgtgtccttacgtggtggaacgggcaaggaagctttctgggcctcttttataagggcacttatcacctcccagagggcccatctcctaataactggtgattaggtttcacctatgaatttggggtggggggggcacaagcgttcggaccatagcagagagctactattaatattttgttagatacgtagtattttatacatactttaaatactcaagattatataatctacataattttatatcctaattttttcacttgatatttttagctatttccccatgttttcccaatcattaaaaatgctttgacatcatttttgatggtacagagttttgttccaagtgtttgttgagtacccactgtgtgctgagaactatgctctattgcaaacaaaacacatacagcccttggtgtcatagaacttaaagtcaaacaaatatattgttgcttgctgagccattcccctacaattaaacattaagattattcccatacgattaccatatagtgttgaaatgaaaggtttagagtgttggctaagagcataggttctgcagtcaaacaaagacaggttggaatttcgcctcttctagttataagctatgtaacgatgggcatattcctcaacctaagccccagttttccaatctggactatagggatgatggtacctaccttagagagttactgcacagattaaatgagataattcatgtaaagcacttttcacagtgtgttaagagctcaattgctattgttagtagtagtaatagtggtagtaataatattctcttcgtgcatgaagtttaattggcatttggatgtattttttttgacagtgaaattttattttattgaattttgtatgtataaaacatgcca

SEQ ID NO: 21534 - DNA, 1069 bp, Homo sapiens
ttagaaaacctaaggactcttccagaaggcttctggaactgataaacaacttcagtaaagtttcaggatacaaagatcagtagcatttctatgcaccaataatgttcaagctgagagccaaatcaagaacacaatcccatttacagtaactgcaaaaaacaaacaataaaaaaagcccaaatctaggaatacatctaaccaaggaggtgaaagatctctacaaggacaactacaaaatactgactgaaagaaataatagatgacaaaaacaaatgaaaagacattccatgctcatggattggaagaattagtaacattacagtggccatactgcccaaagcaatctacagattcaacgctatttctatctatgtcatttttgacaaaactataaaaaactattctaaaattcagaagaaaccaaaaaaagagcccaaatagccaaagcagccctaggcaaaaagaacaaagccagaggcataacattacctgacttcaaactatacagaatacagaactcaaaaataaagccacacacctacagccatctgatcttcaacaaagttaacaaaaataagcaatgaggaaaggactttttttcttttttctttcttttcttttttttttttttttttagacagagtcttgctctgtcacccaggctggagtgcagtggcacgatctgggcttattgcactgcctcccgggttccagtaattctcctgcctcagcctcccaagtagctgggactacaggtgtgtgccatcatgcctggctaatttttcattattagtagaaacagagtttcaccatgttggccaggctggtctcaaactcctgacctcaggtgacccacccgcttcagcctcccgaagtgctgggattacaggtgtcagccaccgtgcctggcaaggaaaggtctttctattcaataaatggtgctaagatagttgtctctccatgtgcagaaaaatgaaactggacccctacctttcaccatatattatacaataattaactcaagacggactaaagatttaaatgtaagacctcaaactataagaatcct

SEQ ID NO: 21535 - DNA, 1220 bp, Homo sapiens
tagttgacctactccccacccatcagtccccactccagcctgtcttttacaagggcactacctgacgtaggaaactgtgcagagcttgtattagatatcaccagcttgctcaaagaccttcaatggcagccagtggtctgttgtcttttttgagttccccgaaaacagaccctgaaaaaggaatggagagcaagtcatttatttgggaggtgatcccaggaagggagagagtcagggagtgaagggaaccatgataaaggtgcaatggcaggtaatggcagttatctgccattagtggaggcattaatgcttctggggcattcaccctctggcacttacagcttggccttcaggaaggctgaggagcttctgcagtcccaaaacaagcccctggcagagagtagcagtggtgtgcagtaagctgtctctgagggtgaaggggtgagtactagaggatgtgggtgttacatttaccaaatcatttgttccataaatattttaaaattccctgttatgtgcaaagtaccattctggctgctggggacttagcagagaacagaacagaaaaaattcccagctttcttggagcttatattcctgtggagaaacccagataataacatacataatatagaaacccaagcaaggaaaatagctaattcattagactgtgagaggcagagttgtattctgaacatgggtgccacttttaagggggagccattcacatcataggcataaactaactcatgtgagaagattccaggcctctgcgctgggttccagagccatggggagtttcttacataaacccatcacggcatccacagggaggcacaggttctcagaagggcacgcctgcaccaaaggaagggcacagcacacgcacacagcccacgactgggcaccatcggactcatgctcacatctcctgagtttgcctctcctaccccagggcgccagcagaggcctggtggtcactggggaggaggtagtgccagtcatgtgtgagcacgagtgcccctcctcctgcagcgccacggtgtgggccagcagagaagatggtttctgaagagctctccttggcagtgaagttcaggctctacagcaacatagtaactcaggtatggactggaggcagccttggtgataagcgctgctgaaaaaacaagacagagaggaggttagggaatgtgaggtttacagatttaaattagagc

SEQ ID NO: 21536 - DNA, 1027 bp, Homo sapiens
gttttttaacctttgaatactctatgattccagttattcatagctcttcagcttgagggtttttaattttttttcctcctcttttttcctcttagaatcaagtgaccctgagaggacgtgtaccacacctgggccgatacgtctttgtcatccatttttaccaagcagcgcacccgacgtttcccgcgcaggtgtcggtggatggcgggtggccacgggcaggtgagctgcagtgagcaggccctgctgcctgcctcaggctgaatctacagtccggtgcatgacagaaagtctctctctctctctgccaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtgcgttccactcgttcctcaacttgctcctcacatgcctgcctggctggccattctgggtgtctgtttagctcatggaaataattcttccaaggaattgaagtcatatttgtagaaaaatgtttaaattttacagctgtcttttaccccccaataaataaataaataaagcatgtgacaattaaagtcaagggaactaggacagaagagagtaggcgtcgcccctctccaccagcccctgcttcctcatctgaccagtctctggagcatttttcgctcctttcttcttttggcccctgcagctgctttctctctgttttccctgctttctctagcgctccttgggtgatttctcttttccacttgtcactgtgtgttggcgttccttccgatttgacaccgagcccctcattgtgtcatttctccttggatacatcttccgtgcccatcgattctattctctccactgtgggaaggacacccacatctgtgaggtcatctctgatctttcctgaactccagtatgtgaccaccatctcctgcgtatctgcctggccagagatcttgaaagtccct

SEQ ID NO: 21537 - DNA, 1035 bp, Homo sapiens
cacatgcagtgggcatctctgaggtgacccctaagaagcaagtctactcaatgctgtgcagacactggctacttcaggggccacaaataccaatggaggatcaaaatgcacaaagtaattgcctcctgatgctttattttattttagaagtcagtccagctctcaacaacctacagcaaaccctgaatattgtgacagttcagaaagaagtgatagacaccaatctcacaactctccgagatggtcttcatgggatacagagaggtcagcatcttcctaatccattgtactcggttggcttcttttgttgaacgttttagatacttatacctccctatctgtgtgtgcattaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcgggtatcaggcgatctctggccaggacatcttagccattctctccattgttatgtgttttggtccatttccattcttccctggtaaagtctgatctcagaaactaaaacattagaaaacagctccacctgatacaggatatattcaaagcgtatagatatcctgctagttggaaggaccagacaggatttttaatttttagaaaatacattgaaaatgctattggtttgcttttttacaaagtggagatatatgtttctaaatcatgaggcattgaattatgattgatattaagaatcagaaaacaggctgtgttttctgtgcgctgtggctcatgcctgtaatcccagcactttgggaggccgaggtgggtggatcacgaggtcaggagatcgagaccatcctggctaacatggtgaaatcctgtctctactaaaaatacaaaaaattagccaggcgtggtgatgggcgcctgtagtcccagctactcgggaggctgaggcag

SEQ ID NO: 21538 - DNA, 1065 bp, Homo sapiens
gttccccagttctctttttactaattccaacttgggcaggtcagtggtagcccccgaaaggtcttattcttcctttggaatgaggacttacagtcagcatatgggtagaaaaaaatttaaaataacctttttttattgaatatcagtggtatgtgtgttcgttatggaaaaattggaatatgcagagaggcattaaaatcacctagaatctcaccactccgaaatctgtttgtatatagttatatgttcattagtcttttaattcacatgtatttttttacaaaaatcatgatgataccatatatattgtttttatatggttttgcaaagtctattgtgtttcctaggtctttaactgtagagcattttattctatcagatgaatttaccgtaatgtatttaaccaccctccaattattcagtaaatggggttttttctcttttctttttttttctttttgcaattacaagcaacactaaaatgaagatatcatgggatataaatttatttattttcttaaggtaaattcttagaactaacactatcaggtcaaaggatataaacattttaacgattgttattagctattaccaaattgttcccccaaaagtttatatctgtatctgtttacactcagaatcattttaagtttgccttaatccctaatgccactgaatatgaacccaccaaagcttgccgatggtcttcaagatgggcagcagacatttacattcatgcaagccagcttgtagaggtccaccctgatccaggctgatctgagccaaaatcccatcacctggaacaggtggtcagctggtgggtgtttagctctgaggggcgatcctgcaaaacaccttaggagagggggcagcctgatgctgagccctgcagaactggagctgggccacggacgcagccaggttttcagaatgcatcacactcgagaacaccaaaccggtgccaagcctgggccgtgctcccagaaagggttggaataatgtgctgaactctcttcgcagcactgggcctcagtgatcggtccagccagccggcttcaccctcct

SEQ ID NO: 21539 - DNA, 1023 bp, Homo sapiens
agctgggcatggtggtgcctgcctgtaatcccagctactcgggaggctgaggcaggagaatggctggaacctgggaggcggatgttgcagtgagccaagattgcacaattgcactccagcctgggtgacagagtgagactctgtttaaaaagaaaacaaaccaaggaccaagtgaaccatgttaggtcgagctcttctaacagcaagtgatgtgcagcctgagaggacgatcgcccgtcctgcagtgcattgtcacgtgcccgatgcacccgggtgctgtgggggatgcagacagttcttcaaggagggaaaatggtttccttgcgttgttgctatggtttcttttcccccctcttaaatgataagatggtaggtgaagtcgaaagggccaggttaggtaccatgaataattaattgccgcagctctcagaaacctaattttagccaagaataagaagcagatgtggcaacagtaggccctagtttcagcttccttcatttttcaaatggcaaagtggctaatatttgagcagggaaagggaaaaggagggaaaagctgcagtactcagcacttgattgagatgtgtctgttcctgaaaggcagaattctgtgtcatcccttccttcactgactcggatttgtgaaacacctgctatgtgtgtaaggtggatatgatatatagtagggtagggtaggagcccatactgttattcccatatagtgctgtggaatgagaaaaactaatgtgtattttgaggcagattgtggggatgacagatgctacaggagtgtgccgtttgatctaggttcatgggtgtgagcactggttagggattcctcacaagggaattgaccccctcactttttttcatgtaggtttaagtaacctattaaatgggaaaagcagactattattaactgtagaatttaggtaggtactaagtagatgaaaaagaaaatggcaacagaaggttaatgtaaaatagagtcctggatctcacacacactgtctttctctgaca

SEQ ID NO: 21540 - DNA, 1016 bp, Homo sapiens
tcttttttcagaaatgatgttggttatcaaggactatttacttttcttgtggcacctaaatgtgtttctgaagtcagttccaaagaagaagttgtaaaaatgtcttgataattgaaataagaagatgatctcctaagaaggggaccaaatcagctatttaaattccagtatgctggctaaacaatcagtttcatttcttgagagtcacatttttatttcaaagatgggattataaagaactgaattaaatttaattgaagtaaaaaagtaaatacattaaatgaactttatctgttatatttgtattggtgtatatttgtcacatacacatacatgcaaatagatgttaacatacacacagacataggtaaaaatcatgttggtgtcttcacctcatctgcagctcttggctctgagtgagctccagatatatgggcagtatcgtctgtagggagtcaagaatggaacagttcggattgcagtaaaggctagggagtcctgcaacgttgaagtcatcaagtagctatggtcctgcccttggagcctcattatataatctttctcctatttgaagctgccttgtttgttttttcagaagagacacagccctctctgcccgtccaccactctgttgtgtcctccccttccctcactccgttcctgctgagaaagggacagtgataggatgtgcttcccccaaaccctctcagtgtctgtggggatggctttgatgcttgacctttacgtcgccatattcatgtcacccaggtttgctggttcctttcaagagggtggaggttcttccccctcattttcaattccctacgaagctctgtgtgaaagactttctttacacttctatccccggcgtgcctgtgttctgtctctggaccttacttccatccatgacttcgggtgccatcaactgtgagaggtgccttttaaaagtgggctttagtgttttctttctgtatgtttattaagataaagttccagtttccatcagtgacccccag

SEQ ID NO: 21541 - DNA, 1028 bp, Homo sapiens
ggtgtgctggctcacgcctgtacactcccactttgggaggccaaggtgggaggactgcttgaacccaggagtttgagaccagcctggacaacatggcgaaaccctgtctctacaaaaaatacaaaaattagccaggtgtggtgtgcacatagtcccacctatttgggaggctgaggtgggaggatccctggagcctaggaggcggaggttgcagtgagccgtgatcacgccactgcattccaacctgggcaacagagtgagaccgtgtctggaaaaaaaagaaaaaagggctctttatttagcctctccttgctccacatcagaatgttaatttccaactgcctcattctgtctaagtcatattcatttgagaatgtggcgaagtacaaaagtatgtcaaggtacagataaacgtcttgcattccagaaatatatactatttacatttgctcaatacctgagtattattgactataattatcagttggagatctgtgtcttctaaatagtcattcacagtaggcactggaggtggtcttatgtcagaaatttatacagatcctgaaaggacaaatggagatgtgcagaacatccttgtggtttgaaaatctgtgtgtaattcactaatctgcaattggtctgcatagccagcagtaacaaacagcacacgtgtggtctggttcttgggaactcactgaactcccctaccttgtctcttatagggcatatatttcaaggtcagcgtcagcttttatctgctatatgtatctctttcacatgtgatgttgttcacattggagagtcactttcttatactatatggagttttattaatgaattaggaatttcagaggccacttctttctgcccttcccacccacccctcctcctgccccagtcccagccaacactgtttttctcctggatggtcacatcatcctgactccctgcttttgctcttcttgccctgcagtctgctctaacatatctgtcaaagtaacttcgttagtaaaatttaggttacatta

SEQ ID NO: 21542 - DNA, 1108 bp, Homo sapiens
ctgttgcctctgcagtctccttgcccaccagctatggccatccccactccacccctgccccactggcctccttccttccttaaatgcacagggcacagggctgcctcggggcctttgtgctttctgggccctgcctaggacatttttacctttgatatctgctttcaccagttcctcacttccttgagtttgttcagagtcacctcccagggagaccacccacctcatccctgcccagagacttctctcaggacactctacgtgaaggggtttccttatttgtttattgtctgcccctccccattagaatgagaacttaagctccacgaggacagagacttcgtttgggccactgctttatctcaaatgcctagaccagtgcccagcgcttagggagcagggtgtttgtgtgtgtgtgtgtgtgtgtgtgtgtgtgtgtgactgtgcatgtgtgtgtgtgtgatgaatgaatacaaagtacagtctcttgttcttttcctctcagttgtgctgtgatgtagctcctggacttttgtcagaatgggagcagccatatttatggcatgtggaaacagttccctaattatgcaaaatttatgaattccacatccccagtagtattaaaagctccatctcccccatcaaggactttctaaacgtaactctaaaaccaaaacatattaagaaaaagattgataaaattgatcaaaagattgatagaatttacataaaaataaacttctgtattgtaaaaatatcataagcaaagttcaaaaaaagaaaaaaaaaaccctggatgttaacctactaaatgttagcatctttagtatagaaagagttctttcaaaattaggacataatggaaggataaataaataaaagcacagaaaaagaaaaatgccaaaacacctaagctgggaagtcaggaaataagatatacacatggccaataacatgtgaaccttgcaaaaatccaggaaatgcaaattaaaacaacatggaagaatgattggctaatactgaaaacattcagtgtgaataaaagatacagggaaattgaccctttacaaactgttggtacatatggatagttgataaaatctttatg

SEQ ID NO: 21543 - DNA, 1026 bp, Homo sapiens
gttagaatgaaattaccccctaatttgttaaactgtaaatcctgtctagtcactgaagtttgtttataaatagtcaaaaaaaaaaagtattaagaaagaactgtctgagaggctaaggcacgagaatcgcttgaacccgggaggtggaggttgcagtaagccaagatatcttgccactgcactccagcccaggcaacagagtgagactctgttcctccccatccctccccaaccccccaaagaaagaactgtcaagagtgaaaatttgctggtaagtgagagtgaatcacttactggaggattggggccttatcatgctaagcacttttaacaaattatttatattcttttatttgttggtcataataggtaggtagcaaataaggaaagaggtctctaagagtaaataatttgtccaatgccaggcaacccataggtgtcgggggagttttagctcaggtctgtttattctttccacaacgctatgcttatttttttacttgtatgtgtacggtatgcctcattgagtgtcagtactgaaaggtgattcagagaactttagattccagtcttttattttatataccaaggaaccaaaactgaaacttggcagagttaaaataatagcatactaggaccatagtctaattatgttcctagcactgtattaaaacattgcatgctatttacctctgagaaacccatacaaaagagagaaagaagataagttgtctttaggaattggtcgttatagaggaagtggggatttgcttttgggaattttctgctgacgtgtggcagaagggtgtactaactacatttgtgctcttattggatagaataagataaccaatagttgaagaataaaatggaaacactgattaaagtaactttttaaaaaggttatgaatcttatactatttcttttatatctttctttctttcttttttttttttttttttctttctctgagacggagtgtcactctgttgcccaggctggggtgcagtggcataatctcggct

SEQ ID NO: 21544 - DNA, 1041 bp, Homo sapiens
agtaaaaaaaattgagacagggtcttgctgtcacccaggctggaatgcattagtacaatcagggctcacttcagactgacctccctagcataagcagttctcctacgtcaaacctactgagtgactgggactacaggtgtgcctcactatgcccagctaatttttttttttttttggtacatttgggatctcactgtttcccaggctggccttgaactcctgggctcaagtgatcttcctgccttagcctcccaaagtgctgggattacaggcgtgagcgactgcacctggcccctaatctcctttttaaatgtcatctttattgaggtaaaatttttgttattaaaaaaggggaacctaggctgggcgcagtggctcacgcctgtaatcccagcactttgggaggctgaggtgggtggatcatgacgtcaggagatcaagaccatcctggccaacatggtgaaacaccatctctactaaaaatacaaaaattagctgggcgtggtggtacgtgcctgtaatcccagctactctggaggctgaggcaggaggatcacttgaaccagggagctggaggttacagtgaaccgagattgtgccactgcactccaatctggtgacagaacgagactccatatcaaaaaaaaaaaaaaaaagaggaacctggctgggtgcggtggctcatgcctgtaatcccaccactttgggaggccaaggcaggtggattacttgaggccaggagttcgagaccagccaggccaacatggcaaaactcggtctctactaaaaatacacaaaaattagccagggtattgtggtacatgcctgtagtgtgagctacttgggaggagaggcttgagaatcgcttgaacccaggagcagaggttgcagtgatccaagattgcactccagcctgggcaacagagcaaaactctctctctctctcaaaaaaaaaaaagatcatttacggtgaattgagtgctgaaacatttaataaaggtgtagcaccaatgaaattaagatatagagcatttcattccc

SEQ ID NO: 21545 - DNA, 1045 bp, Homo sapiens
tttttttgccattactttcaatggcgaaaaccgtgattacttttgcaccaacctaatataatttcaatttttgaaagtttattgaggtttgttttgtgtcctagtatatggtctgtcttggagaatgtttcgcatacacttaagaatgctattgttgttaggtgaagtactccatagatctgagttaggtttagttggtttatagttttttcaagtggttgatttccttgctgcttttctgtttagttctattcttcattgaaagtggggtattgcagtgtccgagcaattgttgaattatttttccttttatcactttttgcttcatgtattttaggctctgtgtgtgaggtatatgtgcttaaaatgttacatcgtgttgatctgttagccccatcattacaaaatgcccttctttatctcttgtttaaagtctattttgatattagtatggccactacagctttcttgtggttctgtttgtatgatgtcttttattttcaactcttttatatctttgagtctaatgtatatctcttgtaaggagcatatagttgaattttgttttttatccaacctagcactttctcccttttgactggattattttgtacattcacatttgcatttaatgttgttatatatatatagttggacttagcctgccatttacttttgtttcctatatgtttcttttactttttcctctatacttttcctgctttcttttgtattaagcaaatattttctagggtaacacttatcctttgtaattttttcaacatgtttttgagtgtttttcttagaggttgctttagggcttacaatatgaacctcattggaatctccttcatgtgtatattaacttatttcagtgagacagagaagccctttctttcatatagttcatttctggctttcctctgcgtgcgtgtgtgtgtgtgtgtgtgtgtgtgtgtgtgtgtgtgtgtgtgtaattattgctttataccttgcatctagttatattacaaacccaacaattattatgttacataattttatg

SEQ ID NO: 21546 - DNA, 1031 bp, Homo sapiens
taaagtgttctaatgttcactgcagtactgatcttaaattactaacgctaatgactttgtgttatcttgctcccctccaccgccaagaactctagctcacaattaatcaagaaagtggcagtgacacctgttaaaaaattggcacaaataggaactactgtggtaaccactgttccgaagccttcctcagtacaagtaagttgtgctggccattcgtgcacttgttgttctcttaacttttaaaaaaatcatttagctatctcctgttagatatgtaagttactgtgtgacattgaagatagcaattcagtaatatatgatggcacttatcaaactgggaactgttggaggtatgggaaacaagataaacatggtgtacattcttggaataccagttttacttcagtgtattaagttaatacaaatctgcctaatagccatgtgttgcagtatctggaagcaggttctgagataaaatttgggatatgtagggataaatacccatggaaggaaaggagagtagataagggtttaaactagatgcaggcccaataaagccttagccatcttagtggagaactttggaggatatatggccggtcagcattgtcccactatgggttaacatggttggctgggccttaattcctactctctgttcagtcactggatgtggactttcctgggaaagttacctttgggcaaggtgatcctctgcagctgagggaagcctgatggaacttataaatggaggctgtctaatatcattcctagcagctagctaggacagtacatatcactccttgtcatggttcatcacaggctactccttgcatcacttgtatgtgtttcctcatacatgttggagatcagctgttctgggattctcatggttttcgtctttggggaaacaaagaggaggctaatacgatgaactacagtccccactgctgcagctggtttctggtggcacctgatattaattatttccctcttccactgtgccttcctagattcccttcccctcaact

SEQ ID NO: 21547 - DNA, 1019 bp, Homo sapiens
agcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactagtgagtaacattttgtttcttccccagttacttattttgaaaattttgaacattcagaaaactggtaagactagtagaaaactagtaaggctatatactgtttacgggtttgaccaattaatttttttttttttttacctcatttgctttgttttcctctttctactcacacccacaaacacacatataagtcctttttttaaagacagagtcttactctgtcgcccaggctggagtgcagtggcacgatctcggctcactgtaacctccacctcccaggttcaagcatttctcatgccttaccctcctgagtagctggaattacaggtgtgcaccaccacgcctttctaatttttgtatttttgttagagatggagtttctccatgttggccaggctagtcttgaactcctggccttaaatgatccacccgccttggcctcccaaagcactgggattacagacaggcaatgagccaccacgcccagcagcaaacacacacgtaagtctttactgaaccacctgagagtggttgcaaaaattatgacagtgcatggtgtatatctcctaaaaggttttttttgtaa

SEQ ID NO: 21548 - DNA, 1077 bp, Homo sapiens
cagagaacatattcttgaacatataatttcaattttattaaatttattgagacttctcagtgtgactaattttgattaatatctcatgagcacttgggagaaaaatacgtattattcagtttggggaagtagttttttgttgtctacatcagtttggtgaaggtgggtgacagtgttcacatcttctataccctgggcttttttttggttttatttttcagactgtttccatcacttacgtagagtgggtattaaaatctcccactctgattttttttttccttttgcttgttttttcctttagttctgtcaatttttgtattatatatttgaagctctgttattgggacatctcaagccactagtcatagactagggagtgcatagactagggagtgctttcagaccaaaagacataaactcacaaattttacccattactgttcccatcatccaacggttgacttacctctgttttctgcctgcctttattaagtctccaaatgattgccttttaaaaactgtttgtagattttgtaattgttattgatcaaactattgtagcattactagaaaccacgaccatcatttcttttttaatggattattgtcctgtggtatagttgtttgcctctatgttcttgaacaattaattgtagttattttattgtgtgcatgtgtggttttctttggttgttgttgttgttttttttttttttgagacagtcttgctctgttgcccaggctgaagtacagtggcacaatcatagctcactgcagccttgaacttctaggctccagtgatgctcctgcctcagcctcccaagtagctgggactacaggcatgtgccactatgcctagctagctttttttaaaatttatttttgtagaggtggggtcttgctttgtctcccagactggtcttgaactccaggcctcgagtgatcctcctgactcagccttccaaagcgctgggattatagacatgagccaccacaccctgccatttgtggttaaagtcaaatgcttaatgtttccaatgtccgggttacctgtgactctatttctattatctg

SEQ ID NO: 21549 - DNA, 1033 bp, Homo sapiens
caaactcctggcctcaagcaatccacccgcctcggcctcccaaagtgttgggattacaagtgtgagtcaccatgcctggccacgtgagtacatcttgatttatagtaggcagtttctgtataaaacataataagtataatttacaatggaatagaatttttaaagtaatatttattgaatggcattcaaagctctattgtgtatagctttcagctggaattcttttgttgtatatcagtagcgtatttccaaacatttagttgcactaggcaaaatggatggtatctcccccacctagaagacctcactaagttagcttgaagctaacacttccttaacctgctgtcttgtatactacctattctgactgattttcccgagctttccttttcctacactcatttgttaatacagctaatgccactgtctacatttgcgtatatataaaataacaaaagattatcagcccttttaagtcaaaataattatcatttggttatatttggattcagtttgaaatcaccattattttgtagactttgtttgtaataatctttatgtcacagctttagccctgtccttatatttcagttcatccctgataggatttatttttatctgtacagtgtaggaaattctactccatagattttataaaagtgagttactctttttaaaaaagtgaaatccccccatctctttccactcttgaacatccatttacttttgataatctttcacctggtttgatataattctttaatcattagtcataaactgagatctaagtaaataagtagaaagtgacatgtagtacagagcttttgatctggctaccaggtgttttcccactgaagatatgttatagtcgcctatatgactatggccctgaagaagcttcattcagtgttttccagttgaaaggtgctatttgggttgctttagatgggattcatttgatggtgttgatatcatttggtctgggtcattacattttcttggctaaaccatttaatatgcagtggccttaaca

SEQ ID NO: 21550 - DNA, 1054 bp, Homo sapiens
ggcaagtgaaaattacatcctgtgtagtgataccaggtcacagctcaaatttcttgaaaagctggatcaattggagaagcagagaaaggatttggaagaaagagaaatgttacttaaggcagccaaggtaagggccagtgtgatttatgagtgaatgtggcctggcagtgtggtcagaggtggctttatcgttggttgactgtcttggttttattaggcctttagatttctccagaggatttcctaaaacgaaattactaataggatgtctcacagccaggatggtgtggtggctttcagttaatttagtttaatgagtcataatcttttgtcttctcacatttcctgtgtgctctccccatcctcaaacccaggtaaaatgtttcgtaaaatttcagggtctttttaggaatccaatttgatacatgccaagttgaagttgatagggaaaatttggaaagtagacaggaaggttatgggtaaaattagtaatttggattttgtggaacaaaatacaggctgggtggaaatagagtaaaagaatagcgaggcttctttatttaattttatttttggagacagagtcttgcactgtcacccaggctggaatgcagtggcatgatctcggcttactgcaacctctgcctcctgggtttaagcagttctctgcctcagactcctgagtagctgggactacaggtgcctgccaccacgcctggctaattttttttgttgttgttggtttgttttttagtagagacagggttccaccatgttggccaggttggtcttggaactccgaccttgggtgatccgcctgccttggcctcccaaagttttgggattacaggcgtgagccacccgcctggccaaggctatttatttatttcccttctcccttatttaaacgttttcttgggctattagtgtcacatgaggtaaaagctaattccactacagtttccattttgaagctccacatttcttcgtaggctttgggccattgtgagaaatcttaaaggctgagcactggagtcttaatttttgttttaag

SEQ ID NO: 21551 - DNA, 1048 bp, Homo sapiens
attgtttttattcatttaaaccaacaattactctttttttcttttccttcatctgtaccaccaattttttagttttcagtgttcctacaagaacaacgtcatgcctcaactggacctgactgacatcgttagcatcattttcagtataagcttcctccaggctagaactgcagcagccagcccagatgatgagggggcaggggaaaccagggtgggagtgcagctagactggattgaggtattttcccctggagctaagatattcaatcacaagagaaaattgtcatttattaaatatttaatggcaactatggtgttcagatgctagtaatttctattaaaattttcttttcctttgatagagtcgttctaataaagaagatccagaacagctgagattaaagcagaaagccaaagaggtaggactttcaagttaccatgcttgtctttgtgtttgagggaaggttggcagctctctcctggcaattaggtcagggtttattttgctgttgcataccatttgcagaagccttggggaaggacaggaactgctaaaggcaagggcagtacttcaaatgaggtcaatgagttatgtgctctctttttaaaatttattttcaaggcttaggcctgtctcgaaatgggtctttgtaaactacagcagcatacttggaggaatataatgtgagattttaaaaaaaaagaaacttttgagatttagcatctgggactgtacaataggctacatttttccagggtaattgttcgttttgtaaatctgatactgcttataattctttggctgggaggcggtgctgggatttagttttaaatggaaaatgcctctggcttttaattttctgggcccagcagttttctgttctggaatggagcccttgtttcacacagttcatgtttagctgcaggggttttagtttatagcttagactggttaagcttttactcccagaggcctctgcatagcaactgtagaaatcaacaaataagttcatttatgtctgcagcctcctctcagtagctgactttt

SEQ ID NO: 21552 - DNA, 1094 bp, Homo sapiens
agttattcttcatcgtcctacactagtattacatgtagcaaataaaagtatgtacatttgtccttggaagttaagtaagtaaaggtaattgttagttaaattattagctttggaaataaaatggcaagctagattaagtctagtaattagatgttttttaaaatgctgcttatatgtgtttttgaccattagcttatagaccgttttcaactgtactcctatggggcgtttggaaatgtgtgaaggggtggtgttttgacacagtgattcagtgaagggtggggtgggttgtgtgctgttggcattttgtggcttggggccagcagtactaaacattgcacatcgtgagggggcaaattcacttaatttagcttacccaaaattctaataatatccccattgagaaacactgatacataaatttctcaagcatttcagtaatatttataaaattgagttaccatactctaggatcttatagtatctttcaggtaacttttaaaatttacaaacatcttttcacataagtgttggagtaaaaatttctgtagctatcataatgtttgtggatgtagaattccagcttgacaaacttctcatacttctataccaaagtacaccagatcataagaaagagtaaccatgttcctttggggaagtcttcaggaagggttgactttgaaatctcaattttaagttaaaaattgaaattaactttgcatttgcttttcagattgaggtataatttatatacaatagaatgtattggttttaattgtaaccactatcccagataagatataaaacatttctgtgatccccagaaagttctattatgccttttaccacctgcaaccccctctgcaattactgatctaatttctgttaccatagcttaatctttcctgtttcagaactttgtagaattgggaaccatatgataatgtagtcttgtttctgaattatttcactcataatgtttttgagatttattcacattatgcatatcagtagtacattctttttagtgctgagttgtcttctgttgtgtaaatactccataatttgtttattcagtgttactggactgtttt

SEQ ID NO: 21553 - DNA, 1026 bp, Homo sapiens
aagataaagtgtgcataggaataaactggtttttatctttaaaatgcagactccaggatcttctttcttgataataactctggagtgggcccaggactcctgtttttgttttgttttttgattaagtcccctgggcaattctaatatagtaatgagatgttagcctctgtaatatggcttctgcctaaatttccagcacattcttaccaccagctgttagtggagaacataacacactccattactttccttgtcaatttttcaatgaaatatatagctatcaaaaatgctttgcataattttctttattttggcaatgaacgaaaactcaggattttgttcttggcctaaaccagataaaaatgtcaatagccttgggaatactccagttgaaggcagtaggaaacctgaacatctaaatcatgcggcaatcatggaaatcttggtgataatttcaatttacctaggctgtttacatcagttacactacaaactaaaggctaaacagggcctccactgacactctggttaaagtttagtgcaatacataatttatcaatgagtgcacacaaatgagtttaattttgcctgctacccttaaaccccccattattatgtagattattaatgaggtcaagacatccctaacattttgcaagaaagcaagcccagggaactcaaccaactgattgtagacaaagttgggaaattacatgaagtctgatttagtcaccaaactaccttaaaaaaattcccttagaaaaacagtgagaaaatttctagagtgtgacttgaagtgtaaaataaaaaaagaaagttctttgtaaatattttcaagtgaaatatgcatatgcaaattttaacatgatgaccaaaataccttggaatgtttcatggtttttttttaaatcattaaaatacagaaaaatggtctctttgtatgtatttatgcaattatgtctatccatttatatctacctatttatctaatctaccttgatctaattaccttttttaatcaggaaa

SEQ ID NO: 21554 - DNA, 1047 bp, Homo sapiens
ggtgcagaagttgtgatccatccagagcccaatagagaggaaaactgactgacttattttggtgaaaataagtagtggtagctccaaaggaaggaaattcacaatgaattctccaaaacacaagtgaaaagctttgctgtaattcatgtaaacatgcctaatatatttaattttatactgaagaaacaagcaaaaatgtttagtgcatctaaatggtcagagatactggaaataaaaagcaacaggacctaagtaaactttaggtagttcttttagtaataggatataggtcaacagaggaaaaataatgtgtataaaaatgctgagagcagtattaattacatttagaaattgtgatagcccaaatgcctaattatagaatgactgtctatatctaagtagtagaatactatggaaatgtttataaaaagaaacattgaaaagttggaacataaaatatgtatacagtaatgaactgattatttcaaatggaaattgtgctattacaaagaactatttgaagaaaggttaatcttttatggaattaacagcaaaccagatattaataggtattatgctaaaaaagaggagagtggggttctttgtttaaacagatttgaaaatctctaggtttcttctttactccaggaattcaagtattttaatatgctaatgtgtaatatatagctatattagagggacagagctcacagagctaccactacttattttcactaaaataaacccatagaacacattttaaggaatactgatttatactgaatgcccactaattttttacattagaaaaaaaatcacttcagattgttaaatatatatacacatatctatagatatgtgtgtgtgtatgttttgagacagggtctcactttattgcccaggctgaagtgcagtggcatgatcatggctcactgcagcctcaaccctctgggctcaagcaatcctcccacctcagcctcctgagtagctaggaccacaggcacgagctatcatgcacagctaatttttgtatttttttgtacagat

SEQ ID NO: 21555 - DNA, 1076 bp, Homo sapiens
gtagaggagcggagatcgcgccagacaaagggagactccaactcaaaaaaaaaaaaacaaaaacaaaaacctaatctcaccccagcacagttgcttgtgtctgtagtcccagctactcaggcaactgagatggttggaacacttgagcccaggagtttgagaccagcctggacaaaaaagcaagacaccatcttcaaaaaaaaattgaggggtagataaaatttaaaaatagatgtctaaaaaaattttttagtaagatgaaataagcacctaatttctccagtagataaatctcacatttctacttggtaagtggattaaaagatattacttggtccaaatttgaaacatatctaggatagaaaatgtcctaagtggttagtaccttctccactccaaattggcaagggaattcaaactatgtctgttgtcagcaataggaacagaatgtacatactttttctctcttatttttaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaagcaaaatcactggactacatagaaatctaaatattaagcatgatatctaaaatatttgtaagttgtatttcttctcataaattatatttccaatatagttttttaaaggagtttatgaaatgaggtcctgaacctactgacatatagtatcttttatatgcttatggagagaagaaaaataatctaaaatgtcttgaaggtagctgggtattccctaaatagcccttgaagtagttttgtctggtaaggtgaggagtaccaagcctttgtcagcaccacaatcgtagtagtttgccttctaaaaatcttgtagtaacagtaattccatttaaaacaacatttattgagcacttgctatgtgctagg

SEQ ID NO: 21556 - DNA, 1045 bp, Homo sapiens
cagcacctggctttgtaattttaacagctttattggtatcttgttacttgagtagttatgctctaagtatatactttaaaataattttcttctttcctaaaatctgtgctatttaattatataataaaggttgaggccgggcgcagtggctcacgcctgtcatcccagcactttgggaggccgaggcaggcggatcacaaggtcaggagatcgagaccatcctggctaacacagtgaaaccctgtctctactaaaaatacaaaaaaattagccgggtgtggcggcaggcgcctgtaatcccagctgttcgggaggctgaggcaggagaatggcatgaacccgggaggtggagcttgcagtgagctgagatggtgccactgcactccagcccgggcgacagagtgagactccgtttcaaaaaaaaaaaaaaaaagatttacttaattttaaatcttgaggactagtttacaacctttgattttttttttttttgaagtttttttggggaatgatctcgattatcgactcggaaaatagatagactaagtgccagattttaaattatttaatttatactgaaattgggagcatgatgagtgggaatattgtttttcctctcccagtgttgttgattagccttttgttgggagaatgcgtaatggaaattcgtctagcatctgctagtttaaagttgagagaaatgtaaagagaccttttttggttatagggtaatgccctgttctgaagatacgggccttttcaggaacatgaaaattagttttagtaattcttgatttgtacctttttccttcctacttctgctttgttttgaaataagttctgtctagcactttgatccattccagcccaaagtgagatgagaataattcgttttatgtctgaagaaacatgcttggttgtacagaggaaggaacagtaaaattggagataagagacctgaatatctctattttattttatttttagacaaaatctcgctctgttgcccagactggagtgcagtggtgcagtcttggctcaccgc

SEQ ID NO: 21557 - DNA, 1058 bp, Homo sapiens
gttatgattaacttcagttttatttttcattttttatttttattttttaaagtgacagtctccctgtgttgcccaggctgacctcaaactcataggctcaaactgtcttctgcctcagcctcctgaatagttgcaactacaggcgcatgcttacccagctttccagttaaccatattttttatgaatgacttataaaggcattataacactcaaattttgttctgtgatgatcctctctgtttgtttgttattcttgaacagttacaactgaacttaatgtcttattaaagttcaggtattcaaatcttgtatcttaaaagatactgttatatatgttttacataactgtcctgagtgtgtgtaatgtgtgtcaagatgtgtaatgtgtatcaagatgtctaatgttttgggcaaagtattagagtagttgaatatgtttttcctgttgacatgaatgttattgtttttagaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataaga

SEQ ID NO: 21558 - DNA, 1024 bp, Homo sapiens
cttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctcctacttgtgtgtctaattaaaatttgtctggaggcaaacatttaactctcataattcacactgaaagacgtaggagataacccattattttgcacttaaaaaagtggataagaaaaag

SEQ ID NO: 21559 - DNA, 1027 bp, Homo sapiens
catcatgtagaagaaagtatgtgagcctatttacgtaatatataaacataacacagtttatatctacatttatttccagatagctctatcttgtaagccatgagttcacactgatacctccaatcctaatctactaaccccaatgctaatctaataccccatggtccattctagttttctgtctttccatagatgtctcttacttctccgacagtgagaaaccagctcctcttactcttaatatatctagatatttgattattgccttgtaggtagccagtcttccatcttggccaccatacctttgccatgtggatggtctcctcatcacacacaggctgtgactcttgatgacaggccacccaccttgcattttcctcttcctgttagacttctaacactgcacatcaggctactcctcagtgcaggtgccctcctcaccatggttggactctaaaactcctctccaggccacctctctgtgctacctcaccccacttggctctgtgattccctcctggactgtcatgatcatggctgtacccctctccccttctctacacgcttacaatgctttaagcctcatacctagatgttcagaagagggaagagaaggctgtctggattctgattaggttcagctgttgggtagtcacagcaatggattgaatggagaaagaaaagtgagattgagcatcatatcctccctgcaatgacagcacaggcttcattcattggccagctcctatcaggatgtcctctccatacagtcccctctctgcccgtggtctgataagccctgcgtcccttcacacttcaggtcacacactaactcccattgttaattctagtttacttcactgttctctgtggtgttgcagcccctaggccatacctttttaagtcatcactttactctcctcaaatgatcctaacttgaaggagctgttgtggctgctaagactcttgactggcagaccttgtgaggaagttgagtaatagaggtgtaagaaaattatactggttt

SEQ ID NO: 21560 - DNA, 1043 bp, Homo sapiens
tctgtcttctcctgttctcttcctgtgacctataactacattgttttccctgactcagcttcagtgtattgctagcccagtagatggatagtggtgccattaactgagataggtaaagatggaagaatatgtactatggtatgaatgtaggtatccctcctggatttaaatgttggaacttgaactccaagctgatgttatcaagagatgtggggccttttgagaagtgattaagtcaggaggactttgcccttgtgaatgggattaaacccttataaaagagatttcagaggcctgcctggactttctttctcttatgccaagtgaggacacagcaacgtggtgccattttggaagcatagaatatcctttaccagatatcacctctactggtgccttgatcttggatctcacagcccctagaactgtgacaaaatacatttctgttctctataaattacccagtcttgagtgttttgttttagcagcacaaatgaaaaagacagcatgttttccattttggacgtgttggatctgaggtgcatttgagaaatctgtgtggaagcagtgaataactaattggctatacaggtctggaggttaaacttccaaggtggagttaaaaggaattgggaaccattgatgtatgcctgttaattaaaaccatgaatataaacaaaaagggctatagaatagatttagaagagggcttaagatgaaagtctgaaatttccaaatgttaatggctgaataaaagagaatgagcttacagaggagacagaaaagtaatcatcagtgaagtggggtagcataaaaccagaattctatcattgaatacacttccaatgatatttagaaagtgaatatttaggaaggaggccatgatttattttttcggaggggaaaggaacactgtctctggggaaaatatgtgttaagtagttacttcatttcacttagctattcataatagtttaagagagggatcagggaaaaggggagttccagggtgactgtgctcatggccaaggctgtgcccgttc

SEQ ID NO: 21561 - DNA, 1057 bp, Homo sapiens
gaaaatgtaattctctgcttcacatagcacactcatatgctgtaaaacttaataaacctgtgataaaaggcaatagtccctcagtgtaagaaattgcagatgaaattatagtgggatatcagcactcaaatttttaaaaaatgcattttcaagggtttataacttgttcatgaaattttattttgggctgaaaatagcacatgaaatcttaaagtagtcacttttgaatttcttaatagatttgagtaaaattatcctgttttcaagtatgttcatgaattaatgctttatagataaataattttagtcatgtatttaattctcacacttttctaaaaatattgactgtgtctaatgcattttaatctttgtttagtccttcttttggggagagcctgaaatgttatcttttgctttatcttcctcttcaaatgtcatctgtctttattatctgtatgtgtgctgctttttttaagtgacatgagcgtttacatcatagcgtggtagcaaatgaactaaccctgaaagcagtttcacctttgcctcaggtttaacagagacacattctgctttggcaatattagtgtcttagacaatcagatccctaaaaaaggaggggtttaagaacttactattgacggtcacttcagatcccccttagaggaacttatgctccaactcccacatacaaaccaatacttgaaagttgttattttgtgtaaaggacacagatggttgcaggtaacaagacctatgtcatgtgatctcatttcacaaaattacacttgtaaatggggaaaagaaagacatgccagaaggagtctcacgtgagagctcttcatgtaaagaaattagataattaacagactgcttggaatagggtgctcagagtatgctacccttcatgaattgtcctaaatggcagtccttttgagtaggaaggcctgtttttaattgctgtgccaggatatatatatttttaagcaaaaccaaataaagataattaatgtcttttctcaaagattaaaaatgtgacaagctagttgttatatgtctt

SEQ ID NO: 21562 - DNA, 1049 bp, Homo sapiens
ctattaaaatttttaaaatcaaaagtacaagagtatctatattagcatttcaaatgatcaggaaaatatctttaacagctaaaggttctgtgatcattaattaatgtaagaattttaaggctgggcacggtggctcaagcctgtaaccccagcactttgggaggccaaggtggatggatcacctgaggtcaggagttcgagaccagcctggccaatattgtgaaaccccgtttctactaaaaattcaaaaattggctgggcgcagtggctcatgcctgtaatcccagcactttgggaggcttaagcgggcagatcacaaggtcaggagatcgagaccatcctggctaacacggtgaaactccgtctctactaaaaatacgaaaacaaaagattagctgggggtggtggcaagacctacaggcgggacctgtagtcccaactacttgggaggctgaggcaggagaatggtgtgaacccgggaggcagagcttgcagtgagccgagatcgcgccactgtgctccagcctgggcaacagaacgagactccatctcagaaaataatataataataataataataataataataataataataataatttaatcacctaaaaatgatttattcctcaatttaaaagtagacttatcaataactgatgctctcactcttttccagtgagagttgtatttagtcaaggaataataaaagcaatgatttatttttgagtgaatgcatgtggtagcctatttgacagcaagtgaaagtctagaacagtgccaatacctgcccacagcaaccaaattgggttttctgaacagatttgatagtatcaacatggtacagaaatcagaacagctatgtgcgtatcttttcttgtcacataccccaaaatagacaaaagtataatttctgctatcacacattgctataaaaagtatgcaaacatataaatcatactatacatttattttgcattgccaaacataatctgcataattagaatatattcaatcaatacttttaattaaacattttattttgagat

SEQ ID NO: 21563 - DNA, 1571 bp, Homo sapiens
tgcttctgtttttaaaactccatctgtttctaatacatggcttctgtgaaggcatgccgttgaaacctggatttcctgtacaactattatgcattgtgcaggaccttgaaattagacaattgactggactcaaggaacttctgccaaatctgttagaattaattgttaaagttacttggaactgaagaagagaataacttcatggcttggagcttgttccattaaaaattctagaattgtcacctcagctggtagtgcctcctacagacaatcatgggttattcctattagctcatgcaagagggtgtggctacaaaacaaaacatgggaatttcagtaaaaagaagccatagaggtagtgacctattattttcaccttcagcaatgcatatatatatacacacacatatatttttttccgacttaaataaggctaagcaaatgaggatatactccggataactgcgagtgtgttaggttgaaatgctttctaaagaggaaaaaaaagaaagaactacccagaactaatgcattagtgtcatgtttcacagttggctcaagcttctggggtacagggcctgctaagttgtctggaagaaaatgcctttccttcatttttttttacccctaaatcaaatcactaattgtgtaaatgcttctgttttttaaacatgagcctgcttttcctagaaaatagataatttgacttgaacttaaacttacagttgaaaatttgccatatttacatagttgataccagtagcataatttatgttttcacacccaatacctaattccaaccctactcactcacctgaccctgctctataggttgtaaatgttacagattattttttctgatctcccttataagtatgggtgacagtgcaactcaggcatagccattgatatgtaggtggctgtccactggcactgcctctgcccctattcctttcattttgctctaataaacagcaaaattagtggagctgcatagccattatgtcaacatgaggaaaagacgtaaaggatataagagacattaaatccaacttgtttgagcaacggaacccattctagtgactgcttatttttagaattcttgttatattagaactctatatatttatataggctgacatatgctctgccttttatcctagtaaatatcatggtataacttatttattattagaataattgattcattcattatgttacagtatgtgattgaagtcagcgtataatatggcaaggtaaactaaaattttaataaaaagaaatataagttgaagacagtataatggtagaagagtaaaataaagccaaaagaacacaaaaatatatctaaaagatttatatatattcttcaagatcaaacaaagatttgcctcaagatttccagcacccagtgcaaaggggaacacaagatgaattacacaattcacagtgtccataagagaataacaaacaaatcagttgcttagcagaaggccgactgctactgactaggaaatgatagagacgttttccccatggagagtcacaaagtggttattgtggattgtaat

SEQ ID NO: 21564 - DNA, 1023 bp, Homo sapiens
attcaaaccaaagctatctgatccagttcctaccattcttaaccattctgctaatttccagaagtccagctgataaagtgtaaaacaaaagttgtttgttgctgttaccaagaaaatatcagggaatgctttctactaatacatcagcagcctctcttcttcttcccctctctcctcctctctccacccagttacaagctacaggtgcttcaagcatcaaattggacatttctgtgcagtcatagaatagctggaacttaagatatttatttttctggaaaaccactgatgtgaggtagaggtgattacacagtcacttaggtcaagagatttgtctgaatgggaacacaatattaaaagtgaaaatggacacatgagaaacatagttttcctggaaatctcttgctttagcatatacattctgtgttttaaccctgaatataattcatgacgctttgttggaggcatcatgacctaacactgttgagataggtagaggactgatgttcaggagatgtggtttcgaatctctctttcactagctggctgtgtgactttaagccagtcattgtttccttatctctctcatagatacgttcataactctgatagggcctcctggtgcattagtattttgaggacatgattacataagctatttttttcctttgaaaatttaaaactatctcataagtaaatgaaagcaaaagtattttactcttcttttgtcttgcatttgctcatccattatccagtttataactttctgttatctttttgtttattaactatcacttcattcattgggctacattctatgtaaattatttaactctgcaaagtgggaacacaaaatatttaataagactctgtagacagaaagcacaaggcagtgtgaacaccacagttagtttctgtccagttttttgaagtcatcttaaattcatttattattctctgtccactcaggcaggaattttaaaccctttctgacttttggtttcaaaacaatttttaaagcat

SEQ ID NO: 21565 - DNA, 1020 bp, Homo sapiens
caaaagcagaatccacacaggaaaattttgtccaatttgcttatttataaattaaaattttctcaacacaagagacactaatgaatagtaaaacaaataccacactcagagaaaaatagttcaacagaacaaaagggaaattttattaaaagaatatacaaatgaccaataatgaaaatatgttaaatgtcacaagtaaatgccatgtaaaataatgagttatcactgttcacagatcagattggcaaaatatttaaaatgatcaagaatatgcattgatggtccaggagtaagacagcacactgatctcttaatgcaggttttcttgggaaaactgttttagaggaaaggttcgtagaatcagtgaaattttacttctaggattccattcaaaaaaaaaaagttggcaatgaatatgaagatgtttgtccaaggaagacaaatttgcattttgaatttaaaatttgaattctaaatttgattgtagattctagtttcttaaagttaaactgaaaacaaaaaagtactctcagatgtccactggaaattttatgagctataagggtaatggtggttggctgacttgctaatttagaaaattaggggcaatctaaatttccaagtttctttcaagtaatctaataaagtgtcaggaatcagaggttccaggcaggctagtttagtgtgattactaaggtcattatgcttgggattccatctctgttaacctacctactgttcttttggcttgtggaggcagttatattgttttctgcattgatcttgacttctaagttaccagcagttaattgtatcattgtctatgtgaacatatcttttccttttagggtagggtgtttaaagatataaaccttggactaaagtgatttaggaattctgttaaagaaagaagtccatgaattggaatctgttgtctttatgtttttttcagttgcaatatataagcactagaaaatgttccttctattttatatattcttcaaaaagattttttctact

SEQ ID NO: 21566 - DNA, 1090 bp, Homo sapiens
gccagggagcctcagtcaacctgtcagcttcgtgccttcatttcccccaacgttcatcataaagaaagctataagtagcaagaattgatctttctacggatttgctctgagctgcaaccagccaaggaattactctattgtatgtgtcactgtgagacgtcttgggagaagtcttacagggtgggaattactctgtgctctgacctgtgtgcataaggcctaactcaatgaaaattacacattgcccttatactggacaagtttatgaaagacatccattattattttttaaactatattgggttcctggagatataccttactgttatccttgagtgaattggcttcactttttctttgtcacagaacaaacctgtttacataaactgcatcttcatgtatagatatacaaggacaaattcaacatttgaaaatcacttctaaaaagacatacgactgagcttaaatgacaaaagttggaatagattgtttaggagaagactattggatattaagcctttgctttatgaatttgaatttcaatatatcctgggtgcaatctgtctctgcatatttcagctaaattgtaatcacagcaaccaactaagtgttaacccagccagaatctttcttggatgcttttgagataaatctaaaataaataagacaaaacaaggattaatggaagattaaaagattcacataaacatagctaaatgttaacgattgaagacaatatttttggaagctggggaaaccttttaccttctgtttcttgaggcttaggagatttattcttgggtagttagagactttgattttcctcttttaatgaatgacttcctcctcttccatgctgccttacatgtatttttgtgctataaattttgtaatagcacatttaattgaaaaattttaggcctaccctgtctcaaaagacaggactgtagtcttgcctgaaggtgtccctatactctggtaattcacacaggttagaggtgtgtcccagaccagaaagcaaagctgtaagggtaaaggtcaatagaaaggtaaaggtcaatagagagcctaaagattgacagctctatct

SEQ ID NO: 21567 - DNA, 1069 bp, Homo sapiens
ctgtctcaaaaaataaaatttgaataacgtttcttgatttctttccattaaatattgacattgaatcaaaagaatctgaaattatttggtttaacatattaagttctatattttcatttttgatctatttaaattgaatgttaattataatctgcacaataaatgtgatcattatgagatggcatttgatagtgaagaggatagctttaccagaaaagaaaaaagtcctatttttttcaagatgtggcaacaactttacaactatatactacaacaaacatgactgtgacaacggattttagcatcactttctttcaaagataaaataggttcccctaaaaatactccatcttcctaacattttaaagaaggatcgagatgaaatttataatactatcattgggagccttaagaattttacagaacttctcagtactgaaatcactactctctcaggatattttttcatgtgttttaaaacacgtgctgtagtgaaagattatactgttagacttttgaagtactggtgaaataacttgtttaactcttctaagttatatatttgatatttgctgccttctcaacatcacagttgagttgaaaaaaagtagtggctttcttacaatgctattgaaatagcattatttcaataataatgaataacaggttgggcatggtggctcattattatttcaataatagtgaaataatgctatttaatggccttatttgcttgtcttctttacaaatcagtgattgaacagtatagggaataatcaatttttatcgtacctcataatttatagaaaaagtattaacattttgctgcatgtgcttactacgttagagaaaaaggttataaatggatgctatagcaacatcctggcataatccttcatttattgacagttttattgaatattgtgatttttattgatttagtaataaatttcatttttgaaactacttttatctacttatacttgtgccgacggaaagtgagaatgttgtaccatggcaattattagagaatacattttaatccagttaagtgattgcatttttttct

SEQ ID NO: 21568 - DNA, 1061 bp, Homo sapiens
agacagggtttcaccatcttggccaggctggtctcgaattcctgacctcaagtgatccgcccgcctctgcctcccaaagtgctgggattacaggcgtgagccacagcacctggcccccacacttttgaaggatctttgaagagtctaagttcaactgggaaagtcatagtcttatttattgttggggaaaaagaaactctactgggagcatattaaatacaaagcccttttcattgtggagaaataaagcatttgtgtatttttagttagaaattatgcatattatctcccattcgtctgtctttcaataaaattttaagttgaggtgtattgtgtttcttaagctgctttatactcatttgttcaaatacataccaagcctttaattagaccatttggctattttatttgcaaataagtaatactattaagtgtatctgtgcctccttctgttgctgtttcaattgtgtcatgaatgcactgaccctccatagacagggttaattggagtgtgggcgtgagtgcatgcatgtgtgtggctgcctgctgtagacttaagataaagaatggagatttaccaagcaaagcttttatgtcttaaaaataaaacatatgtaattatgagtgatatatttaggaatcctgccttaataaaattaatttgcatgcactctaccttatagtaatagttctgagtgactttgctattttttcccaaacagcttagcaaagcatctatattgtaatatgtaagtaggcatttttaaaagtcatacaaatgaaaagaaacatttaataagaatacaactgtgctaaaataatttaaatgacttgagagatctgcctttattatatgtagatttatgctatttctctagccagtaaaacaaacatacaaacaaatccctatttcattctttcagcacttctactatgtgccaagtatcagttattaaaaatagagaagaaattcagagtcttgctttcaaagagtgatagttttaacagggaagaggaataatagacagttaagaatctgcttaaggagaaaactgggccct

SEQ ID NO: 21569 - DNA, 1052 bp, Homo sapiens
tacatggggataccaggttggaagctttgagtgggctccaggggaggagtgaaggatacctaaagaggagaaagaagtactgaaaagaaagctatgaggtactttgtaagcacctctgagtatttaccatgtatcaggcacagtactaagtgctttgcattcattgccacttgtctccataatagcctttgtaaggtatatagtgttacattcttttcacagataaggacactgaggttcggttaagttcctcacatcaagccaacagaacagcaaaaaattcaagcctatattgactggctacaaagtttatgttctttctgatacatcagcagttctcaactctaactacagagcaaaagcacccaagtctgtaccccacttatgatcagttatatgaaaagttctgagtaagaggcacagtcctccatatttaactttaagtctcatcagtatttctaaaatgtttccagggctgaaaaccactatcagaaacactgtagatactcttccattttgccaactctcatactgtgtgcttacaggtgttctcacccaggaaaagagacttgactcagtttatgaatggcgcaccctaaactcagatgaaatattctgaacagactgagtgtggtggctcacccctgtaatcccatcactttgggaggctgaagcaggaggatggcttgagagtccaggagtttgagaccagcccgagcaacatagagagactccatcttgacaaacaaacaaaaaaaaagaaaatcttgaatagtcatgcactggccctgtgatttgaggtgctcttaattggtggctgctttgatgttagcaagagttttatcctgtttaatttaaattaatgaaatggattacatcatgcctagtctctaactctctgcaaagggtcctgctcagggccgttctgccattgtaagctttctagcacagctgatgctttttcaacataccccattccaaaaagtaggtactacctgggccacacacacattcaccataaaaattaaattgaataggtatcaagaaacaat

SEQ ID NO: 21570 - DNA, 1059 bp, Homo sapiens
catctttttgcaaattaaaaaaatacatttatagagattaagtaactcactgtaaggcacagcagaggcggaatgtgagttcagggcttctagcaccccgtactcttagaaacttaagtgagtttatgaaataaaccatattatgtctccccagccttcccatcaggttcccgtttcctcttgacttttgcagagtctaatctaggtataggctcaccagttctactattaggtgcctaggaggttctcccccacttccatctaactcccacacctgctgtatttaccttgcagtggaacagaaccaagtctttgagattcaaggaaatacagctaggtggttcatctgctttgggaaagtggcctctttattcctgaaaacagtagaaagaatgtaaagcttaagaatcacacagatataagatcaaatttatgtactttcacttattaatcctgagcccagggcaagtcacttaatctctctgacatcccatttcttaatccataaaatagaaataatgatttctaaatcacatgatttaaaaggatgaagtagaataacatatagaaggttcctttgcacacagtaggtgctcagtaaacatgggttccttcccttttgctctgctcccatgtcacatatacaattaactttgcacctggcaactcctgtttagcttctatatttctgctttcctttattcctttattcctctgtgtttaaaagtctgtgctaagtagccaaagttttgtatgagaaaggtctgctgggcaaagcagaaagctacacacataacacaactttagggccctaaataaatattaggaacaaaaatgcctctcaaaactttatagcctctcctgcttccctcctctcctgccactgctaccaccaatatatccaaatgcctaaaatcccgttttaagatctctcctaaggaacttatgaagaacatgcattagtctcaataggcacctgttacctcattttgtttacacatggctacatgttgtcatactctatatgctataaccattaattgacatgagactgggtaa

SEQ ID NO: 21571 - DNA, 1074 bp, Homo sapiens
tcaagcttttgaacttcatcttctatctttgcattttctgatacactcttgctttggaatattttaatataatgcataagcttcttttagtgaatttactgtatatttgattattttttcaagagtttgtaaggaagattttacttgatgttatacgtgattcttcaaaactcttcatctaagttgtctcttatttctgactctcttactatatccaacacctagtgaccactgtccatttcatctctaaggacagcaaacaaatctgtcatcttcaacaaacattcagtcaaatgctagatctgatgttccttctcatgtagaattttttccaaacatggtcttgaaatttcaacctcctttttttctatgtaaattaagaccactcagtcttcctttacctttgtataaaagtaattttccatttccctaaagtttggatttttcatcgaaatttttctttaatactatctatagctgtgttttacttttctgacataaatttcaagattattctggtttagctacttgggattggatggattctgatttatccttcaaatgactgtattatagcctttgtgtaacatcaaccatcatgccatcttcttctggatagttagatttttcttccccattttcccctagaaagtctattttaaccacaataaagagtaggactaatcagttcttaaatatctgtctccagacagcatttcaaacaactttatttcaagtctggccttcaaccaagacatttccagtgcttaatgacctctcttaaaatgccagagcctgtcagaaattttaagtttttcttcatctggagcagaaaacatgccatgatgttctttctccctacatttataaagcaagctttagttctgtgaaacccaatgagagctgtccatagaaccatcttttggggaaaatcctagagtcctgatcctgggctcaaacctgcaggcataatgctcacagagctgcatggagccttcaggataagccagtggtaaagctgtgtgactattgcatgtcctgtgtcacacaagtgactgccacagaactgcctct

SEQ ID NO: 21572 - DNA, 1062 bp, Homo sapiens
cgtatttctcctaatgctatccctcccctagcccccaattccctgacaggccccagtgtgtgatgttcccctccctgtgcccatatattctcattgttcaactcccacttatgaatgagaacgtgtggtgttcggttttctgttcctgtgttagtttgctgggaatgatggtttccagcttcatccatgtccctgcaaaggacatgaacacattcttttttatggctgtgcagtattatttgtccctagctggcccctttccttggcaatttctttaacctctaatccatcccacaagcatccttcactctcagaagttgattttgactctttctggtttctcttggcctatatccagtactaagacatttaaaaaatcttcttaaatcccgtgctttccattctctctgcagttgctctacttcaggtcttcatcatttaacttggctattatatggtcttccagttgttctcctgtctctaagctccatccacaccctcaccctgccactacatacacacttgctgaaaccaacatacccatcttctaaaaactatagacttcaattaattgctcccctacttaaaaatctttagtgattcatgactcccttcaaaataaagcttagtgtccttagtatgtcttaaaaggtccatcacaaagcctcgatctgtttctcaaacattgactccactgcttcactggttatcaccaacacttcaatcacatacaatggctgcctccacaatatgccgtatactattttagctctgtgctagtctacctttccccaccgccccccgcccccccagaatgcctattgcttctctcctttgtgggaaaaccccacttttcctttagggttgacctcataagtcaccttcactgtactttctgtactttctttttaagtgtatagctcacccactgttctgggagtccctaatgctgtggcttgtgtcttactcgcttttttattctcagtcactgacacacaggaaccactcaaaaaaatgtttaagaaatgaacagatgactattcagaagaagtttgtttctga

SEQ ID NO: 21573 - DNA, 1053 bp, Homo sapiens
ggttcaagcaattctcctgccgcagcctcccaagtagctgggattacaggcacccgccaccacgcctagctaattttttgtatttttagtagagacaggctttcatcatgttggccaggctgattcgaactcctgacctcaagcgatctgcttgcctcagccttccaaagtgctgggattacaggtgtgagccaccgtgtccagccaacaaatttctttatgtatctttcattgatattttaaatgtatttgtcttaatctccacacatatttaaaaagtcattttgcctttctcaacaactagtattttcttctcagaaagctaagttagaggatagtcttgagattcttaaaaaatctcttgtttaggagatacttatgtaacagaagagcttaaagagagctgaataaattctgaaaaaaagttaagtcaaatgtgtattttttattacatatttaattaaatcttaatataaaatagaaacacatttatttgcataaataaaactggacttggcatttttgcaaaataaaaatgatgtaaagatgactcagacactctgaatcatgaaagttttgtaaacctctaagtattttaaaaagagcaatagagttactttaattatttttctttttaagtctcagtttattttttgtactcattcctatatagtgtgatagttcacacatttatagatgctgaaacaatgaattcactgaattaatcacagttcaggaatacagatgccttaattagttttttacaagatataattttgaatgaaatttatcttccaatgcatatgaacttccaggtcttagattgttcatttctacatatttgaagaatcatgtttactaaccaaaagatatttaacacctcagataaatgtagcaattcttcccagatgcatccaatgtttgaagttattttgtaggtaagagacatttattttacatatgataaaactaagatgtagacatatgaagtgttccagatatactatgggtggtttcctcaggtaacaaacaactctcaatttcagtgacata

SEQ ID NO: 21574 - DNA, 1039 bp, Homo sapiens
ttaagggcaggtgtgctaaatttttaaagtgctatgtacagttaaacacaacacacacacacactcacattaagctttgttttgtctggccatgaaatgaatgaataaatatattttacatcatcatatgtcatcacccttccatgtcagaaaagagaagagcctaaaattggtggtttaatattagtctgatatatgccattgccatttttcagcagaatagaggggaatggagaaagtgagtggtggtcatattgaggatattgtgtggctttccacctcctcctaagtctagttttcaaagtgtggctttattatgtactttgaagaaaggtgatcttcagaacaccagcatatacctatgtttacaattccaataaaataatgcagctgacagagcattggccactgtctaaatctaatctgaaaggcagagatgcttccttaatacttttgattaacttcaaaatgatggcaaataatgctttcataaacttacaggtgtataaatttggtttatagagattggatttagaactaaaatggtaattctatttatttacaagatgtgtgttgaatgcagttcccagaagctaaacttggtgcccatcaaaaataccagtaaatcaatttgcctagtgtaacagttactctagaagaaaaaaatgaaaatgaaaaacttattttctgaatcctttattttccacttgtgcccatctgtgcctgttaccttcagggccattccttgccctgccctgcctctctttattccacagggactgaccctatgggctgtattttccagccagagcctctcctcccctcctacatgttacctccagcttcttccagtgacctgaaccctgaacctcattaacactacctcttcccttttgtcccttgagaatcatgagtgatagtgcctttggcttcctgaggctgctgatcttcaatttgatccaccattcccaatttagcttctcaattctttcatctttgtaaccatttccttgtattaaagttcatcattttaaatact

SEQ ID NO: 21575 - DNA, 1028 bp, Homo sapiens
gattctcacacactggattaaaaggttgtttattttggagtagaagggaatactctgcaattacaactcccaacatgggaaactaatgaaaaaaaacaaacaaacaaaaacgtgacgcagttctttttaacttaagaaaataatctagcttctaacatataaatgagtagacttaaaataactggacaaagccagaaggcaacaaggcagacaacttatacttaggcaaaactaatcaaaggaaattatcatgagccccaaaactactctgcttctcatatccatgcaacacccaaacaatatacaattttatcttgcctatgaaattcccaagtatattcctacgtatgtgtttgtctttgtaccacacactgtctgtattctttaaaaaccttcccttacctgacattgcccttgagtttagttatcttccttgcctatcggagacataaaaaatactcttcccctggctaatgctctgtgagaaccagtgattaaagtctgggcaggagaaaagaagtcggggcatatgattgtcagtattagggttttccggtttggctaaagtgaagctccttacttcagctagtattgcagctatttgagctcccctttccttatactccttcctaaaatgtttaaaaaaagtccaaattgcaacatttattacctttctcatttaaaattgtattaaaataatcctttgggtttaaatattatcttctgttagtaatgctaagatctgagattcttttgattaggttaaggttaggcaggaaaggaatattaaaataaagaagaatgtcacttgctagctattaaatatattataagctataatcacaattaagttgaactataatttaaaagggtgttaatatagacaaaccctggagtataaacaaatacttgcataggtatcaatatatgctagacaaggctgtgcatagcaacaggaaagattattattattatgcagtaaaatactactgggaaggaaaatattttcattcatactacaaaatgaa

SEQ ID NO: 21576 - DNA, 1029 bp, Homo sapiens
atgttaaaccaagggagatcaggcatttccagctcactcacagtgggcctcttttaatccatatttcagctaaccaagcaaataaactattagaatattttttaactccctgagctgcaacattaaaggcagagtttctacttagtgggaccaaattaataaattcagcctgatccaactctatgttccttctatcattatcccacacctttaaaatccattcccatgcctgttctccagatttttgtttatataaattgaagaactcaagcagttcttttcaagtgtagagcacctcctcatgggtcacactctcaacctcacctctaggggctgctgggattttagtctagttataggtctagaagcaaacagaggtattgagggtggctcctcaggagaatcaacattatcttgcttgacaactgcctcaggagagtcactgttgcctcaggcagtgcagggtttatctcttcagacaaaggtcgaaaggctgatggcagtatgggtcagggaggggatgttgactctactggggatgggaaagctctttcttctggcaaaaaaaaggttcatcagagtttacaaactcagtgtcctcagtttcatcagaatcttcccacacatccccattccaagttgcagggtcccattcttttccaatcaatgccctcactttaacagtagtcacctggcgaggctgtgcatgcatctttcattgcaggtcagccacttgcatgataagagcttgtctgtttttccacaatttcagctctttctctacaggagataagactctcattcagggcaatcttagcagatttgaggctcagtgtctgcttctgaagctgggagacagaatcccccagttcatcattttctttcaacactttgtccactgaagttagaagtaaccaaccagcttcattatgttcctttattctccatatatggtcaaaggtattatgtatagagtcaccaaactccttgcctctcaggagcagtgaatcagaagtgtcaaatgcattt

SEQ ID NO: 21577 - DNA, 1035 bp, Homo sapiens
atagttccgtcacaagaaaatccaacctatttatgagtttttctatattttaatatatttcaattcaacctttagtctttacttaaagaagtcttcagaatatacatcttaaatcaaaatgttcttcctaggaattattattgggaaccaatattcagtgtaaatatactagtacttcatcaccggtcagattctgaattcaagcaacagttcttcactaaggaagagtatactgagaacttgccaattccaatgcaactcctcactgttgtttatgtcatgctgaggacagatagatacattaacacggatcatgaactacaacttagtttagaagaaaggagctaaaactttctattttcttattgttagcatattaccagttttcaaacttctaccccatatcctaaaagatttgatgtttgaaaactaatcagatttagttgttttacataaatgctaaatctacataaggagcctctttcttaggggttgtagacctaacattatattccagggcactatctgtacaaagaaggatcagactccttgagaggacagaaggccctgtggtttgtggggcaaagagctgctgttgctgctgtcttaactgttctaagaattacatctcctaacaaaagccagagggatttcttgagcaatgctcttattacttagcttttaaaaaatgaggacaatagtcacttcattatattaccaattatggactctaggtataaaagaaagtgacaaaatttgaaatggtttcttatggaaaggaaaaacatggttaaggttttattattatgttggtgcaaaagcaattgcggtttttgccattactttcaaatggcaaaaaccgcaattgcttttgcaccaacctaatgtatgtggtaggctactttttataaaattttgactgtataacatcaggataaatttcccaacaatctaaacgaagaagaggcagcgtgattctctggaaataacctgaattttaaattctgaagactcagattgaagttccattttcac

SEQ ID NO: 21578 - DNA, 1049 bp, Homo sapiens
tgttcccagatcagcctgagaagccactcaacttggctcacatcgtgtgagtatccctaccctcccagtatagagacaattttcttcaagggcacatgtctggagccacacaaaagcaatttcctatcagtggtcagcaaccaagatttttaatttagtttaaaaaaaaaagtcagagtaatgccatcataattttttgttgttgttgaggtgtacagtacttccaccaggctggacaagtaaagtatgcaacactaacataattcacctggaggtggaaaatatttcagaaagcttagttataaaatacggatgttagtggtgtctgcacattggaagttaacaatgggatcactgtggtaaaaaatgatttacagtatattattccttaatttcatatgtgctttgagttccaaatataaaagctgtttgttttatttctctgcagacccagtttaagatgccagcaaacctagaaattacttttgtttttcatcccaagctgtataactttagaagaatcatagcctgtgcaggggaaggttgaagagggggagtggcgggaaaatttatcagaatatccatagattcttttcttcaaagtatgtgtgagtttcgtggcagaaggtgttgggccaacaaacagtccttccagccatccctgctacctcccagaagtttcatgcctttgaacctctctcaggcctgggtggccaagataacaagggggcttaggtagaagaaacaattttttccttggtgttacctggggctcataagaagaaagagtctcattacctgcttctatgcacaattagatgtcatgtagtcacagatgcctccttatgaactgcctgtagttttccacacttcagtgggacctatcacaccatagggcctgtgtttgcatgttgacatcaagaggtgggtgacgggacctaccggtataggaattcaacaatgcaaagttcatgcttcaggcagttcagcatatgatccataaggggcactgtggtgggtatgagaccttcgtggaagcagcaactatg

SEQ ID NO: 21579 - DNA, 1033 bp, Homo sapiens
gctccttgccctcaccacttgatgttattagccgctttgtttctgaacctctttcctcctcacttgagtattttcaaaattttcttcctattactgcttcttagatctatttttgcaagattaatacatgagataatttttagttctcatgaactgatgaacatttatgtgctttagtacatacatgtatcttaatttgtatttttaaaaatgtataaccagtacactagtttaattttaccttagatcctactgtttaaggggataaaaatgcactctttggctgacgtaaatccatctctttcttcaaattttgtgagcttctagattaaatagtatccactttttcacaactcaggctctcaaaactacaaaattgctttattcccaaggagtttggtactccagtgttacatggtagctgaagcagtagaactaagcattgaatttttttttaattgtattggtcatctttgaagaagaatacagtcagtgtagattcaattgtaagactatgatgcgatctcacatcatgtcctcttcccataattctaagcacactccagttatttctactgctcttctttgaccttttcttaattaaggttgttaacaaagaaatctccaaagagaaaagctcagagtttgtcactaccagccattttccctactcaagtgattaatcatattgacttgatggttacttaagaccataaatctgtctcagcagagacaccttgcgtctgcctgatgaaagctaaatgtgatttgtattttgaaaacaaagcagaatttaaggccaaccaatcaatgaaggaggctttgttttaatagctgcaccctccatatttctcatagttttttctatccttaaaaaattccaacttctttttcaaatttctcattttttcttcccttttctttatgtttaattagatcccaacaattcctcatacctgtcatggttctataagtaatgtaatgacctcttacctcctttaacatcattgtagctacaatgctttaccatcat

SEQ ID NO: 21580 - DNA, 1041 bp, Homo sapiens
atataatagtatgttactttatatggatccaagtgattgcaatgaataattcttacaaccttaatattggcataagagggtgtctttacaatatgtatttatgagttaatttctttaaggaagagccgtaagtataagaactgatgcagaagaatataagtatgtttatgaatgagaggaactagtttctgatcttgattctgaactgatacataccacaataaccaataagccaaactacaaccaactagtttgttaacaagattagtgctattggtatgtttcatagaattatttttaatggcacccaaaacttagtcttgaatggagcacttcacagaatgaagttttctgaaatatggaagaattagtaacgcttctatttgcattagtttttagggactcagatcatccttattctagtatgaacagtttctgtaaatttataggaggcactaaaaaattccattaaggtcattgggagtcactactaaaattctgtttctctgaaagtaaatataaaaggcaggttataaataagtagtaatattatagatgagacttgtattagttaccttatgctgcataacaaattatcccaaaagttagtagcttaaaataacaaacatttatcatctcagaatttctgtaggttgagaatccaggtttggcttagctaagtccctctggttcaaggcttctgtgaggttgcaatcaagatgtcacttaaggctgtgatctcatctgaaggctctaccagtggggatccattcacatggtaattggcttgcttgggtttctcatcacctaggtctttccataaaggctgctttatgacctgacagctattttcccaccaaacagaccaagagagctaaagagaaaacaagcaagtccaagatggaagccatggtctttttataatctcatcttggaagtgacattccattccttctgccatatgctattcattagaagcagattagtaagtctagcccatcctaaaggggaggaaattacatgagaatgtaataccagcag

SEQ ID NO: 21581 - DNA, 1137 bp, Homo sapiens
gtggcaaaaataaaatcacttcccaaagattttcagtcagaaagctgaaaaatcatttttcctaccttttgtgtatttgcctgccagagaattctgttctgccttccacctcacagatgtgctccagatccacagaaaagttggtccataggagaaaaatggcaattgaattttatgtatttgctttctttgttttgatagaaataattccctcctccttgtctgcatatctcatgactcctgccttcccaaatacataggttcacattctcaatatgaaatcttataaactacatattttacagcagccacctcagcagagaagtgctcctgacatctctttcaccatcgatgcgaataagcagcaaaggcagctgattgctgagctagaaaacaagaacaggtgagactttgtagacgtgctggcttgtttgatcaatgtgcgcattccttaataaactatggtcgtgctttaaagtttcagggctttacaccctgtatggctactcaagggaagacatctacactcagtgatgctcacttccaaaaagctggtctttagatctttagaacttcagaagctccatgagaaaacggcgtgtgcatgtatgtgtatagttctgagatatcaatgcaattaatgttgcccctctagacggtctcacttccctttttctgagatacttaattttgttcaagagcttctagtacaggaggaccctcctgggtactaggtagaaggtgtctctaccacccagaaacaggtaggaggctcaccagagaggccccctggaaggaccctgagctaaagaggcatctggagagacaccaccatcacccagttactctccaaacatccaaagatctccacctgcagcccatcagcaggttcttcctctattcaacacagattgactcacagtctacctccacagcatacaccccaaaaattgtccagctcatctccaccaccacccagttcagcctgtccttttcaaaaacatcaatcttatgttattccaggtttaaaccctctaatgtgttcccatcacacttcagttaaatcctactcctcttaccatcacctgcaaggtcttacctgacctgattccctcctgccattccagcctcagctca

SEQ ID NO: 21582 - DNA, 1116 bp, Homo sapiens
ctttttaaaagcactttccttctaaggtggacttccctgagatccattgttaaggctgagagatttaagaaaaaaaaaagagaaagaattttgtctaactggggttttctcagataaattcaatgagaagtcccttcttggtgagagaatgaggttacttagttttgtgaaatgagccccatttatccttattttcccttcaggctcctcttacttggtagctgcaggtactttacggtgtcagagtgtgatcgtaaataacaggaagatgcatttttgtctcttaagcagcatgctcttcaaagttggacacattaccttacttgctagtagtaatgcattacattacttgctagagagatgactggaccctggtgatttaactcaacgacatgctgcagaagcttctaggtttggatgtactggaaatgaagtcaatcttcccgtcacccacagcacccatctagctatagtcaaagcctcttaaatacactggaatctgttggttagggaaggtcggttctgctcctaaacataggatgatcccttctctctttgttctggtggccttgatctgctccgatgttagtttcctgaaagctaactaaccttggtttctcaccttcctcctctctcccaagagaaatcttacaggagatccagagacttcggctagagcatgaacaagcttctcagcccacgccagagaaggcacagcaaaaccccaccctgctggcagaactccggctcctcaggtaggagagagcacccatgtcatctcagggaatatatatgtgtcagatctttgagaaagtctagcagtgtctagccagaaaacagtcctcagctaccttagctgctgacatttgtttttttcatagcacacacgtaattgctgatatttgggggatttagagagaagctgtttatattttgttctttcatttggtacagggaaaagcagtgtgtttctgtttttgtttttgagacagagtttcactcttgttgcccaggctggagtgcaatggcacgatctcggttcactgcaacctctgccttccaggtacaagcaattctcctgtctcagcctcccaagagctaagattacaggcatgc

SEQ ID NO: 21583 - DNA, 1118 bp, Homo sapiens
tagatattcatctgtgtaccttgtaagtcttaggtcagaattggatctgattgtataagaaaaaaaatcttatgtaaagtgagatgtggacgaaggaatcaacttgtgcactgtggactaactggagaagcaaaagataaaattattaaaataatagcccaagaggaaagtataaaataggaaggaaaataagtagggccccttgtttgagattatccttaccatctgggttgtaaaacatttgattctaattccagaaacttgataccagaaataacttattaccagggacatatgctgaagaattgtcaggaatgacaaagtgtttacttgtttttaatatctgtatcacaaaatgataaagctgataaaccatacagtgatgtgaaggagtgagtcatagcttaatactttatgacacatatatttatgctgtatcttttacaccccaattcttcccttttcaccctataaaaggtcagagaccactgctgataagcaaagaatccttcaaaatctctcctggctgggcgtggtggctcatgcctgtaatcctagcactttggggcgggtggactgcctgagctcaggagttcaagaccagcctgagcaactcggtgaaaccctgtctctactaaaatacaaaaattagctgggtgtggcggcgtgcgcctgttatcccacctactcaggaggctgaggcaggagaattactagaacccaggaggcggaggttgcagtgagctgagattgcgccactgcactccagcctgggtgacagagcgagactctgcctctaaaaaataataataaaaaaaaaatctctcctctctggaggacagtactgaacatatgcagggtcttttcagtttataatctaatccgtagactgcacagtgctagcaattctgttcacagttatcttttcacaacagtcatcttggaagtacttgattcttaccttgatttataatatttattgagctcacattacagatcattactgtccagtcacattgataaaaccatgtcacttggaagctccagttcaccactcctagctgtgtgaccttaagcagtttacttaatcttactagtttactcatctttaaaatggg

SEQ ID NO: 21584 - DNA, 1086 bp, Homo sapiens
gtaatcccagcactttgggaggccaaggcatggatcaccagatgtcaggcattcaagaccagcctggccaacgtgatgaaactctgtctttgctaaaaatacaaaaaattagctgggcatggtggcaggtgcctgtaatcccagctcctcgagaggctgaggcaggagaattgcttgaacccaggaggtggaggttgcagtgagctaatatcgcaccattgcactccagcctgggcaacaagaatgaaactctgtctcaaaaaaaaaaaaatccgtaggcagctctccatcatacctcacaccaggagaggaggaaagtacccatagtttcttaaaattttatgtttaaaaaaattaatcagtggtatgttatagggaagtaagaaatgttttagtaatagctaccttgtttaagatcgcagctcctctccaccaggcactcatggtcctccctacctgactactcaatttttctttctttccattgcaataccttctgtgctataatctagtttacttatgtttattatttcctgtctcctactctgctcctacagaagtgctttgaatgcattgatctttgtttagtttactgatacgtactgagtgcctagaatatatttgttaattcaatgaattgcttttcctttggcttctagaagtggatgtacatttcttttggggaaaaatactcagcagactattcaaaactttaagaggcttctgtttctggcagcgtggcagagtagaggttaaaaaaaaggtcccacattatgaaatgttaaaaatactggacttaatattcaaaatatcttttaaatgcatcgttgagctgacaagaggtaaggaaactttccagaggcccagaacaagaaatcttgaatccagggaggtaagttagtagtgatactggctcccgtgctgagggttctggtatttgtaagtccttcaaaacccagaactttggcttttgcagggtggccatagggtaccagacggtgtctagggatcaagcagttgctaagtaagatccagagacctttgtgtaaagctgaagctccctgaaagctgtcagtgggtttaact

SEQ ID NO: 21585 - DNA, 1034 bp, Homo sapiens
acttttggtttgatcagaacccaaattagagaaatgtttctcttgaggaagcactggctttgtaacctaaccatacagccggagcccatcatgtgcccctgattttgcgaaattccaactgtggaacccaatagatgtcaatacttttttaaaaactatcaatgtcatatatggtctttgctgttattttcagatttggtagtatggaggtactttggaagctttttaccagtaactacaatatgttccatttaagtttaaacaaaagccaaacccctatttaattgaaaagaaaaatactatgggaaaactaaggtgaacatttcctgattactcagctacatgttacatggtcatctctgctgttttcagatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggttagcgttgttttgcattagaaatacaaggctgtacctttgttgaccctgatcctggaggagaagtaagaaggttagaagtgaagctttgagcagaggtgaacacctgcctcataaggtcattgtaaggaatgaatgaaatcacacacagtatagaaagtgcttggcagaatgcctagaataatatataattaacagtaataaattatccaggtcagtgttgctagcccaggttttgcagatgttctattttttttaaaacctaactgcaacatttagtatttattcctgtgaagtttcatcttgttaaattttcagccatttttctagcttatatgactttttcttgattcttggagttttcattcaacataacaaaaccactgtttttgcagtgggtcatgaacgttctctataagcaggccctcaatgctgtcataggaggctttcgtcaagtatcacaaggccactgagagcccaa

SEQ ID NO: 21586 - DNA, 1039 bp, Homo sapiens
gttgtttaggaaactgaagcacaaaaaagagaagcttctcatagtgttacagagcttatgccagaattaggacttagaatttaggtcatcttgcagcaagtcaagtgtaccctactggaccccagtgcctttctccctccctcatacctctttatcgacctacatatctacctacttctctctctctctctctctctctctgtttctccatccatccacctacctaccttttctccgttgtcttttaaataatgtatattaccaaaaaaaacaccttttctgcagaggaacttaatcaccaaaactgatgcttgaggtgttttgttttcttccactctcatgttaagattttttctatttcagaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaa

SEQ ID NO: 21587 - DNA, 1032 bp, Homo sapiens
ttgtgtcccataaatatatacaattattatttgtctttttttttttttttttgagacggagtctcactctgtcacctgggctggagtgcagtggtgcaatcttgtctcactgcagcctccacctcctgggttcaagcaattctcctgcctcagcctcctgagtagctgggattacaggtgcccgccactacgcccagctaattttttgtatttttagtagagatggggtttcaccgtgttggccaggctggtctcgaactcctgacctagtgattcgcccgtctcggccgtccaaagtgctgggattataggtgtgagccaccacgcctggcctacaattattatttatcaattaaaaatactcaaaggccaagattaacaacttgttcttatagttgcatgaaatgaaattgtgctaactggtgccagcaccaaaaggccaggtattcactttgtgtccacaacatttggcacaacacaatggtcatggtagctgctttacctttctgactaacttctctctagaacatctgtttctcttgaactcgtcttgctcctgatcacctggtcatagcgagctctttgcagttctcaatgcataccatgtacttggcagcttcgggcctctgcatgtgctttttcctttaggtctcactttggagactgccctccaccccaaccccactgcattatgaggggccactttttttcacagttctggtgaccctgtagtttcttgtttctgatcattaccaactgcctgtgagctctttgcagacctgagtggtctcacttgtacccccaacacctagtttgttgcccagcacatagcacaaactgcagattccaagacttactacatttaataagttctacttcttccacactaagaactaaggtcctttctgagcacatgattggaaagtagataaaaagtagtaaagatagaaactctcaggtgggaagttgtccacattacttcatttgcaagtgagggacactgtggattcttgacttttctgtttcgcagaa

SEQ ID NO: 21588 - DNA, 1033 bp, Homo sapiens
tgtatctgatgataagggacctacatccagaattatgaagaactcttaaaattcaataataaaaagacagaagatgatggtcagaatctgaacacagttctccaacatggctactgaatacacgaaaagatatttcatacctactaggctgactcacagacacagtacaagtggtgaagatgtaaagaaattggaaccatcacacattgctcctaggattgtaaaatggtggagtcactttggaagtttggcagttcctcaaaaatttaaacagagttactatatgacccaacaattccattcaggcatatacccgagataactgaaaacagatgtccacacaaaaacctatatatgaatgttcatggcagtagtgtttataatatgcataagacagaaatttcaacatagctaaaagagtgttttttgaatgtccagccactgttgaataaaaaaaatgtggtttttccatacagtggaatagtaatgttgtcataaaaaattactgatatatgctagaacatgaatgacccttgaaaacactgtattaattgcaagaagccagacaccaaagaccacatattgtgtgactccatttatatggaatgttcagaataggaaaataaatagaaatagacaagtggttgccagagggatagggagaatggggagcaacttctaatgagtatggggtttctttttagggtgatgaaaatattctggaattagatagtaaccatggttgtacaactctgagtatactaaaaacacaattctacacattggaaaggtaaattttatgtgaattatctatccttaaaaaaataaacattaccttaaatttaatgtagacatttaagttttaaatcctgtaaagagaagcagcagagatgcaacataggctcagactttaagcagctctaatttcatggctttcctgggcctccaccatattgccatagggcctgtcacatgcttatgcatcctactggctgcagcagtgcatcctgaagacagctcagtatagccatgg

SEQ ID NO: 21589 - DNA, 1050 bp, Homo sapiens
atacaatgggaacaaatatgtgttacttccaagaaagcagccttttttgttttaatttttaagttttctttgtatgttatgtttttctattgtcccaattagaaaggaggatgcttatctcttctgttgttagttggatggtagatgattaaataaattggtatttatcagatgacattagctgtcttgttcacatgcagaccttcttgaaaagttctttgtagaacttagtagactatatactacatgttgtaaacatgtattagcattgtatgcatatttgtcaatgttattaaaaatgaatatagatcaaatgaattggagggtaaggaaacaaagtattgttttttttctggaaaatctggaaatatatatattatagacaaaaaagtcttatacataaacttcacaatataatgttttaaaattaatacaacttattttttaattaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgagtaataatgaaaatatccaatataacgatacttaggtctcctagttggttgatttttttttcaccacccacctatgtgaaggatagtttttcacaattgtcagattcctacctgaaatttcttttttctttctttttttttttgagacagagttttgcttcttcacctcggctggagtgcagtggcgtgagcttggctcactgcaacctccgtctcccaggttcaagtgattctcctgcctcaggttcaagtgattctcctgcctcagccttccaagtagctgggattacaggcacgcaccaccacgcctggctaacttttttgtatttttagtagaaatggggtttcaccatgttagccaggctggtctcgaactcctgacctcaggtgatctgcccgcctcggcctcccaaagtgctgggattacaggtgtgagccaccgtgcctggcctt

SEQ ID NO: 21590 - DNA, 1027 bp, Homo sapiens
ctgaagcctaatatacccaattttgtaggtgaagactgtaacaagggctatgggagttttgagccaggaagttttgtcagagaaaaccagtgtacttaacacctcaggccatggatccctcaggccagggatcctttacatcaaaaaatataggctgggtgtgatggctcatgctggtaatcccagcactttgggaggccaaggcgggaggattatttgagcccaggagcttgaggccagcctgggcaacatagggagaccctgtctgtaccaataattttaaaaattagccatgggcttgcagccctgggtatcgttgcaggcgcctgtggtcgcagctacttgggaagctgacgcaggaggattgtgtgagcctgggaagttgaggctgcagtgagccatggttacaccactgcattccagcctgggtgatagaccaagaccctgtctcaaaaaaaaaatgtgtatgcacacacagtcaataattagtccagtccatcatactgtatgaatgtctcccaggctgaggccactcaggtttgcagatttccttcaatcttgtcaggtttcagaaggagtagcctcagtcaatattatatacaacttcactttttcaggcatctgggataattaagctaagagacaatgtcatctcttgctcttgagactcttatgagttgttaatgtgatattgaattttcctcaatgacccatttattcatttctttactctcagctgctatttctccttctctccattaatacccaaagcttttcatctttgaaaggcacattagaattgccattgtgttgatctagattgctggcagtaatacaagtcaagcaagtagctcctcagtctactacgttcagacaggataaggttaggtaggtgcagaactagtgagctatttttaccaccaggcaatgtagctgttttcaccattagccctaattttgctagatggggtgaaggtacaaccgtacaacccattcccgtcatgccttaggaattttgatacaagac

SEQ ID NO: 21591 - DNA, 1029 bp, Homo sapiens
tgtgcattctcagaggccactgatctgttttctttccctgtagttttgctttttccggaatgctatatgaatagaatcatttcgtgtgtagccttttgagactggcttcttcactctgcacagtgcccttcagatccaagttgttgggtgcttcaggagttcctgccttttgattgcagagcagtttcccctggtatggatatcccacagtttgttcatccattcactcactgaaagacacctgggttgtttctggtttttggtgattatgaataaagctgctctaaacatttgcatagagattttgtgtgaacctaagttttcatttttctgtgataaatacctagattctttattcagcagataattacctggctctctccttagcagggcagtcaggaggtttcttatttggcaagttatcctttgtccgaataatttgtcttttttttttttttgagacagagttgcactctgttgcccaggctggagtgcggtggcatgatcatggtcactgcagcctcgacctcctaggctcaagtgatcctccagcctcagtctcctgagtagctggggctacaggcatgagccactgcacctggcctgtcagaagaatttgtcattcgagtttctgaacttcagaatgtaagcactttttaaaacactgcccacaaaaaagatcattcatttagatatcttgtttgttcttaattcttatgcctcccaaagccctgttatggatgaattgtgaggcaaagtactggcgtcccctgcctcatggcctcatcatcctgggctctgacgtcaccctggctcaaaaccctcatttcacaactttacacagggacaacgcctatgacagagctgtgtgagaatcacttctcaatccccatgggatacaaatcaccagccattttatcaattagcaaaatggtgtaaacaagcaaagcagcaagtggcactagagaaattagagtgtgaaaggtgcactttgatcattgcacacagaggtgatgtgagcagtaatgg

SEQ ID NO: 21592 - DNA, 1068 bp, Homo sapiens
ccctggggctgctgtaaaggacagcccagggtttctggatgtttccaaccttcaagagaagctggaaacctggctttttatgtaccgtgcctttacttttaactattggcagctaaccaaaagtattctaaaacgccatgtgggtcacaccgagtgtggcagtgttctgccagttgcagaaccatgatgtcctgcaggccccatcatttcacagctgtgatagataacaggctggcccaatattctgctgccagcttggctctgaggctggatttctttatcccttaagggctgttttctgggggatgctatggaatgactcgtgagttctgggttttcctggccagcaggcagctcaccctctagtattcttaaaagcttttcctagaagtccgcagtcacagccagctggacttccctgaggtgtggcttctgctcctgggccttcgtatcacagatgccaggtggagctagattcttggcccatttgtgtgttttccctggatctcagtgggcctacccttagaccccaggatatactcacttagcctgaagggtgccgtgtggataaatgtgacaaagtaggaaggagagccgggcactggctacagaggggaagttctgaacagattgggattcctgagtttctgctcttggttttcagcccagcctgagacttctgctctccccctgcccaggggagatgaagtggtggtgtctctgtcaccttttctcagggtggggccccaggttcctgcatcagatcacctgtgggtggtaggaaatgtgccatgtcccgggccccacctgctcagactcacagaattaggatattggggtatgttccaggaatctgcactttgaatgctcccaggaggttgatggagggatggcaagggcactgggcagtagggtcttgtgattccaagtcatgttctatgggccccaccatccaggaatgcaagcagatgagggcaggcagcagccaactggctgcttcgggctcatagcccagaacccaacaggaagtgttgagtggtggcctgccctaggaccgactccatgggt

SEQ ID NO: 21593 - DNA, 1031 bp, Homo sapiens
ttttgatttgcatttcccatgtggctaatgacattgagcatcttctcatgtgcctattgggcatttgtatatcacctttggagaaatgttcttcaaatccttggccacttaaaaaatagggttatttggcttttttttaattgttaaattttgtaggagttctttatatattctggatacaagtcccttatcagatatacgctttgcaaatattttctcccattctgtgggttgcctttttgtgttcttgatgatgttcttttaaacagaaagtttttaattttgatgcaatctaatttacccagttttttcttctttttgcttgtaattttagttttatatctaagaaataattgcctaatccaaggccatgaagatttacttcaatttttctctaagacttttatcattttagctcttacatttaggtctctgatccattttgtatttagtgtgaggtaggggtccaatttaattttttttgcatatggatacccagttgttgtagcaccatttgttgaaaagaccatcctcatatatttttgatgttaataaatacattttaaatttcacttttaaaacttttaagtgcttttgtaaatttctttgggatccgttgtgaagaaaattatcaaaataatgtaattcctcaaagggtatcatttgttactatgtgatcctgaatgaggaatcaattgatttcttatctgtctatatttgaaactaacattcataaaaggatatttaaccattgaattctggctcttaagacaataaaatctggcctctaaacacctttttgttcctattttttagtggctgcatttcatcttattttacttcatttattttttatgttaattgccttatttgctttttatttttgtcagtataatatagagtaaccacatttacaatgtttgcagtacaaaatagagcaactgatcctgtgggtttatctccaccacctggcctgagtggcccaggagaatgctgtagttattaattttcaaaaagggtgaagaaccaag

SEQ ID NO: 21594 - DNA, 1025 bp, Homo sapiens
aacattgatagctgtggttcttggttattctgtagctcgcctctaaggcatgtattatgccttaaaattttcattatttattggattactcttgaccttgactccccaagcagatgataaattcttagagggcaggaatcatatttatactctccccgagtcctctagcatttctaaagtggtaggtatgtctgtgtagtaagcgttaaaggattttttgttgatgaggccattactttgttgttttgttttgacaaattgcaaaatgcccccttcctccatctttggaggaagaatgaaggctcatgctctcttgtgagaaacacagccccactccggcctgtgaagtgtatgggaggtttactgcaaggatgcaggggtgtcgtggaaaagaggagccagaagagcaacgaggcttctgagggtggggctgggggcgggatgtgaaacagaagttcttgagagccaggcatctgtgtctgtctgtctgtctgcctgtcttgtcacatggtctctcatcccttcttttcctagggcaagtgccacacctcttgactttctctgctgactgggccctctaagaatttattgctctttgaacatgacagcagaatgatcattccagggaccatcactgactattttttccaacttcaggatatttcttcagaggaggaatttgattggtccccttaggtcaggtgttcttcctggtccggttagctgtggccagagagatggggtcactgggtgtcaacattttcaagcaggattatggaaacacatcttcagatgacagtgtgggctggctaggcacgccaagcttctggagtgaaacttgaaatatgttttagcagcagtcagtcgggaatgttaattaaggggccactgtcgtcattgcttggagtaaagatagaggtaccctctactgcctcatgaagctttggtctagggagtggcagcttgtgaacggtcttgaggtccaatgagaaattgaggattgttttccccagaagtccctgcca

SEQ ID NO: 21595 - DNA, 1033 bp, Homo sapiens
ataaggaattcttaggattggagaactaatcaggagatcaaggtgaaaaggaaatgaatatgcagaacggcagaaaggagacatggcagaactgagggccagaaggaggagcagctccgcacccatgaagctgtgtgaagacatgaagcacttctttggggagaggcctccactgttccttgcgccacccagaagatagcatgaaactgctggcactagggaggaatcttgttgttttgcagcaagaaaaagtgagaagcaggcctggtgagagcagatctgcgggcaggtctgtgggtggacttctggggcttgttctcaagttggggtggagtgttcgaccagactctgcaagctcactgatgggaatgggtgcctgttacctcatgtgggcaccaaacctctgcgcttctctccagagatcttgtggttctgggtgtgaagctgaagattcagaatgatacgttttcatctcttcttgcagttgaagggtcttcatttgaaagagaacaaagatataggactatgtcagccccttggtgttaatgatctaaattacaggttatttcattgtgcatgatctccatttgccacaagactagggttgggcaaataagccagattttgttttttgagacagaattttggtcttgttgcccagtctgcagtgcagtggcacgatcttggctcaccagaacctccgcctcccgagttcaagcgattctcccgcctcagcctcctgagtagctgggattacaggtgcccaccaccacgcccagctaattttgtatttttagtagagatggggtttctccatgttggtcaggctcgtctggaactcctgacctcaggtgatccgcctgcctcggcctcccaaaagtgctgggattacaggcgtgagccaccgtgcccagccaaacaaatttttaaaattttaaaaatgtttaattcctgcaagtctgacagtgatctctagtaaaatctatacaatctattacatggtagataataagtaatttttaaaagttgaatc

SEQ ID NO: 21596 - DNA, 1056 bp, Homo sapiens
gttcttcaccctgtctgcccctggagctgcaagcccatgctggtatcccaagggctgggcaaagcttccatccctttccctggttcctagcgcttcccctaacagtcacttcctagtttcttatgcgagaagtaaagggtgaagctcaggtctgaagactggaaggtcatcagtagtaaaaagctgggccactgagggaagcattcagcaggaatcctttaatcaggtccagtgttaattgatttgcctgaagccagaagcactttggagaggaagacccatccaacagcagaaaatctgacttggagtatactttaaaataaatgtgttatagttaccatgtaggcacattgagtgctggcttagttgtgctttaatgaacaataattaaattacttaaaatattaaaattaatattttatgtgattgttgtaacagtatttaatactactaaatatttgtatttaataattcaataaatttttttgccagtttatttatattattaacttatgttggaggttagcaaacttttcctgtagagagccaaaaggtgaatattttaggcattttggtccaagaggcaaaactgagattattgagtaggtacttctatgataagagagaaagaaaatttgcagattttttaattgactaaattcaaactacaatagtaataattgagtacaatgtttttataactcagatttaccaatgatatgaatgaaattttggtgggagaaaataacatttcacttaattggggtccaaagttagtgttttctgtcatcaaattgattataaatgtttatctgtaaaaacccattcttagctctctggctgtgcaaaaacaagttatgaatcagatttggcttatgggctgtggtttaccaacccttgattatgttatacaaattatacaaatgatttgtttagaaaattcatccctcctccccatggatggggccaaggtaactgtctggtcttatacaaatacaatttcatctcaatttcacagtctcttagtatttagaactttgcgacactttgatttta

SEQ ID NO: 21597 - DNA, 1050 bp, Homo sapiens
cctcccctttctggtgggactgctcagggacatctcctcctcctctcttaacatcttcccaggtgtttctttgaacagagcaatgggtacttttccagcaatataaaaagctttgaacagagaaattttacagatggtattaacttttcaaaaattagacaaacaacctaacttcagaagttggtatttcttacattaaaatcctgggaaaattaaatattttgccactagtttttacatctctaaaactagggtaatactgactacctggtgttggccatgaagagtcaatgaggcaatgcttgtagattaacttcttgtagattggtagtgtaaacttcagaatttaaaatttatccatgctcaccctccctccctctccttctttatctctccccctctctccctgtctcctcacctttgatttaagtcaacaaaaattcattttgtgccccgtgtgccaggactgggcatacagtggtgaacaagacacacatggctctgcctcatggaactttccattctggccaagatgatagacaaggaacaataaaggatatatgtaataatgacagctggtgataactgctgtgaagaaaagtaaagcaggtgtgaggcttctagagggtggcatgtataaggtgggcagacactatttatacagggtggacgaggaagacctctttgaagacgtaatgtttcacccaaagaatggagccagctggaggtaaatctgcatccaaaatgtaaaaagcaatggattaaggcattcgaagcagtttctgaatcgtcaggaacactgttgataacatgtcagtgttatcagctgagggatgattatcatgaaactttttaagttctagaatttctaaatatctgtgtgtgtgttgtatgcagggaaagtgcattttcctcagcatggattatgctttatctctgtctgtgaaaacactgttgcgagaagctcagctcaatttagcagaacataagtggaaagtagacatttgaacgatactgatggttgatttccattaagtaggaattgaaatg

SEQ ID NO: 21598 - DNA, 1023 bp, Homo sapiens
aagaagaatgagttaaagatgaactgagcagcgggaccggtgacatcagtcctcctccactcagaaggaagctgttaaaataggacgagctgactttgccctttcctcctttctgaataataggcttcatttgcatgtgattattgtttactaattacctaccattcacctacagcccccaccaatactacttcttccatacccctctgcactacattttagcatcttgcttgggcaggacacacaagccatttaaacagctgcacagtgattgtttttccctccttgtgtaaggtttgtgcctccctgaggatatgtctattttggttttcatcattatcatatcctgacctgagagagagtgatgaaatcagcttagatagagcccgtggccttaagtgattgctgttaaaataacttccctgtgcaagttgtataaaaatacagggccatgagaacacattgctagggcccctcccaaggtctgggaaggggcctgtttgaatgagggactctgaaacataagctttgttagccccccggtcccacagcatgaattatgttaactgccactcttgacccttacctttctctgtggcaggtatccattgggaaagacagttgcagcaagctgagagaggcatacttttggaaagtgaattctttctaggatccctgaaatcaaactccacatgcagcagacttttttacatgcttgcttgtccaaattttcaggaaccgtccttgggcacccagagtgagtgaatgagtgtgtaccccttgttgggtagatgaattagcataaaaaacagggttacaccttgcctaagttcgtcctttgacttagaaagctgttcactgctgctcctttctgtctgagggtagttagtctgggccttgcatctaacctgctggagcccattctcaagcaagcttatactaaagccagagcttccccaaaacatagttgcgagaccttggaatgaggactgttgaggatgttgataaacagtttccactggt

SEQ ID NO: 21599 - DNA, 1022 bp, Homo sapiens
ttatgaagagcaccttctcctactagagagtaaaatgtgcagactctgaggattacaacaatgtagtgtggccccttcctcagcagacagatgattggtgcagaggagctctgaaacagacctcagtgtatagaacaactcactgtacagttagttaacattggtggggacgggttaggtactgattggagaggtgttgttaaatggaagtaaacaaaaacatactttaaccatacaccacagtaagccccaaggagcttaaagcatttaatggaacatagcaaactgtaggaagaaaaaaaagagagagagagatgaagactaattagtctgtggttggtaacgtttattttaaaaataaaaccagtgaaacaggttccagaggaagagatttaactattttactgcataaaattttaaaagatcttatttacaaaatgaaaatcacaaattataactaaatgcaaatgacaaactaggaaattgtttacaaaaagaaaggtagaaaatgatgttatcctaaatatattatgaattcagtagaaaaatgaaagacattaaaccaactaagaacaaaagaaatacatatgaaaacaacaagacatgtttcccaggtcacattggcaatgattgccttttaatgaagtatcatttcttgatgaacacccaggaaactcctataaccctggtgggaaatgggcacaacttttctgaaacataatcctaagaattctgcttttattttcaaatctttttgtgagctcattttaccatttgatttgaagcaattttctgttggtttctaaggattaaagtcatctatttcctgtcctttttagtcactgccattgttttggaaaacaccgaattcagcaaaaatggaattttcacactgccacagtgttccccattgtaacattacctattttattgataaggccattcccagctattcttatgatcatagcagtacccacacaatgtggtactttgttgctaatcactggcagagacccagtgcc

SEQ ID NO: 21600 - DNA, 1021 bp, Homo sapiens
tccttatggaagtatatctttttgatgttacacttaatactcattcagttctcctatgaatggtaactttagaattagggaccaaatggaatgttagattataggtttggtttagcctgaaagaacctcaccaaggacttgagaagggtgccacagagggttataggaatcgtgaataattcatatgatctgtgacaccacaggattacttttcctacccatgacttgtgtgctatcaaggtggtagaatgcctccttcctcaacaaacactcctaaccagtggagtcatgtcttatgggccagcctttcttaagctacatatgagtggcacccactcgagtcgatgtcttaggcccaaagggcaatatgacacctctacaaaggcctgccaaccagtgccatgacccatgaatggcttattcattcctagattaaaaatacattgtctcagaagcatggatgaacgaatgaatgaaaccagaatgtcttccaatagacctgtcagtcaatggcgtagtctaaaatagttactatttggattttttcccagttagaatatactactagattttatgctttatattgctggtcactatgatgcagtaaaaacaagaagataaaagactttattagtttacatcttaggaattattgcattgaaaatccagtgtcttcatttggttgaatatgtatgtgccaagaggtattatatatactgatatttacttaatttctttcaaagtcagattacagttagtcccccaaattcttcttatcattcatattaatgtaattattgtcataatactgggtgtagggtaagtcttattgatcagattggtcttaaatcatgttttatttattaggaatagctttaagaattattaatcataactgggtttagcaggcctaaaacatatcaagaaattggattagtaaaaatataccaggcgacagggctttcttggatcagattgtccaatattcttccaaagaaggacaattttccaaaagtggaaa

SEQ ID NO: 21601 - DNA, 1062 bp, Homo sapiens
gattgctccaagatacaatctaatgggctcttgccagtcccttgaatcacaggacatcagggtggaaagagttcccagaggacagtgaatccagtaggagtttccccatagcaccctggggagcccctgcacacttacatgtctcccctgctcccgggctctttccccatctctcctgtctcagccccaagcctacctaggtcttggggggcagtggatattcagatgacagatgctcagtaaagtggagggtaaagggatgcatgacgatgccagagaccaacggaggtacatagtgcaggttcctttttcttaatgtgcctttacgaaacataaaaaccaggctagcatctcacttacctcatccattactgtaaggtcagttccaggcaaaaggctgaaattttctgggaatcctcctttagtcactatttattctttcttgaacagactcaacgataataaagtcatcttttttgatattgacaggtcatatttggaacttgttgaaggactctagagtgtgattttttttcatggtttggattgttgcccatggatttctcccatctgtgcgtgcatttgagtagcacatggacttctggcaatagagggaatggaatgaggaaaggattaagccacagggcgtgccatcatctgggcagttacacatttcaactgaaccctagttaggcagatttttgctgggggaggaagaaaaccaattaggaagacctcactgaagccgccctatgtgcacagacatgtgtgtatgtagtcagccaagcagagggcacttggttactgctctctagaagtccacattcctgagggtctgacttacatggaaggccagacacattaacttagcaattttgttataattttaagaaccacgggataatcatttctcttaccatccacctttgtgtaagctccttgttttcttggaattttctggacctttaggaagtgctcaggtcacttttgtgcagaaggagccctttctacagctctaccctgcacccaagcagttctgaattccagtgccatcagccaaga

SEQ ID NO: 21602 - DNA, 1057 bp, Homo sapiens
tttagatttacatttccccggtggctaatgatactgaaaaatcttttcatgtgctttttggccatttgtatatatcctctttgaagaaatgtctattcacatcttttgcccatttaaaataaaattggggtgtttttcttttttgttattataactggatttttagatattctggatgatagatcattatcagatgtatgctttacagatatgtcttccattctgtgcgttgttttttcactttctcagtggtattctttgaagtacaaaagaaaaggtagagaaatctaaattatctaccttttttattttattcattttgatgcttttgtaaatgagatggttttcttagtatcctttcagattgttcattgctagtgtagaggaacacaaatagctattgtgtgttgatcttgtactctgaaactttactgaatttgttaataagctgtaatagttttatttatttatttattgaggattctctaggcttttctatatacagtagtctcccttatcagggaatatgttccaagaccttcagtggatgcctgaaactgctgatagtaccaaatcctatatatatattttttcctatacttacatacctataataaagttcaatttataagttaggcacagtaggggattaacaacaataactaataattaaatagatcaataagaacaatatgccagcatcactactcttgtgctgtggagccattatttactaaaataagagttacttaaccacaagcactgtcatagctcaatctgataactgagagggatgctacatgactaacgcctatacagtgtggatatgctggccaaaggatgattcatgtcccaggcaggactgagttgaactgcaccagcattcattatttctcttccttgccttagtgctctgcctagaatttctagtacattgattagtggagtggcagaagcaggcatttgtctttttcctgatctaagtgggaaaactctcagtttttcatcagtggagtaacatgttagctgtgggtttttcataagtgccctttaccat

SEQ ID NO: 21603 - DNA, 1039 bp, Homo sapiens
aggtagaaaaaattttcacaaaaaaagaatgtaagtttcaagagaaaaggtctctcctttttaatgtatctttctggccctttagaagagaaggcagatgttctagtctttgaaatagttttgggaaagtaaaaaacctaaagttcttaaaatgaagaagactgtaaatagaagagaagggatatggaagaagaaagggtattttggtgtttggcagtgtggtgtactaatataaacaccttatcaactttgatgaatcttggcctttttgttttgaataagtattgggtttttgttttttttgtttacaaattgaattatttagtgaaagaatatattatgtacttggatagggccacttcgttccatttaacaagccctagaaaatgctgttttactgatctgataatcatcacgaatactacagaagttgtatttcttgaggccattttatttactctatgttgctgtacaaatttagcagattttggagcattgttattataaattgtcctggaatgacattttatatcagactaacagtttgaatgattctttccatttgtattacagagagataggcatgcttaaagaaagaactgattgttacttattttattgttgtctaaactattcttaaagattatttttgttctcttaaaaatatttagttattaatgctaaccacagggagaaattgtgacaaaagtttttagaaagtaaagaaattatatgctcactattgggtgactattacttacctaggtgaccgtaccccaaacttcagcatcatgaatatacccatgtaacaaacctgcacatgtacccctgaatctaaaaaaaagtcaaaattattttttgaaattatataaatgtaaccatatactaaaattcatcccaataagagtctctaggggttaagttactctttaataatgagttatatttacactttacttttttggaattcatccaggaattaagaataaaatgaggcactcctcacccactccagtcccgtatgtatgaacttactttc

SEQ ID NO: 21604 - DNA, 1037 bp, Homo sapiens
aatataaggtcatatcatcagcaaacaaaaaatttcacttcttccttttctatttggatgccttttacttttttttcttgtctaattgctctggctataacttccagcactacgttgaataaaagtggtgtagtggtaatctttttcttgtttctgatcctagaggaaaagcatttaacttttcaccattgagtataatgtcagctgtgggcttttcatatatgacctttattgtgttgaggtacatgttttctgtgcctaatttgttgagagtttttactatgaaaggatgttgaatattgtcaaatgccttttctacatctattgagatgatcaccacggtttttattgaacaaatgtctgctgttttacatgtatatatgaaaaaatatctattttatatattcttttatatatgtctttttaggaattaacatttagacatatttagtcaattttatctcagatatcttttgaaagagaaatagttgaatttttttatccattgtgtccaaagacactgtattctaacaaggtgggaaagactgataaaatggcacattttaaaaaatgaacattccagttaatttcttataaaaagatatgactttggagacagaaaagctgcttttcttgacttcagaagtgcaagatgggcagaaatggaacctagaattttgtcatagtggtttagacagtgcttgttaaccagtgctcctcaggctataaggtacacgttaatcacctgagcagcttgataaaatgcagaatcgaatccacatctagagtgcggctcaggattttgcatgtcttagaagttcccagatgataccagtgctgctgtccctggaccacacttagacttccttcctgacagtaagtttttctctttttatggcaggttgattatatagaaaggttaaacccagtgtagacaactattcatgaagtgtactttgataagaaaggtatgccgttgacaaagcttgctgtagttgtgaagcatttgatgtaagactattaactaagtgaaaggc

SEQ ID NO: 21605 - DNA, 1041 bp, Homo sapiens
aagagtactagtttacctgccttacaataaatactaatagaagtctgtttagatgaaaggaaaatgacataaggcagtaactcaaatccacacaaagaaataaaaagcatcaataaagatgtgtatttccttttccttaaacaattttagacacctgaataaaacaataataatcctgtattgagcttacaagatataaagatcgtgtgtgtgtgtacatttgtgtatacatttgcacaagggagatgagaagggagggagctatattagagtgaattttccatatactggaattaagttagtggaaaggaagtaaaactgtctttatttataaataacatcatcctgcatatagagaatcataagaaatccacaaaaaaaggtgatggaactaataaatgagttcagcgaggatacaggatataagatcaatatgtaaaaaatcaattttatttctgttgattaccaatgaacaattaaaatacggatatatttaacagaagtgcaagacgtatacactgaagacattaaaacatggctgagagaaactgaagaacatctaaatagatggaaatgggttccatggtcatggattggccgtttttcccaaattgatctgtagatttgttgcaatcctgatcagaattccagcagattttgataattccttttttgtggaaactggtaaaacagtcttaaaatttatatggaagtgcaaaggagtgagaatagccaaaacaattttgagaacgatgagaagagtagagggttactcttttcagtttcataatttgttctaaagctatggtatagtaggtagaattttaagatggctcacatgaccttggccccctggcaaaatggtttcactcttgtgactatgttatgttatatatttaaaaagattatcttggtaggcccgatctaataaataagaaaagcagagagttttctttagctgagagtaaaagatgaaatcagagagatttgaaacatgagaaggattcaacttaccatttctagctttaaagatgaatgggg

SEQ ID NO: 21606 - DNA, 1041 bp, Homo sapiens
agtcacttgtacatttataacatattagtaatgagaatggcagcctttgccttgccctcaattgagatagctgtttgtataaacagttaattgtgatttctagatcttccaaagaattaatagctctccttgctcatcattcttgtctgttcttcctatttatttattggtccttaatttattttaaaaagcaaatattttaaattataaaagtaagttacattatagaaaatttgaaaaacaaaggttaaggaaaatatccataacccttatgatttttacctgtatttgaaaaacatagtcctatagttgtgtgcttacaattttgaattctgtatttgtcacttaacctattttgcattttctcttatggctgcatagtattctgttagatttaacatggtttaatcatttcattatagttggcagattaagatttagactctggcttgtattacttgagtcttcaaaatttttcttctttattaatctttccatgtgccaaaaaacttattaataataaatattatgaattctgttaactaaccacaaatgcctggtagttgtatgctaacaaaacaacagcaacaacaacaaaacaaaaaccttgagactttactgggtagatttattttcctcaggatatttgacagttttttcatctttcagatttttgaagatgaaaacaataaaatgaattcagtttcagttatctattactgcttaaccactgcaaatcttagataaccaccattcttgaatttgagctaggtgcagttgtatggttcttctgctgattgtgcctgtggtcatacttatgtggctacatgcagctgacatgttagctatggccctaccatggctgggcctctatgttggttcagggcctctctcctcgtgtagcgtcttcacatgatttatccaaaaaagtagctagacttcttacccagagtgcaaaaatggaagctgccaggtctttttacagattgggcccagagctgggaatgtatctgtgggttaaaatggacagcttagccagaa

SEQ ID NO: 21607 - DNA, 1032 bp, Homo sapiens
gtaagtaaatatttgagttttttttcttttttccttaaagctctgagaagataatgtgaaaaataaacatcttaccatcgtttaaggcttctagttagtataccaacccttgccaagaagaagtgaataaatggggatgagggcagtaggaggaagggggtgttctttgtttctatattagagttctggcattaacacttgcagattgagaaaagctgaagaattgtctctaaaataccttctttcttttgctgtactttttctttaatgtttctaatttcaagagagaaaaccacatgtatttcatccagtcttcactatattaggaggctgaagttagcatgtattatcttggcaagtttttaggagaaaatttcttatgtctagaagtaaacgtttagatctgttagaacactgcctgtctttaaggtggacgtgcgcattggatttgtttttctgtctgtgtctgtgacaccatgagacattcaaatagaaggaagctactgtgacgtttctgattgatgctttgactttctagtatgaaactacttgcctcttactaggtttgcctctgtctttctctactcctctccatccccacctgtgaaaaaaaaaattacttttaaaggaagactagtagacagtccttcaggaaatattttcgtctttctgtaactggtatgacccattaggagtctggcttcattagttcaaacacttaactatgaatagttactttttcattttgatgatttaacacttgtgatttaggaaggagtatatttaattcttccctttttccctctcttcctttcttattaagattttgtggtttggtttgtacagctagcttctatgattttcgtaaaaggcagctaagagtgactttccaacacagggaaagggtgagtgagagaattccagcagcccataactctagtctggaattgtgcaatcctggctataggagagccccttgatcctccaaacctctgaaactaacacagggagctgccagtaaaccatgggttg

SEQ ID NO: 21608 - DNA, 1034 bp, Homo sapiens
tgcctacatcaaaaagtagaatgattaaaaattaagaattaaccaatgctcttgcaggaactagaaaagtagaaataaaccaaatccaaaattaacagaaaagatataatagacataagaacagacctaaatgaaatagagacttaaaaaacaagatgaaaagtggatttttaaaaaagataaacaaaattgataaactgctaactacattaactaagaaaagatgagagaagatccaaataaacaaagccagaaatgaaaaatgagacattacaatggataccacagaaatacaaaggatcatcagggccagttttaataactatatgctgaaaaactggaaaatctataggaaatggataaattcctggaaacatacatcctaccaagattgaatcaggaagaaatataaaacctaaacagacttataatgttgagcaagattgagtcagtaataaaaagtctcccaacaaagaaatgtccaagactggatagattcacagccaaattataccaaccatattaagaaaaactaatataaattcttcccaagctattccaaaaaatggaaaagaggggatttctccctaactcattctacaaggccagtgttaccctgataccaaatttagacatacacaaaaagaaaattacaggctagtatccctgacgaacatagacacaaaagtcctcaacagtatactagcaaaccaaatccaacagtacatgaaaaacatgattacatgagattacacaagggatgcaaagatggctcaacatacataaatcagtaaatgtagaacatcacatcagtacaatgaaggacaaaaagtatatgatcatctcaatagatgcagaaaaagcatttggtaaaattcaacatcccttcatgataaaaagctttcatcgaaccaggttagaagtaaaatacttcaaaataatgaagatcatgtatgacaaaccctaggctaaaatcatattgaatggagaaaagctgaaagccttttctctaagaactggaacaaaacaaggat

SEQ ID NO: 21609 - DNA, 1025 bp, Homo sapiens
acaggacatcaagctcctttgagtaaacaaatccttttgtcttggcttcttggcacctcaaactgtatgtattctggaaaattgcatttgaggtttaaccaataaggcaaagatagctggccacacatcagtttgttgagtggctactctcagcagatacctccttgctggcattatatacatgattgtgtattgagaaggcatgaggtgatcttaatgttgtcatcactcatgcttattttaatatcagtatagtgcttgtgaaggttctgattgttcaactgaaagaacaagtatttaagtgagcaaatgaatgcaagaataaaacaaatgagaacagttgcaagaaagcgtgctggtaatatatactctaaaatttcaaagtgcctgtggttttccaagtcataacttctggaaaattcttagaaattcgatgataatataaatagaagaggagccaatctgatgagaaataaaattagacaagtttctaaaaagtaagaatagcaataaaaccttctaactaaatgaagccaccaaaaggcttttggctgcaagaaagataattcaaaataaagcatgaagaacttcctgccaacatgggataagcccactatagcctaccccttctgctgattaaaactaaaaagtctggacaaaatataaaagcaactgtataagtaaacaaaagcagtcagatggtggtgaggagtcaaaacttaaaggggcaacctgtatggaaatgagtttcctagtttggaaagtttttcttttctttttttcttatggttttgccttcagttgtgaaggcaacagtgtggcactggaaactaaaactgatagaaatcttattttcttgcaccacaggaaccaagtaaatgagcttagcattccaaagagtttgggggcagtttccaagttttttctccctttaccagctttaacctaagacagacccagttgcaaagctgcatctgcagtgccacaagaggaaccaggaaaaggggccctttgggccactgagt

SEQ ID NO: 21610 - DNA, 1032 bp, Homo sapiens
gggttcaagtgattctcctgcctcagcctcctgagtagcagggattacaggcacgcactgccatgcccagctaattttagtatttttagtagagtcggggtttcaccatgttggccaggatggtgtcaatctcctgacctcgtgatccacccacctcagcctcccaagagttaatttttgtatactgtgaaaggtagggatctagttttgttcttctccatatggctagtcacttatcccagcaccattaattgaacaaggagtctttcccattgcttgtttttgtcagtttgtcaaagatcagatggctcttgttgtgtggacttatttctgggttttctattctgttccattggtctacgtgtctgtttttgtaccagtaccgtgctgttttggttactatatccttgtagtatagtttgaagtcaggtagtgtaatgcatccaactttgttctttttctttaggattgctttggctattcaagctctttttttggtttcatatgattttagagtagttttttttccaattatgtgaaaaatgacatgactagtttggtacaaatactgtctatctgtagattgctttgggcagtatggccattttaactatattgattcttctaatccatgagcatggaatgttttttcatttgtttgtgtcacttgtgatttctttctgcagtgttttgtagttctccttgtagaaatttttcacctcttggctagatgtattcctaggtatctttttgtgtgtatgaggctattgtaaatgtgattgtattcttgttttagcactcagcttgaacattgttggtgtatagaaatgctactcatttttctaaacttattttgtatcctaaaactttgctgaagtcatttatcagttccaggagccttttgatggagtctttagggtttcctggatatagaatcatatggtccatgaggagagagagtttgacttcttttcctatttgattgccttctatttctttctcttgcctgattgctgtggctagcacttccag

SEQ ID NO: 21611 - DNA, 1064 bp, Homo sapiens
tatatttcagttaacagtctggctgttatcattgagaaaaatgactaactcagtcagggactgaattaatttaatgtttgatgttagttttgatgagggcttttctattttttattttatttttagatggcttttcatctaagaataaacgtgaaagccttgggtttttgaacaggttctctctttcttggtaagccctgaaatccaaatgttgtttccaaccctgtgagactacttaaagctcctcttggctcctccactagcacttcttttacattttaaattaaatttcttttaaaatgtcttgaacagaaaagcaatgactaatgttaaggtcatctttttttgcttaccttctatctgaaatcttggctctttcatgttctcaacaccttggtaacacttcagtgccttcaaactaattttaaaaaatattttttcctatcattcattcttgcaggaagtatgcaaaaattgcattattatccgcaatagattgtgcctaaacattttgagaattttgctctcctagaccctgaagaaattttatagagtacttaatctacaaattttagaaaggttgttggtgcctgatttttacataaaaaggtagttccagctgggcgcggtggctcacacaggtaatcccagcactttggaaggccaagacgggtggatcacctgaggtcagtagttcgagaccggcatggccaacacagtgaaaccccatctctactaaaaatacaaaaaattagctgggtgtgatggcacatgcctgtagtcccagctactcgggaggctgaggcaggagaaacacttgaaccgaaatcgcgccactgcactccagcctgggtgacagaatgtgtggttcctttttgtgccttggctaggtatctaccatctgcctagtctcctgaatctccaaagattgttcaatataacttgcagattggaacattttaattttaatacaattatttcagtttaggctgttagttttgtggtctattgtaggccttcctttttgtcttctactatctctccatgtaaacttcgtgttttga

SEQ ID NO: 21612 - DNA, 1022 bp, Homo sapiens
tttttgcattgtttgtagagatagggttttgccatttttcccaggctggtcttgagctcctgggctcaagcaatctgcctaccttatccttccaaagtgctgggattacaggcataaggcaccgcacccggcccagacacttacttttaatgtaaagtgtatatgatttcccatatggttggccctccatatccctggagtcaaccaactgtggattgaaaatagttgggggcaataaataatgcaacaataaaactattacaaataaaaaatatagtatagcaaatatttatatagcattgacattatagtaggtattaccagtattataagtaatgtagagatgatataaattataccagaggatgtgcaaagattatatatacatacacatcacttgagcaaatccatgggattttggtatgagagaaggtctgggactaataccctgaggataccaaggaaccactgtagtgtttttgagtatgtttctttgaatagatttgttttattggttgctctaagtattctgttaaacacacataacttatcaaagtctactggtgtcatattttatcagtttaaattaaatgtagaaatttgatctccctttaagttcccttaccctcccccatttataattgtcttaaagagtttctcattgagaatagaacaagagaaattttacaatctgaacaacagaaatagactaaaccaaaaaaagcctaaacagagtctctcattgagaaacacatcataaaatattgtaagttttgcttaaatcatcaaatttaaaataagttacagaataatttagaaaagtgaagagaggaaaaatctattatatttatctgtgtttctatttttttctattgttcttcctttctgatgttccaagatttcctcttttatctttttgttgttttgtttttagatctctgtttattctttaaggtaagcctgctgtagttttgcttcatatgaaaatgttcttattttcacatcacttctaaagggtacta

SEQ ID NO: 21613 - DNA, 1124 bp, Homo sapiens
cctatatatagaaatgactatataggtacatacatgtattctctttccgtgttcacagcaaggacttgggagctgtggcaatccaatagctttttttttttttttttttttttttcccaatacaaggtaccagaccttttcaaagaaatggctgattccaggactggttcagaaactggacaatatagcaattgtttaggtatgatatggccagcacctgaatcaggccactggaagtgaacggaggaattaagaggtatctatctgtttctccagcctagattttatggtcttctaaatcaaggacttgttctttttcttttaaaaaaaaaaaaaaaaaaagactcatgccaaaatttgagtatttcatgtgctgttttttctcttatactctattcgcttaaatgtctacctttcttcccctggttttcctcacatcactgacacccctttccctcctgctgtcccccgaggatttcctacaggtgccttagagaatccgtgtttcctaggaaatgcactcttttcatctgcctttttctaaaagactgttttctcccactcttcacaataactcagtaattttcaatcctatctgaacattagaatcacctatagaacttttttaaaaggagaggagagtgagagagggaagcaaataatatccaggtcccaccctagactgattaattcagtttcgacaagtgggtgagactcagtccatcgctcttattaaaaattccccagattatttaaatgtattgccaagctgtgaatcactgcctaaaatcagcatcttttctgagagcaccacttctattagaggccattctttctgtcacatttgataaacaacagagagaggagtgccagcatttttcttgcatatctctttatttatgtgaatctaaatatatgtctagttttactgcagcagtccatccttttccatcctttgttttccatcattatctcactaggaccttgacgtcccacttaaagtcactttctcccccataactcctaccatcattctgtgagatcccaatatccatatggttgatgtatccattgccatagctaaagaatttctgcgttcctcaattcactccagcatcatccat

SEQ ID NO: 21614 - DNA, 1085 bp, Homo sapiens
atgaatgcgtgaaagttttagggagaccaatttgttggaaaatagggaagattgctgtagccctagaactgttcaatttggaacgtggtaacttggatgatggtgggataccttcttattaacgaatttttgagatgatagctttcagggatatgaggataagaattcatacaatgcaaaagaggtttaattagatgactttagaattacaaacttgtaggcacaaaatccttttagcagcacgatagttaccatgatttttgcagttacagctcatttacatcattccaactctttttgttctaattttatacatttctaattagattagttaccttcctcatcagaccaaagtggattaaaattgggacattggatgatgaaaacatgatgattgagataagtacaggtcatgaaagcaggaacggctgatggcctaatatcaaaggaagagatgggcagcagggaaagtagagtataaaaagttaaaaagaaaaggccacttgcggatctggtaggaacattctaaagaccttgatagttcctatgcatagtatagtagaatccagttaatcccaaattggcactgaattttcagtataaaatcaaattatattttacacttttgatattcagagcacacactaagtatgaagaaattcagttcagcctgcagttatagttatttgttaaatgcagaaacacattttaaatgtaaactttgggtgggactgagatgatatacagctgtatctgacaataaaacagactataattacaataatgtggtagtgacacacatgtgtaaaccaatatactggttgaacagaattaaaagcccagaaatacatccaagtatgcatggaaatctagtatatgatataggtggcatttcttcactaagtcataatactgaggaatggaattaatttggaaaaaaataataaaattatatccataactcatgccatacataggaataaactccaaatggatctgtaatctaaatgttaggaaatgaaactaggccaaacatggtggctcatgcttgtaatcttaacacttttgagaggccaaggcaggag

SEQ ID NO: 21615 - DNA, 1053 bp, Homo sapiens
tccacccattaatttatttacagaaagaaattcttttagcgtcagactctcagaaattatgatttaggttacttgacatttgggccctggggctgaaaagcttttctagagagaaggcagtgctcagaaaacaaattggaggaaattggttctcacaaagtcacactttttattttttaattaaattttgtctttctaccccctttttttttccttaatgacctaagtatttcagatgaaaaccttctagtcaggacttgatgtttcacccagaaagttcatagtaataactttgttcaattaaatttgttaccatttaaatttatgaagtattttcaaattcacagtttatagcatgtaggaagtgacccatttctgtggaacctgaaatatgaatactgtaatttttcaaaactatttgacaaaaactgcaattacttttgcaccaacctgcttttacaatggacttttttcttataaaaatactaatttaaattaactccatgccttttgattatgcttgggggaaaaaagcagttggaagagtcatgtatagtgaagataatagtgatgcactgagtgttcttataaggctgtttctgagacagtgacatgaggacaatcatcatatttgtgtctcctgacaagaaattgatggtgacccatgggataaatgaattcagttcagcaagtattcattatcacctcttggcctagcattatataagactatgagctttcaggtatcatgtccttgtattcatataaattaaaattgttttggggtaaggatatttacacataattaaaattaggaagtatagcatagtaattgattaagggtcactctcttaataaacatataagtaattaatataatataaatgtggaggatgaccagatcagtgtgctgtgacatgaggaaggtttcacagaacaaagattgcccttaaagtgtgagcagactttgatagcattttttatttggtggtcatttttttatggggcaggaaagcatgagtaaggtaggctgttaggttcaggaaacagttt

SEQ ID NO: 21616 - DNA, 1068 bp, Homo sapiens
acatcttattaaacactttgagactaagcttttgtattcgttcccaaagcttctcaacatcaaactgattggcaaataagcctttggtcctctcctctaatctcgtttctgttacagcctttgtcacccttgaagacatttcagtttctttaagtttaaattgcctcatctttgaaatgaggttgataacatttacccagcttcccttaccagggtaattgggaagattaaattagaaatgtattttataatattttatgaactaggaatcactacataggaccgtatagcatttagtttttatgacttatattttaagcacatattgtggtgctatttgaagttttctttttttaaaagttgatttttagttccttgaagatctatatctttgtttctgccatatacatgtatatatgtctagcacatttctgcatcataagccatcggatatttattgaatcaaataatgagtgaatgtattttaggatgaatgaattctatcttgtcacatggtttatgtgggaaaaaaatgcggttgtagatagaccagtatttgctgaagactcagataattttcgattgtggatggattagtggtgtttaactaagataagaggtttcttgttatttttgaatcaagataatctttttcagttttgctttctatttaagtttataactgtgagaaatatgaataaggattatccatgctgttaaagaaatccagatcattacgcaacatagaactaattttttctcactttgaacccttcagggtgataagtctgtcagagttatgcgttctttgctggctgcacaacagacatttgtagatcggttggtgcatctaatgaaggcagtacaacgcgaaagtggaaatcgtaagaaaaaggtaagcctatggtgtatgcttttgttcctaatagcatcttggcatcagaaaatactgaattttcactattgtctttttgggttgatacgtgaattttttttttttttttttttttttttttgacaatgtctcactctgtcgcccaggttggagtgcagtggcacgatctcggc

SEQ ID NO: 21617 - DNA, 1068 bp, Homo sapiens
tttctttgactcatttttttttctttggattaatatatttctccaaatttttgtcttatataatttcttctcaatgaccaaactcaatagggtctctctctctcagaacaattttctgaccatttatgtccagaatatccatcttagcatgccactttatgtgaggttttatgattccccctttctaaaaagaatataatttctttattttttttttgttgatttaaacatatacctaaactaatttagaccttcatataattaagggaaggactgtggggaaaacataatattattccagaataaaagatacagatatttgagatctcctctcattttataaatgaggaatttgagtcttaaagctgcacaactagtacagattgagcatctctaatccaaaaatccaaaatctaaaatgctccaaaatctgaaactttttgagtgctgacatgatgccgcaagtggaaaatcctccagctgactttatgtcatgcattacagtcaaaacacggtcagaactttgtttcatgcacaaaattactaaaaatattgtgtaaaattactttcagtttatgtgtgtagggtatatgtgaaacataattgaatttcaagtttaaacttgggtcacagccctaaaatattttattatgtatatgcaaatattccaaaatccggggaagtccaaaatcccaaacatttgcaagcatttctgttatgggatactcaacctgtagtatacttgccattaaaaaccagggctcttcactttgcatctggtacattgttatgttgtactgtttcaccttatttatttcagtatacctctaaaaataaaaaatgatgatagatatataaagaatgtcttctttgtattaggcatggtgccagactattgacctgtatagtttctgattgccttagcaactctgcagaagagatggtatcttattttacagatgaggaaacaagttaaaggatatgcataagactgtccagcgagtacctgggagagcttggaatgttttaaccacatgactgattgcagagcttgtgcgctttccatcg

SEQ ID NO: 21618 - DNA, 1050 bp, Homo sapiens
gtaaatttaaattatcttttaacttttcttaatctttcacctacccatcaaagaaaaaaacgttagctgtgtaaacagacaagtaagtgtgatatataaaggagtcgccaggagctgttaatccaagataaataggataaatgtgggataacatttattttgcacattggccaaaactagtcttgaatttcattgacccacctgtgctctcttgttccactgcagtcagcattgctgcacaactacccattaaaacacatgatatttaaaaaacaaagaatacaggcacttgctatatgacaaatgtttgcagcttgtaagattagttaattattgtaatagcaagagtcagcagaatgccccataattttcagcccaaatgccttgcagtttatttctcattcatacaaatttaattttcttatcttctccaaagaagatttttaaacacttgaatgtcatccttgatagggtttgccatgtttgcttcattaactgcttttagtaaggttagttttatactgttgttttctttccctctgtgttctgtcaaaaccttttataaaaattcttcaaatgtacagtagttgaatattttgggactgtctctgctatatgttttttatttttatttttttcctaaagacacagacatttcaaagtatttgggaaaaagaaggcataccttaaagattttttgatctgaagtccagaccactgcaataaatgacttttttgttttcccagtgcatataaaagttatgtttacatgatactatgcagtagcattatgtctttaaaaactatgtgcctatcttaaaaatattgctaaaaaatgcttaacaatcatctgagctttcagtgagttgtaatctttttgctggtggagggtcttgccttgatgttgatagctgctgatcagggtggtggttgctaaaggttgagtagttgtaaatctgtgaagtttgccacatcagttgattcttcctttcacaaaagatctctctgtagcatgtgatgctgtttgatagcattttgcccagagtagaa

SEQ ID NO: 21619 - DNA, 1035 bp, Homo sapiens
cccaaattcaagctctcccacaatcacttactgtatgcttcactggaatgccgagctgccatggggcctgtggttcatggcataataaacattcctctgggggctgggcctccagcctccctttcttgcagacatccccaggatctacaaaggatgctcttcaagcttcttccccagctttttggttgagaaaagccaagaactttcaattcctccctgagcctcctctcacatttctagtgtctttcacacagcctggaggatgtagtggtcttcagcttctctttctttagaatgtgtgaggactctattgccctcagtttttgcccagattctaggacaatttcattaaatacaaatgattttgaaccatgttggtaattgttgaaatggagccatgccactgaacagattcagccggagaaagagcaggaatacctcaggcagccaggcatggcagagactgggctctaggagaacaaatggaggttcatcaggaaggagagtgagggagaacactgggcagagacatgagaacatgcttgatgacaaaaaagggcttggtgaactcaaagcacagcacagtggccggtcatctgcagggagaagggagtcaagactgcagaggcagcttggaggcagaacagggaagtagggctgctgaagagcttcttggaggggaagggggtgaagttgttttctagtcagaaggggccaagggagagaatcaggaacaacaattaagaggcactgggtcccccaggtaatctcatttacctttaaaatgttaccctcttacatattccttaggttactcagttgtcttgtgttcccaaatctctttgccttctggaaggttaacagccactggtaaatggatggcaaaggatttatttgatagtcgtggaacagggtcacatggccacagtctatttttagccacctcagtaagactgaatgaagtaagatgtatgaaagtgttctataacattctaaccttagaaaacatagggaacacttattgttaagcagtta

SEQ ID NO: 21620 - DNA, 1034 bp, Homo sapiens
cttcatgaatgcagagagtacttctgatttataccctgtctctgtacaaggactggcaaatagtaatgctaaatccatatttgtagaaggaaggaaggaatgagggagggagaaggaaggaaggaaagaaggaaggaagggaggaaggaaggaacaaaggaaggaagggagggaggaaggaaggaacaaaggaaggaaggaagaaaggaaggaaggaagatgagatagaaatgagagagagagagagacagagtgggggggggagagagagagagagagagagagatgggatttggaaatagcccaaatgttctgatgtttcattgtttatctgattattttctcaccatatatagctagtagtcatctggcttcatacttccttgggaaggacagcagggccagacctgccaaatgtttaattgcagctcactgtaaaaagaattaacactccagtaaaaatggacccacaagcaagctgctcagatcattgtagatcctgaatttcagatctgtgaggaacttggatgcttatcgcatcctcattttggccttgaggaaattgaagctcataaaggctaggtaacttgctgaaggtcacacagctggtggcaggacagtgttacctctatttcatgctgcttcttggatagactgcagacaaaacatgtaccaaactttaatttctattgctctcagtgctggggggatgccagagttcttgcttcacaacaagtgttcagaagcagaataattgaggaacatcacagcaggctctgggaggaatttgtggccagtcatatgaaatttgagtgtctggctgaaactgactctagtcaatcactggctgtgtctctggctattgagaaggaggtagtggatttttggggtattgctttagttgctattacagggtgatattttgaacaaagacaccttttttttttttcaaatctctatttctggtaaagttaaattcagcacttgatttgtagtattcagcaccagggaaagattagtaacttctcccttaa

SEQ ID NO: 21621 - DNA, 1022 bp, Homo sapiens
tgtcacttcagagaacataactaagacttggttggaaggtgctgcaaagcagattttgtcttagtacaaataagaaagaatttcttgaaaagtaaatctgccaacagcataatgtttaactgcctcaaataaaggccagaatgcctggcatgagtagagatgtcttttgaggaaggagtttctttaagtttcacccaatttagatgctaagataaggaatttccgaggatctactatgtaaaatgcactgttagattgtatggagtttcaaaaagaagtatacaacaaagtttcttttttaagatgcttatactctagtatgagaattaaaatatgaaaacatgagcatctaccgtagccttctggagaatatgtgttatctaattaagagaatgggataatcacaatagacagggaaagtcagaaaagaattcatgggagaggccttaaaaaaaaaaaaaaagaatggtaatagaaagagtgatgggaattgtgaggcagataagttgtgaaagtgtgactatatatgctgtgatcagagaaacttagtccaggttattgggttgttttgggagagttgagaccataacaatagagagatgattgtgaatagatttcagtataacttgaaaggcatatttaggaatttaaacttttatttttatgcagttggtaaccattttgtgcctttgcatggataggaaatggtaggatgaaaatggtattgaaagaaaaagacctggatgtgcttgaataaggagaagctgaaagcagcaagcacaatgaaacaggctgcatccttggagaaacacagacagcattctcggaatggtaaatatgctgtgggttgcttcaaccacttcaggcatcaacaattgccttgacactcatttagcaacttgtctatgtcaaataatgagagttacctctttggagcctttagcaacctagcaactacagagccataacaatgttgtttatcatctccttgtccagcctaatgatgcatgattctgttgctt

SEQ ID NO: 21622 - DNA, 1027 bp, Homo sapiens
ttcatagcaaatgataccaggtaaagaatgtgagcagccctgaagtccataggatcctctgggaggtagctgccaccccctcccaggagcccatgatggttaatgatcagcagacccaggtagaacaagtgtaggcaaagccagctgagctgaccctcaggtaggcagaggctgtgccactccaagtgctgaggaggaataggggatgaatggtgagcagataagagttttagaactttgttagcttggaaaaatgtttccttggtccaacttatcttttcccaccaaaaataccccctttcatatgcatggcattttgttcttttcaaaaatatctttatatggcttccgcccccttgattctcctaaggaggaaggccagataagcattttatctccgtttagaggatgaggcaactgatacactgggttgcctgaaatgacacaagttggtggccaacctggggccagacggctgtggcaaagtgtgaagagcctcacatctgaagtgacaagatcctctttggatcgtgtccctgtacttcccagttaaatgacccctggcaagtcagttaacctctctgagcctccggaacctaatcagtaaaataaagataaagatgcttaccctgcctacttcacgggggttatgaggattaaataataccagctaatttctgtaattgaactctgggaggatttccatgctgcctcctggaaactggtgcctgggattattgttgccatagcccagcaattaataaccccttggaatgatcagaaatgcccacaagggctcctcgtgttctaataattcaaccgatgtccatataactgtatatattgaattattagatgcctactatgccatgtgctttttgaggctcaaagtctcaggtggtatccagttggactcaaagatgtcccagtgctcaggaaatgctctttgagttaaggatcagcaagaaaaaaggaaaaagatgtgcaaacacacagggaggggaggcgaagtggagagaatgagggg

SEQ ID NO: 21623 - DNA, 1022 bp, Homo sapiens
ctttgggaggctgaggtgggtggatcacttgagatcaggagttcgagatcagcctgcccaacgtagcaaaaccccatctctactaaaaatacaaaaattagccaggcatggggtggtgaatgcctataatcccagcatcttgggaggctgaggcaggagaatcgcttgaacccaagaggtggaggttgcagtgagccgagatggtgccactgccctccagcctttttgggtgacagaatgagactcaatctcaaaaaaaaaaaaaaaaaaaaaaaaaaaaaaaaaaattccagtagtgacagggttttgaagagtttccaagctgggcaaggcttagcagctcttctctttcgtgaggatgttgggagtcagggacacctgtctagattcaacagcaagataagggcatgggagttccaaatggatgccatacagtgactcagggtaggagatgtggtgtgatagtctgacaccaagcagctttgtgaatctggatctgcagtatgaatttgctgaagccctagtttcctcacctgccaaatacaggtgatgatttctacatgatataactcagaggaagattttagaagaaaatggataatttacagagcaaacatcatcataataactttgatttcttgagctacatggcagaccctctgctaactgttttacattactcaccttatctgttagtcctcataacaatgctgccaggcagatcttatttatttacaggaacttgaggctcagattgcttcaaaggaggaggagctggaaggggcgaggttttcctatgaagccaattctattagactccaagcaaatgtgtattccagtcccttagttgccacaccctataaaagtaaaggatttctgaaaggtgaggatcactagagtgttttttccatactttctcatatagctggggtggcacaagcataatctgccacattttccctaattctaagttttccatggttttgagagagtgttcaaagctcactagttaaagccctatt

SEQ ID NO: 21624 - DNA, 1053 bp, Homo sapiens
aggcagtgagtttccaatagctggctggaagttccagaacagggattcttagccttagaagtgtagttgtgttgggcctttccaacccgattgagtaactttcagctgatttggaatcccatcagcatgggccaaactgacgtcagcagggagacagacacagcattacgttgtttactctgtacaacctataagtgaattaatgacctgccatgtcactattttgatagcaacaacatcacccccattgtctaccatttatgaattatcttttttgggcttgtcaattgattggacatctgcatatcctagggcatgtgcagatccacatggtcacatgctcattctctgggtcttcctcctctgagaacctagcatgtggtgttctttgtgacttgcccatataaactgctattaaagccaaagactgggtgccctgtgctggctgtgtccctctgtgagagactcagatgctgaggtctccagtggcacttaatgctccaattgccattgtttgaagaacgacatctaccctgtagtcatatgtgcctatgttgacatctctttccacttactctttgcaattctcttctggtgtccatgctgctggtgatctttattaacagtaaaattcttcaagagctccatagccctgaaagaagaattatgccatcacttccattttactcaatttcatttttctggaagcattagaagatgagtgttcacattttccataaatttatttgcagcttgaaagaaggaaagattgagcgctgtggctcacacctgtaatcccagcactttgggaggccgaggcaggcagatcacctgaggttaggagttcaagaccagcctgcccaacatggtgaaactccatctctactaaaaatacaaaaactagctgggtgtggtggcacatgcctggaatgccagctcctcaggaggctgagccaggagaatcacttgaacccaggaggcggaggttgcagtgagccaagatcatgccactgcactccagcctgggtgacagagcgagactccatctcaaaa

SEQ ID NO: 21625 - DNA, 1119 bp, Homo sapiens
ccaccccagatcacagaaatgcaggcatgcgtagaaacacattccttacctcctaaaactcatctcctaaaactgcactcttgcgcatgtgtgtgcttattgaaatgatgtctctctacctccaggttgtgagctgggtgtagggaaaccacaaagattgctgcagcatcacagggatagtaatatcgcagatgaaccatgatcacactaggcttgaagaaggaggatcagtttcagaatgtgtaggtttgctggggatgcggagctaaaaagagggcacaagcaagctctgttggaggtatacttgataggagctgtggcctttggttaaggacacagctagcctggggtgacccagcatggaggaagctgggaaaacaatacttctgacctcactcacctcccttttgtgatctcctgctggtgccccttcttggctaaaaccaaagggtaaaggaacctgaatgtgtaggtatagaaatcagcatcactggctagatagcagaccaagaggcaagggcaagatgtcctgcccagtgtggaagctaccccagtctttgttcctttcatctccttttcaggtcagtaccttggaaactgtggacagctgttcatgactgacaaatcattccctaccagagttaatatttactcccctttggctactgggaccttaggaaccaggtgtgtgatgggcagggaaattgtcaaaactcaggctggtggttgtcagtggtttctctggcctgagggaagtggatttttattttatgctaggagacctcaaggctaattattcaccaagttgtggtggctaccgtcttagcccaacataaattttaaaaatgcctgctttggatgtcatttccttttgatgtttggggtaagtgatgcttctgctttcactttcttttgggggctgggagtcctttagaagcagcaatgaaaaaagcagggatttatattgggattctgtttataattcttgaaggatatctatccccattctcagatttgatcttcacaccaaccctggtggccttccgagcacggatccgacaatcaaaatgtaaataaacagtttcaaaatggcaagaactttgaagaaaacctgtggtg

SEQ ID NO: 21626 - DNA, 1111 bp, Homo sapiens
ctctggtaaggcttactgtgtatgtttccttcatttgcagactgtcacaaaaacatttttgaaagtaggtggaggtgcacatggaaatggaagctttttctctcacttaatcttcgtaagatccgaagtggtggcagagggtacccctgtattacagcagaggacactagatcctcagaggtcagcagcctgctcatggtcccatgcagggcagaggaaggaaactcccatccaggccctgtgactgcatatttagcatcttttcacagccccacaaggaagtgtaattgtgtgcccccactgagatcacacatggcttgactatcttggtctgctttggcttacatgataatcctgtcctcaggttaaaatcaggcaacaattggaccctaacaatttccattgagaatgattgtttcaatatgaactgggactgcgtgtaacctacatggacacctcttgaagacaaggcaaattgtaatgatctccaaaccagcagcaaaaagtaaggactcaacaaccaggttagggcgaagaaggatcattctttacaaaaaaaaaagttgccttgctgtacacgtcatcattgctgatggtggaaggaacagacaactggaagttgtactaggcttgcctgtcctggcagctttgggagactggctggttatgaggagtggcagcgcttgctggcagccctttctggccagctcagtagggggacattcctcaccagggcagcccaggctgggcttggagccacccagctgagcgccacgtggcgggcaggcagtcacatggctgggatttgggtttggaatcacagtgctgaacctacagcctagtcaactccctgttttagggcattcattttttcaatcacaccagttggttggcaggtgtaaatgttctgggggaggacaccagaatggagtgaagacatcatctgtttcctaactcttgtagcttttgactgggtactttcctggccatcaaatgctgagagatctagcacctgctggtcctctatgtgggcgggaactgtgaggtccagcctggtgtatgtctctgtcctaagccttatatttctgaatggtggtgggtgggggatggg

SEQ ID NO: 21627 - DNA, 1050 bp, Homo sapiens
tgaacttgatgtctctttgaatatggtgatttcaggggcagctgagggaatgagatattttttatctattccaatctgttttaaattattttgaaaattatttcttgaacattgactgtttttcctatcctgtataatatgaagggtcgtacagaaagggggtggatgatggaaggagagacaaaaagagaagaagcttctgctgacttgtgctttgtatctacagggctgctgtggaggaaattgtgttcccttccacccaaatgtagacaatgaagccctaactcccaatgtgactgtattcagagtgaaaaagtaattgcggttaagtaaggttataagggtggaaccctgagctgataggattagtgcatttattagaagagacactacagaactcatttgctttctctccaccatgtgaggacacagggagaaggcagctgtctgcaagctaggaaaagagctctcagcagacactacaccctgctataatcttgatcttggactttccagcctttaaaactaggagaaaataaatttctgttgttttagccacccagtctgtggtattttgttaagtagctcatgctaagacaagacatttttctggttacatctaccagataaatggaaaagagtgaaaaacagtgaaagtttccttcccaattccctaaggtcaatctccatttaatggtgggagtgacttagagtgaagagaaatggttcccactacaagccctgtttgggtccatgtgggttttctgaatccgcagattagacgttaaagtgttattataaacttggttgttggtgtaccttcttgtttctcaagattgcaagctcagaacatcgtatacatgttactgatctgccctattgcattgacgcctgtgaataattttttttggtcaagtataattctattgaaaagacgaaattttgctgataaagtgtatctaaactgagtttatttagacttgtaagtcagctgaacaacggaaaatacttaaatgttttttgaaaaaataaactgcttaagatgaataa

SEQ ID NO: 21628 - DNA, 1034 bp, Homo sapiens
tatttctggaggtccactttggctcctaccctgtggaagattcacacgtgcagtgattggttgcccagaaacatcagtgaggaactggaccaaagggcatttggctgtttggagagactgcactaggacttggggattttttaggattttatatgatgactttcacaccgctaaattcagctgcttccatatgaaaaataagagatgattcaagaagcacatgggttttggatttaatggggcattgggggagtgagagggcatctgcagaaaagagccatccaggctgcagaactcttgtttccagcaaatagtccattgttgacgtggtgatagggcaagtagtttgctgatggaaaaaagagaggtctgtgccaggcttaattgtattgtgagaaaatgcagctggctaaatttggcttcccgcctttgatatgtgtaggaacagaaatcccaaagtaaagaacatggggtgagcattgtattaggctgttcttgtatcgttataaagaaatatccgagactgagtaatttatttaaagaaaaggtttagttggctaatggttctgcaggttattcaggaagcgtggtgctggaatctgcttggcatctggggaggcctcagggagtttacaatcgtggccgaaggtaaagggaaagcaggcacatcacatggccagagcaggagcaagagagcgagtaggggcagaggtgccacatgttttaaatgaccagatcacttgcgaactcagagctagagtactcttatcaccaagaggacagcccaagtcattcatgagggatctgcccccatggtccaaacacctcccacaaggctccacctccaagtttgagaatgacatttcaacatgagatctgggtggggacaaatatccaaactatatcaagcatggtgtaaatacagtctgtgtgcttccagcaaaaagtagatgctcaatcaatatttgtgggacctattctagggctgcttatatacccaggggtcaaagcaaatcccttaacaaaaattcagg

SEQ ID NO: 21629 - DNA, 1076 bp, Homo sapiens
aaattcatctatgtggacgacctggggggaagccagctaagtaaagcatggccttatcagacagcctggactgccaagtagtaggccttgagagggcgctgccagcaagaggagaccactaggagcaaaggaatggcatagtgatcactgtgtcttatgctgattagtatggccatactgttacttaccttgatggtttaagtagttccagaccatctttcaattttgttgtatgtctcaatggcttcataaattctttcttcccaagtaggcaacagtgagtttttctcaaatccctgcctgaatgattgagttgcaatgacttgctccttgagagtgcactagcaagacacaccagcaaccaaaacctgtttgtcatccaggaatagcctgcatgctaggaggaggtggtttggaacatgtgtaaaatcaaaacatttctcactgttaatttcttttcacagttcagaatctctgttctattccatgtgaaaagtaaaataactcctttgctcggatttcttgctgacatttctttttggtgggagtcaggggtgggagttcactctgaatgcttactatacctcctgctacagctctgtggcattttcataaaataccaaccaccaaaattctagtaatcacaaaaacatgtgctttctcctcatatccactgaaattctttctctcattaaaaaatagaagtctcagaaatgtaattagaaagctaaactcgatatctttacattcctttggtttcaaggcgggggaagaaagctgcagtttttctaatttcccttcagttcaatgctactcttgaatggggaaaatgatacaaaacgtctgaagaattgagagtctgacaagaggggaggatttgtatttccttgttattaaaaaagaagaaaaagccctcagttatgtctaatctttaggaacgcagtgccctgtccaacccacgaactgttggcagcatcataactctacacagaatgttcttttaagcttttccctccttcccaagcctttcctgtgaagttataaatctcagcatttagagatattcttatgcaaat

SEQ ID NO: 21630 - DNA, 1031 bp, Homo sapiens
ccagaaatgactgtccaataatgaaacaatttgaagagagaaaaatctgtaaacatttagagggacagtgaaatcataagcaataaggggaaagatttgtgaatatcaaaccctgccaagtctgaagttctcctccccccacactaagattttagaattattcgattaagtaaatgttttagaaagccaccccacatttggggatgcaattaataatgagtatagaaaagaattacggcaaactaaatatagaagggaacttccaagagcatctggttcagccatccaatgtaacagatgaagaaacagagatggaggggttaaggggtttatctcagttcaccttgttttccagcttcttctacacggaatcgtttctactgtaccatactctgctattattcacacagaggaatgacaaatctgaactgaaagtttggataacaagcataaaggagaaataaatgaaattcagatgtttggtagatgtgaaaaaccctaaagattataatgtgcaaaagaacgagggatactaagtcctaatgcctgatgccatcaatggagattggctcatggcatatatttatttatgcagttggtgaaagcataaaacacagagaactcattcatgtttctgtgccattaaaacaggagggcagctacaagctaagccttctagggagatggtggatgcatgaccttcacggggaacatctcctcttatccttcaaaaaatatttaggtgaaataaagccccaagagggtgaaaattagagcactgtccagccctaagattttaggatgttttattgccacttatttataatttttttaacattgtgttatcaaaaatgtcagacatataccaaagtagacagaatagcattaataaacctcatgtacccatcaatatcaacttcagcttcaacaatatcaacttacagtcaatcttgtttcatcaatacttccacttacctcctcccttccttagtattttaaagtgaatcccagatgatagtatgtgatttcat

SEQ ID NO: 21631 - DNA, 1029 bp, Homo sapiens
gaagtcggggattcaagaccagcctgaccaacatggagaaaccccgtctctagtaaaaacacaaaaattagccaggcgtggtggcgcatgcctgtaatcccagctactcgggagtctgaggttgcggtgagctgagatcacgccactgcactccagcctgggcaacaagagcgaaactctgtcccccggccccccgaaaaaaaaaaacaattacagcttttcaaaaaacctgcaaatatgtggtaaaacattcatcattttaaaaaaatcattagtgtctagagcattctttggatggatttttgaaatgaaattacctacatcttttaaaaaaatttcttgaaactttttgaaaacattgagatctcagctaattcatagtaagattatgctgtatctaaagtttaccagcagccccagtgacacccctgtagtgtagcgtggaggcactagttttaatgctaagaagcaaaggccaaggtagtacagattgctcccatattgccttatccaagtctgtatgtagacccattaactgcactggttttctgtatgctatgaccctagctcctatgagacatgtttttgcagaagatggctgtagtgtgtgtgtatgcatcatctgtggttttttttaaagcaaaagtgagatttaatagattcatttaactgtgacaaatccagtgtgcaactggtctctggcccaattggatccagcactcatttgatattatctcggcactgttttttatctctttgggtactggctctgtgtactgcttttgggctttattttcagccaggctttcctctcatgagggcagagttgacccccagtagctctcaactaactcatttcctcagtattgagaaaaaaaattaatagactttattttttagatgagttttaggtttgcagaaaaatttaacagaaagtacagacggtcctcaacccattttgccctattaacatattgcattagtctggcatatttgttacaactgacaagccaatattgatacattatt

SEQ ID NO: 21632 - DNA, 1075 bp, Homo sapiens
caactatttataattatagtctaattacagataaagaatctttaccaaatatatatgtatcttttcagctccatttttgcaacctaagtaaagtgaatttcttctaggttttgttttaaccacacttggaaccaagtgctctatgaaagagcgatcctcctaggtcattggtaggcacgatttttttttttttttcatgattccatgattgaaagcactgattcatagaattagagaggttctggcctatagtggaactttggctgggagaatctgcctggagcagaagaaagcaacagtaagtagtggtaggagcagtgagttcagaaaaagatgcaagtaatgatcatgagtgtcagaaatttggaaggagcacccattcacctgatactctctgttggtttaattcattgtacacgtgacatgccttctaggtggtgatggctttaggcagggatctctctgtgtgatgaggattccctgccaagccttgaggacccatttgatagggtagtgtgaatgatgagagtgagtgctggcagcgaagtcagccctcagaaaggaagtgtggcagcagcagctggtataatctgctcatagaccctggcctgctgttgggaacacaccttggttgtaaattatatctgtctagcttcttaccctttagtgaaggaagctatttggtgccaactttttcttttttattaaaatttttttttccccattggccttgctgaagcttttagaagataccagctttttcttttgtgctttggtaattgacatctcagagtcacatctgttcccctttcatgattgctccatcccgagagtggaaaggtaaagtgtagtggactgttgagccctcacttttgtgactgattctaaagcaagcaaatctgacttgaggatggatcttgaattctgcagcatgagagggttagatcagaggccaggtgagtgagtttaggcctgacccagggaacaggagatcccagaaaggccaagtgactgctataggatttagtttctgcacctgtaaaatgaagaatgtcttgggtttcttttttgaaag

SEQ ID NO: 21633 - DNA, 1163 bp, Homo sapiens
gaaaatcttaatacaagccccacagcccctgatctagaagtgtcagctgtccccctttggagcatgaactgagccctcaccagctcttcccagagcttctgtgcccctccccagcctcttgctccaagcctgcacttttggcaggaccccctcgaggcagttaattaaaaaatcagtgtttgcctttatattggaaaagagatttttgccccctctgtaagtgataagtgtttcagctgagcctggtgaggtatctggggctggaagagttgcttttactaatacatgccaagaagactgtaatgctgtcttcataaaataaggggatggggctagatgacctcatggcggtgtgtggtggttctgatgctctggccccaagaaccccttgtctccggaagggagttgcttccaaccatctgggcctctttctcagctgttttgccaaaaataaagtattggggttcaccctcagttttgtgaggccttagaagcaaatgccaaggcccatctgtccaggggccatgttctcagggaaatgctgttagctacctacatgccagggtttctcttcctctggctgcctcatttcttacactggcgagggagctgaatgaaagccttctctgcacatacaaagatctgtagactgtccgacacccttctactctttaatcatcagcattgtcatcgttgccttcatctctgacatttgtacaaatctgatggcttaccaggtaccatcaaatatatagtcatttcatttgagacacaagctccccttatggtggagctggggcaggtgtaaacttcattgttttataggaagcagaggcagaggggttaatatcaatttttttttccctaaggcctggtaaggactggggccagaactagaatccaggtcttttgctaagctatcttatgtcttgaccccccatcaatccatccatccatccatccattcacccacccatccacccatccatccatcattccatccggcagataattattaagtgctcatttcattccaaccatgtagatagctatagagtagtgaacaaaacaggatcttttccctgtccctggcagctgtcctttcagtggagattctctttctgggacatggtgctgtctttataggtaggaagaactgggga

SEQ ID NO: 21634 - DNA, 1027 bp, Homo sapiens
cattgaatggtttgggaagtctttcctcatctactttctggaagaggttgtgtaggattggcattattatttttaattaattaattaatttttagatacagggtcttgctctgtcacccaggctggagtgcaccttggctcactgcagcctcgatctcctgggctcaagtgatcctcctgcctcagcctcccaagtagctgggactacaggtgtgcaccactgtgcccagctaactttttgttttttaaatttttgtagagacagagtcttgctatgttgcctaggctgatcctctacttctgtgctcaagcaatcctcccacctcacctcccaaagtgctgggattacaggtgtgagccactgtgcccagacgcaggctggtcttacatgcctaggcccaaatgattctcctgccttagcttcccatgtagctgggattacaggtgtgtgccactgcatctggtaattttggtagtttgtctttcaataaattttctcatttaattggatgtactggcataaggctattcataatattttcttatcattttaacatctggaatctgtaataaagctccctctttcattcctcatatgagtaatttgtatgttctctctttcattcttgatcaatctagatagaaatttaatcatttgtactactctttagaaaatagcctttgatcaggccaggcgcggtggctcatgcctgtaatcccagcactttgggaggctgaggcaggcagatcatgaggtcaggagatccagaccatcctggctatcatggtgaaaccccgtctctactaaaaatacaaaaaattagccaggtgcagtggcgggcgcctgtagtcccagctactcgggaggctgaggcaggagaatggcgtgaaccgggaggcggagcttgcagtgagcctgggcgaaagagcgagactccatctcaaaaaaaaaaaaaaaaaaagaggccgggcgcggtggctcacgcctgtaatcccagcactttgggaggccgagacgggcggatca

SEQ ID NO: 21635 - DNA, 1064 bp, Homo sapiens
gggattggggtggaagtatggacagatgaaaaccatcgggcttgtgggatgttattggctacaggtaaaagaacagtgtactaacgatggctttaaaaacaaggtgtttcaactcagccagaagtctaaaggtaggagctctagggttggttcattcagggagtcagcgatcatttcaaggactctgtctaacctaggctgccatcttcagcacattggcctttgttctcaggccagtccccttatggtcatagcatggctgccactgctccgggcatcatgttctcacataactgcgtccaaaggcaggcaggaaggttagattctccttgtctgtcttaatttgtcaggaagggaagcctttcccagaattcccctgctgaagattctatcaaggctccttgaagagaaacgggtcagtacccatgcctccgctccagtggaggaggagaaagcaagtccctggtgctttcgcctcatctagagcaagaggcaagctgtgtttgcaaggaagtggggaagggagcaatggttggctaagcaaagaggaacatttacttcaccaagtttcaagatgtttttatttattgggggggagttagtgaattagctttacttttttttatatctcaatattgttgaggtttttgtttgtttgtttgtttttttaaaatctcaccccctagttctggcaaccaccaacctggtttatatcactataggtttgccatttctggtaattattacttcttaagccacaggtaatgctggtgcataggatcccaggtgttccatggatgccttttttgtggtcccaggacatgggttctgtggtctgttctcccagcagctcctccactttcccgacactggggccaggtggagaaccccagtaggcagaattgtccagagggagggagcatatgtcactggtggcctaggcagcaggactggaaaggcctgagggcctgaggctccagtgggttggtagaggatggcagtcacctttgcaggcagctgtgggttggggagaggaattggtgctcagctgtggcctgcacatt

SEQ ID NO: 21636 - DNA, 1052 bp, Homo sapiens
tctgggatcttgggagacagtttcaactatggtatctactcagtttccctatgggaccccactctggcctgcagctcctctgccctgtacagaagggtctcctgttctaaggttttttttgttttgttttgttttgttttttggacagattcttactctgtcacccaggctggagtgcagtggcgcgatcttgactcactgcaacctccacctcctgggttcaagcaattctcctgcctcagtctcctgaatagctgggattataggtgcacaccaccacacctggctaatttttgtattttcagtagagacagggtttggccatgttggccaggctggtcttgaactcctaacttcaggtgatctgcctgcctcagccttccaaagtgctgggattacaggcgtgagccaccgtgcctggccctgttctaaggtttttgctgtctctgttttctccttggttggcctgtgcctgacacagtaagatttgggacccctgagattgagtggggtggggtcttcccaggtgcttccctcttgcttgtggtctctggccctgttccccgccccagccatcagcaccagtcccctaccccctcaaaaggctcaaagacttcctgagaacccggaatctcagtttcatctctgctggagatttttgatctgggggaaaggctgctctctatatggctgctttcagaccacacttggctctcccttggtttagccaaattggggttttcctcattttcaggagccagcttttctgaagtgttccttcctggcagctgcattccccatggtcctgtctatcttaggggcaaggacttaggcatcgggtgtcctagaggctagaagattgttctacagagaaaagtggttttgtggccgtaggtggtacccagacgtgttgcctgccacctgggtgcaagcaggaccggacctctgtgggtggtggagggagcttcccatgtgtggatggaggccttgctggggaagggtagatgagtacagctccgtgtcacagcccggggacagccccacctgctgca

SEQ ID NO: 21637 - DNA, 1022 bp, Homo sapiens
gaccatgtgatccgcctgcctcggcctcccaaagtgctgggattacaggcatgagccactgtgcccagccaacctggggcagttcttaagtctctgtatttcatgacattggcctttttttaaagagtgaccagttatttttgtagaaggtccctcagcgtcggtttctctggcatttcttcatgattggacttgggttataggcactgtagtgatgtgaccttcccagtgcaccatgtcaggaggtacgtgctgttctttaatcccctgcctggtgatgttaactatgattacctggcaaaggtggtgactgccaagtttctccactgtaaagttacaagttttccctttgtaattaagaaatatctttggggagatatttagaggctacgccaatgttctgtttttcttcaaaactttcatccactgacttccattgatgattcttgcttgaaacaattgttcttatggtggttgccaaatgattttctaattccatcattccttctaaatgtactagttgtcttttatcataagggaaagcctttcattgacttttaactcactgctctaagcctcaggacctcagcatttgggaactaggagagcaggtccttgtcccagaatacacgggctgtctcctagctgagtggtgtttaatgtgaaggttatcagcgtcctgctacaagtcccttgtattttggaaggttctagacaaagaaactatctgctggggagccatgtcccaagatggctgggctgggggttccactatgcatgaagccttgaggagtcctctctgtgataacgtctcaccatggccccatcagttccaccagccctggctcaaaaacgtggcccaggggaggccctactccagctaactccgtttcacatttcctctccttcccaggatggaaaaacagcccttcagggacaagcgaacctgtcagtaattaagtcatgagtggaggaggcagtcccagaagggtggctgggctgtgaggcctaatggagtgagg

SEQ ID NO: 21638 - DNA, 1044 bp, Homo sapiens
tttactaatctctagtaatttaatcttggattattaagtcactactactataaaattcttatttaaattacattttaaaattaaatatcttctcttccaaggattatttctggcttttgattccattgtataaccaaaattataatgacttattttaacttaacttaataagtctacctggttgtagtttcagttttcccttctgtttcttctataccatggtttcctcagagttaaatcataaattttgttggccataacatgcattcggaaagttctttttattttttattatttttaattgtagttttaaaataacataaaatatactatttcaagcatttctaagtgtacagttcaatagtgtagagtcacattctcatgcaaccagtctctaaaacttcttcatcttgcaagactgaaactctctacctattaaccccccatgtcccctgctccccagctccttgtaaccaccattctactgtcgtttctgtttatgggtttggctactttagatacctgcataagtgaaatcatgcagtattgtctttttgtgactggcttatttcactttgcataatgtgctgagggttcattcacgttgcagcatgtgtcagaatttctttctgtttttaaggctgaatagtattccactgtatgtatatatcacgtattgttgatccattcatctgtgggtggatgcctgggttgctcccacctcttgtcagtaatgctacatactgacatctctttgaaatcctgatttcatttcctttggatatatacccagaagtggaattgctggatcatatagtaattctgtttttgatttttcgaagaatcaccatactattttgttttttgagatggagtctcactctgtcccccaggctggggtgcagtggcatgatctcagctcactgccacctccgcctcccgggatcaagcagttctcctgcctcagcctcccgagtagcttggattacaggcacccaccaccacacctggctaattttttatatttttagtagaggcggggtt

SEQ ID NO: 21639 - DNA, 1046 bp, Homo sapiens
tactgctccatcctcaccccagcctcttcacgttgccttgtagtagtgttcagtaacggtagcagcacatctcactgcatggacgcctccatctcaatcgagtgcctcgtgtgttcttttctcttttaactcagacagcactttgaagattatcatccccatttttcagaggagagcagagaggtcaggcaacttgctcagggccacacagccaccaagcggtagaatcagtcctggaatccagatctgaccaccccatttcactgccttgcaggcagagcaggggctactctgtttgttttcttggtgcataactcagcacctatatggtaggatcccagtagatcttggtggaattgattccatttttgccccaactaacatgccaatcagagatccttcttccagagatgaaaaagaagaattttcaatgtgtgcttttcttgtttaagaacaaatagtttctgccgaggtggttttcaaagtgattgaagaagattattggtcatctgtagctgcaggagtctccttgctctgctatttacaactcatatttgcttagcaagctcctttttattttttaaatatttttgaatttctatttttagttttactgtggtaaggatactgaatatggatctaccctcttcacaggtttctaaggataaagtacagtattgtatccatagccataatgttgtgcagatctccagaacatatgcatcttgcataacttaaactttcacccattgattagcgactccccatctgcacttccccctagcctctggcaaccactattcgttgcttctttgaatttgactattttagatacctcatgtaaatggaattatgcagtattcgttcttctgtgactggcttatttcatttagtaatgtcatcagagttcatccatgttgttgtatattgcagtttccttctttgtaaaggctgaatagtattccatcgtatgtatataccactttaaaatttttttcttggaggttaatatttgtacatatttatggggtacatgtgatattttg

SEQ ID NO: 21640 - DNA, 1022 bp, Homo sapiens
gtggtggtgcgtgcctgtagtcccagctcctcaggaggctgaggcaggagaatcgcttgaacccgggaagcagaggttgcagtgagccgagatcacgctactgcattccagcctggtgacagagcaagactccgtctcaaaaaaaaaaaaaaaaaaaaattatgagctccaaccagcaaaataagaattagctaatgtgggaaattaatatcattccgtaaaggagagagcacagatccaggactctccagcaccttccatttccacttagacctgctgtctgtctgggttgtgcaagccacttaactactgagcctcagtttctctaccaattaagcagatatgataatacctgtggcctttccctgtctccacaggagtgtcatgagggtaaaaggaatggtgcatacaaagcatgttgagatcttcagggaagatacatgtttataaagatagaaacatcataacaataataacaccttacgtttgaatcaagctttgcacttatcaaagctctttcacatacgttatttcaattgactctccaaacaatcctaggcagatactatccctgttctcaggtgaggaagctgagatgcagagtgattaagtggcatgccaggggctggtcttagtgtgtagcaggtcttctgactccaagcctgatgcccatttttgatgatagcctttcttggatagattatctacttccctgcctccctgaacggagacctagacataattggcccttttcttgatgactcgtcattaccataggcacagtccctgggctgtcctccaggtttggctgtaggtacaggtccaggtcccgcagaggcacagggtggatgggccagctgtcccggagggtactcctgacgtgtaggtggcaaccatcctagagccctgcaggtgtggttcttctgactctgcctcattcttccccctgtcccctttgtctccactgtcagcatgtgtgcccatttctgtggcttcctccgccaccacggcctttacccgtc

SEQ ID NO: 21641 - DNA, 1055 bp, Homo sapiens
acccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcc

SEQ ID NO: 21642 - DNA, 1074 bp, Homo sapiens
tacataaaatttatctggatactcacacgtagaagtttttcttttggtatggaaaggggtcagaagattctccaggttttgaggggccctgaagcttacacaatttgcaagagtgtctccttcaggaaaataatacagaattactgatcataattcggtgctgggtcctggtagaggcccaggctgtaatgtgtccagaggcacaaggctcagctccacactctaccctctttcgttgtgattaaaggtccacaggcgtcctgggcaaatatcagtttcttgagtctcagagacccttgagactgtcacaggcttgagttggcactttgcaaacctgagtgtctcccgcgcccatcctgccctggcccatgttttggccgtgacactgtgttgccaggcaaccatctatcctataggaattcacactcattcttccagcagacacatttaatttcaggcccagagtgcttggtgacgcggggtgacaccagcctgcgccctcacagaaatagcctgaaggactgagtcaaaagtagctgggggaactgatccccacatttgatcttcttcccctaaaatagcttggtcctgtttatggggctgctctgagaggggacgtgggcgtggggctgtgctcacagcttcctccctcctgctgggtgcttgcttttctgtggccatcaggagagacatccgtagtgactcagggccctggacatgatgtaacacccctggctcccagggtggtggggaatgcgtgactgccttggaattccaggcgggacccttggtgcctgcctgccagttcttgactaaggtcaggtgcggctgagagctgcgctcaccagccttggggtggaggctgggagggtgtcctggccccgagccagacctcccactgacaacaggcccagtcctgagccccgtggggacacccttccatcccattctctagagcagtggttctcagcctcggctccatgctggaaccacctagggtgctttaaaatatcctgattctgatgtaaccgtgagattctagtgtgcagccaaggttgagagccaagggactcc

SEQ ID NO: 21643 - DNA, 1170 bp, Homo sapiens
tctccgtttccaaaccgagagaatttggtttgacacctctcacccatcatatcctagccccgacaggcgatgactcttcccctttgtctccgccaacaccctaaacactgggcaggagccaagggctgaggaacttggcgcgcgggcggccgcggccgccagctgggggcgggaccgaacgtcctgtgggcggggcgcggcggcggcggcgggattggctggggcgggcgggtgcgcagtccgctgggcagaggcttgggccgccgagctggacccggaccggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagagtaggcagcgggtgaggctggacgggagggaggtctagggaggcctctgccgcgggcactgtgagtcctggccgatgatgacgagaccactgcgcaatctgagttctgggaaccaggtgatggagtatgttctgagaacagactgaggccgggcaagcaggaggcggccgcggcaggggagaggcggagagcccctcgataccagggctcggagggccgggctgcctagcgagggcttcttttgagtgcgtaggggtggtgggtggcatggacggtttctctgagtcgtcagcgaatgccccccctagaatcctgcttttcaaacactttggtgacactcttgcaatgttggggtgtttttaaatccaaatttgtattatgaaaacttacaaacttacagaaaagtgggaagacttgtacagtggacacatatcgacccaattgttaacattttgctatattgctatccacctgttcttccatcaaaccatcttatctttttaatgcagaccttagtactctacacccatgaacacatcagcacacattattcatttacagttctttttaaggcaaaatatccacgcaatcaaatgtacaaatcttagacaagcttcacaaatgctcatgtataggccgggcgccgtggct

SEQ ID NO: 21644 - DNA, 1030 bp, Homo sapiens
tattatcatgaacctatcacaaggcatatgtatgtaaaatgtgaaatggcaggaggctctgggaaaaaaagtcatctttgtagcacttaagggcccttgtatttctccacattagttagatgtgacagtagacttcactacctaaagggtttgaagaaattttagagagtataaaaatgggaaaagaaagtgaaatattacctatattatcacaattcaacagcaaaaggcatgtatacttttaatcaattaaagtatataaggtggtcatttcacagaaatcctcctgtgaatgctttggtgagtttaacaacttcaaatttacatttttaaaggtcagtacaaagctataaaaagcccagagcgcccaagcaatggtttgctttaacaagtaacttgtctttatcacacatgtgagttcaaatgtaggagggcaggactgattgttcaccatttcttctgagcattgtataggtagaaacaacataaagctatagctcatgaaaaaaatattttgctagaactgcgagacactgaaattgattactgaggaagattcagaatctgactgtacatattttgagagaatagttgggcttaacctccattatattttccctttgtccttgatccattaaacctgcagtatgatgtggcatatattttttaacctgaattctcataaacagtggggttgccaatttatgagcagttatagttctccctctaatgtgtgtctcagatattcgaaactaaacaagactttctaaacttgcacttttgtataaattatcagccctccataaaaatccatataatgggtccaggttcagatatctcagtggcttctgtcatcaaactcttcccattcagcagctgactatgagcatcctaactggatcctttctgtcagcgccacccacaaccccattgttgtatacatgttggtgagtagagagactcactctgcctgccccattctgcggcctgtgtctttaacaatcgactgtgtttctgtcattgcccttag

SEQ ID NO: 21645 - DNA, 1033 bp, Homo sapiens
gctggtctcgaactgctgaactcaaacaatctgcctgcctcggcctcccaaagtgctgggattacaggggtgagccactgcacccggcctggacttgtaattctttatagttgctttactttttgaaaaaatgttaatatctttaatctgtttgaaaggttttgctaactgtagtggcaaatccttctacctattctttttcaaaatttcttggattttctcacatgtgctctttcaaatatatatttaagctgagtctaaagctccataaagttcaaggctgcagtgagctatgattgtgccactgcactctagcctgagctcagaatgagatcttgtctctaaaaaaataaaaatgtaagctctgtaaatattcttggaatttttgttggaattgccttagaactgtggattgtttgaggggaaactgaaatgtttactgttgactattcccatccagaaatgggtatttctatccatatatttaggacttctttatgtctgttagtttctgtgttggtgtattcctaggtattttataatttgtattagtattgtaaatagaatcttttatcctattacatatcttaacttattattgctgatataatcagccactttgctgaagtcttcttattagttctagtatttttttcagttgattgtctcagattttctaggtggcagttatatcatctgcagctttagaccttcgttgtaaatgggcccaaaataatgctgcttttttattctaagaaaaacaattcagtggagtcatgaagtgaaaagtatagcaaaaaattactctttaagggcaggtgcagtggctcacgcctgtaatcccaacactttgggaggccgaggtgggcggatcacaaggtcaggagttcgagaccagcctggccaacatggtgaaaccctgtctctactaaagatacaaaaaatcagctgggtatggtggcgcacacctgtaatcccagctactcgggaggctggggcaggagaatcacttgaaaccgggaggcagaggttg

SEQ ID NO: 21646 - DNA, 1051 bp, Homo sapiens
cccattacatttctattttatgtttgttagccaaatcacatttcccacctcagaaaaacgtaattttgattaaaagagattaacaaaatcccaacatattcataacttttatctttgtaaaaatagcataattcatttctaatcttctttaaattattgtgattgttagaggaattacatacatacttctggaacctgctcccccaccaaaaaaagtcttaattctggtgggagattatccagaattatcattaaaatttttgtcaataaagtcaaattaagagatttttttttctcattttttaatcagttttaatttgtttttgtttttgagacagagtctcactttgtcacccaggctggagtggagtgcagcagtatgatcttggctcactgcaacctctgcctcccaggttcaagtaattcttgtgcctcaacctccctagtagctggaattacaggtgcacgccaccatgcctgctaatttttgtatttttagtagagatgggatttcaccatgttggctgggctggtcttgaactcctgactccaagtgatcagcctgcctcagcctcccaaagtgctgggatttacaggcgtgagccactgcatctggcctgttctcctttttttaatgaattttcattccaaatagttgtagcacctacaaacattataagtgggaagagtactgaaatggcaaggactgactcaagttcttgaatgagtcgcgtgatccccatgaatgtgtttcctcatgtgtaaaatgggaatagcaggacctatcaaagagctattggagaaaccaatgtgacagttctttggaaaattatcagcaatattatacacacacacacacacacacacacacacacatatgctgttttcacttaatctgagttttcttattcctctaatccattattatttttctcaatccttataatattttccccatgcccaattaacacattcttccacgtgtagaaattcagtctcctgtcgccttgtctagtggctttcaaactttaatgtgtgtaagaaatacctg

SEQ ID NO: 21647 - DNA, 1046 bp, Homo sapiens
aactgtaatagtagtgccaaatttaagataccaatgagaaagttaaacctaagatcagtttgacagcaatgaggatccactggccctcatgtctgcctgacctgtgttctagaacctgcgtttcttctttttttcctccttctctcccttccttctttgctttctcttttgaaatctggattgattatctgaattaggtaacaatatactgtgtctaaaatgactttttgttagccattccacaatttatacatatttcaaaacatgttgtacatgataaatacagttgacccttgaacaacacaggtgtgaaggtccatttatactcagattttcctgtgcttctgccacccctgagacaggaagaccaacccctcctcctcctcctcctcctcctcctctttatgattttgttaataacattttcttttttctagattactttattgtaagaatacagtatagaattcatatggcatacaaaatagtgttagtcagccaggcacagtgactcatacctttaatcctaacactttgggaggctgaagcgggtggatcacttgaggtcaggagttcgagaccagcctggccaacatggcgaaaccctatctctactaaaaatacaaaaactagccaggcatggtggcgggcatgtaaaatcccatctactctggaggctgaggcaggagaattgcttgaaccctcggtggaggggcagaggttgcagcgagccgagatcgtaccacttcactgcagcatgggtgaaagagcaaaactccaagtcaaaaaagaaaaaaaattgttagtcaatctgtgtgttactggtaaggcttctggtcagtaataggccattagtagttaagtttttggaaaatcatatgtaaatttttgatttgattttctaacacccacattgttcaagggtcaactgtatatccaatttttgccaattaaaaaataatattaaataagtaaaagtaacttcactttttcctgatgcttcaggtgtctcatcttttgtgtgattttactgtaattttcttctc

SEQ ID NO: 21648 - DNA, 1050 bp, Homo sapiens
aaatcctagagagatttgatttgtatcttatcactgaagattccatagaatatattgatttaggttcatttttaaattttagaaatgtaatacatagattgccttttgtatatgaataattgatctatcgtctaacttttaattctgtgttattcagtgttttgttatttaataataactttccttcttcaaggagacaaaacaactagagattaaaagtggggtatggaaaaataatacattggtatattataattcataattaggagatagcttgaaaacctaatgtttctgcattatagagatttgatatatggaggctatgttttttaattgagacagggcttttgattcttatcaaaactgattgtcttacaatttagacaaatgtaatacggaattaataatatctttaaatgttttcttcaattgtgcttgggtttctcataaaatattttttacaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacaggtacaaatgataagcaatgtacttttagcattaatttttatgtaggatgcctgttcattacatgaattttttaataaatgtaaaataacataagtcaagatgctttttcctaataacttcttattttgggtcttgtcaactttaaaaattatgtgaaaggataactgtatgctatgaatagtatttttaagaagatgtatagttggaagtaattttaactcttattattgatgtttatataacagggaaaagtggaaaacaaagtttaaaagtgagaaaatgggaaactgtactgtaaaagatgccaggtctttaaaattttaagtttaaatgaattacgaagaaatatgttgttttctaatgcactaatgataattgaaagaggcttctgtaacatttgatcaacataattaaaaactga

SEQ ID NO: 21649 - DNA, 1029 bp, Homo sapiens
ttctgttttattcagtaataattggacattttaaatattattttgttttgcctcttttaaactcttggagaaaatatagctaaaatatactattacttgtttttaactttcctgagcagcctatagtttattctttgacacatttcttcaaggtcaccaatttactataagcattgatatttaatgtactacagatataaaaattataggtgtagaagattgagctagatatattgccatgaataactgccctaggaatgtcatttttagacttttttgaaaatattgcctttatacaagatgtggtacagaaaaaacgtcaattaactgagggctttattaaagatattatggaactatgaatgtatataaaacctttaacaataaatttgataaatttttaagcactagatagttaaatttatcctagttataacttcatttacatttgtgctccaatattatttcaatttagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtgtgagtgggttcttattcattctacctactaaccaaaagtacatacatttcttaatgttcagtgagttcgctgtgtgattctgaaagattcatgacttttgttggaggtatagttatatttagtcagtaatctgtctaggacagctaaaattaggtgctgctattccataataagtgttaagattttgatgacatgtagctcaatgctctgtgcacttttcatttgcacagagcattgttcctgttcatctgcacagagcattcatctgtgcagagttttcgtctgacacagtgcattggttcccattttagaaagccatacccagctgggcacagtggagcgcccctgtagtcccagctgtttgggagactgagctgagaagattgcttgaacccaggag

SEQ ID NO: 21650 - DNA, 1125 bp, Homo sapiens
tcttcttgttagaaatttctcaaattgtggtttcagggctctaacagtttagagtaggtgtgcttctctaatgattctaggaggactaactgtatttagagaaaatggtttttggttggttctaagtctgagaaaactgaagaagtgaaatttcctccaactttgctgtcgtgtgcaatgtggcactcaaatgtcttgagcagagccatgcagctcattgttggctgcatgcagctggggctggctgtatgactggcctcccgtgatatgactcaggctgggcctgcgagtatgctagtgaaactgggtcatttgcttcagctaaatagaagactaccctgaaatgcctaacctttggagacagttcttcacatagaaaaaccacaagaagtataagttttacaggttctcttatttgaagagtcaacccagaagtgagaccaggtgctctaaacctgtgacatacaaaacctgtgaaattaaccatttgtctgtatctctgcttcccggctccttttctcccacaccacgggcccttatttcagtgactgaattataacaccatctaagtgacttgcaaaaaaaaaaattacaggagtgtgtgtgtgtgtgtgtgtgtgtgtgtgtgtgtatttgtgtataattagttttgttttctctagagtatgttatgattaatactataggtatgtaagaaatgtaaaaccgtattatttttaatccatcctctaggcactagtttaagattgcttacgatacagcctttttctaatgtgtcttaattagcatatcatactctttgaattgcataattaatataacacgtttaactggaagatatttaaactagtaaccatttaaggtattttatcctagttaagcagccatcgagaagttttgtcacaaagcagtaagagatagaaaaaattatttactacagaactatttaattttttatgtttttgcgatagggtcttgctctgtcacccaggctggatggcagtagtgcagttagggctcactgcagcctcagcctcctgggctcaagcaatcctcccacctcaaccgccagaatagctgggaaggcacctgccatcaagcctagctaatttttaaatttttgta

SEQ ID NO: 21651 - DNA, 1034 bp, Homo sapiens
gtctttttgagagcagggatttttgacttatttatctctgtgcttttccatgacatctagcagcagctgctgtgcaataactatgtgttgaattggatgatgtggaacagaaagtgcagagagccttttctttcgctgttttgcccttgtctttgccattccctcataactgattgtcttaagacccctgcattgcagcctcaaggctgtgttcatgaacctttagatgtggagcattcattagtaacttgcattcttcctttgcaaaaggaagttttgctcagttttgcattcttcctttggttttggtgagtgaagttgtgtagatataactcattctccttccttgccttctctgtattatcagtgttctaacccatcctggacttatctcagctttatcctttcctttattcccgttccttttgactgtagaccatgataactcatttgtgacagattgacattttgggatgggtaattctttcttgttggaggactggagtctatatagtaggatgctgagcatcatttctgtcttctacctacatcacatcatgctggtagtagcctcctctttccagttgtgacaatcagatgtctttagacgttgtcaaatttcccttaagaggcaaaaattgcccccggtttaaaaccactgcttttgaaaaaaaaaaaaaaaaagcttgaaatagcaggaatcctgcatcctctatcctatccctcttttcccttccctacccttgttttttaatctcactcttcctcaggacagtgaagccattaccaacccttagcccctccacccattttggcagagttagttcttacattctttttatgctcacattttttttgttcatacgtttcccaaaacacttttccctttgtatggggtattttttgttctttatatttgtcttccctactagattttaaacttcttcaggacagcagttcagtttttcatctttttatttccaatactcaatgtagtataactatattgcattgtagtataactacacatagag

SEQ ID NO: 21652 - DNA, 1027 bp, Homo sapiens
gaacaggattaatgagcagttctgtgaagggggagctcaggctgcgtggactatttttccattcatatttttatttaaaatacctgtcatctctgatatttcatattgggtgtgtacactgaaatgctgagtaaagcagagagtctgtcatgtcctcttttttttttagaataaagagaaccgaaagacccatcctgtaaacctgtgtaacgggtgatccgcataacagccagataggtgggatcagatgacacaaatgcgttccatatttacactgcagtttccagaataaggttgacactcctttaatttcaaacctctgatagtatggtccttcttcattcagatagaatctcacattaaaatatatcacacagacaatgcactcttgactttaaagataaccaaatgcagaattagacttcatctgttgggactaccagatcaattgctttgacttcattgcctggtcaattcagtccaatagctagcttaaatgatttttttttctgcctgctgaatttgccagctacttcacttactgtgtaactgtggagctaccaccatgtccaggggctgtaccgggcactttggggagttacacagaattgtcaggcatgtttcaaatctgtgcagagttcataatataaaactaattagtaaggcctggcaaaatgtgatttagtattaagggcctggaataaatggggtttgctgttgattatttttgtttcactagaagtcaatgagtgctatcgtagttaagagaataccatgtgggaagacaagaattgaacagagaggagggaggagactgcaccaatggggaaagggctagaggagaaaccttagcaaaatactagaataaaataaaggaacagacctttagggaccagcttggaaattagcctgacttcaggagcattggtgttgaaaagagtgagttgaaaattagggaactagattatggagggcctagaatcttaagccaaggtgtttagagtttttcctagaggtggtagagaag

SEQ ID NO: 21653 - DNA, 1059 bp, Homo sapiens
ggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgc

SEQ ID NO: 21654 - DNA, 1059 bp, Homo sapiens
taaattgtataaataggtagaaagacagatagatagatcgataggtatcttaggtttgcgtattgttttcacataagtggcatcacactgcatgcatcattccaaagctccttctttcctttgatagtatgcctacccagcttctacatataaatgaggttcttgcaacccacatttattgcatagtgtcctatggcatgactattttcatttatttagccatttctgttttgatgggcaattaggctgtttaccatttttggttgtttgcattatttgctaagcagtgatgagtgaacatccttgtacacacctccctgtgtacccatgggaatgtttcctagggtggacaccgagaagcaaaatgagaggtcatggagatgcacatactgtaattttgataggcactaccacactgtcttcgaaattggctccccatcagcagtggaggagagagctcctatttccctgacacttgccagaagttaatatattagccattttacttttttttgcatagttgctggatttaaaaataacattttgtggttgctttattttgttatatttttatgatttctaatgaaccttgatataatcatatacttgctggtcatatatatttccttttctgagaatgtcctgttcatatccttgtttggcattgttttttatatattctggatgcaaatttttgctttacaaattacaaatgtggtctcagttctccagttaaaaggcataaagtgattgaatggttaaagaaacaagacccatctatatgttgccttcaggaaacccacttcacccataaagacacacatcgactgaaagtgaaagagtagaaaaaatatttcatgcaattggaaaccaaagaagagtgggagtaactatacttatatcagataaaatagactacaaatcaaagactgtgaacaaagatgaggagggtcactacgtaatgagaaaagggtcaatacagcaaggggatataacaattataaatatctatgtgcccaacactagagctcccaggtatataaagcaaacattaataga

SEQ ID NO: 21655 - DNA, 1027 bp, Homo sapiens
ccggtggcccagaggaatgaaatagttatccaaatcaaataactcttgagagtgaaagcccacacatgcctcctggttcctgccccagtgctccgcttattgtacagtgctacctctgcatgagagcggtcccacattgacaaataggatggtggcaatcctttagcaatgagcagggactggggtttatctcttaacattttcagctgtaaaattagtcacaagcattttcagtgtcccattagtacatagtcacatatggtcggttgcttcgtgaaggtggcctgtcttgaaatactagggctcatacgggatttttgccctaggaaaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatag

SEQ ID NO: 21656 - DNA, 1052 bp, Homo sapiens
atattactaactcttctctgcccacttctcttttgtccactctcctagacattcccaccaactgttccagtgatttgggcaaaaatacgcagccatttcccaaaacttcacatgtgcagctatcatggctgtccctccctagacttggaggtgactctcacttaatttttacctgcccaacaatgttccatctaccatctaaaaggtaatataagaagaagttttgaaacccactttaggaaaaccatcttctttaaatccttcaattatctgaggcctctatatgtcaaaactatttttcagttgcaggggattgggcaaacttgttctttcttatacttgggttcaaagacccattctccagtttcatatttcccaaaccaaaatgcttgacataaagccaaatcaactgccaagcacactttattttgcataggagtatgcagcctagggaaccttggttgaaaagcagcagtctgctatgcaaaatattggaaatcactgacagtgtagcattcatattatctgtcaatgagggtatattgggaacgtgctctcgtgaataataaaaagcaacatatttttatttggccttataaattaggttgtggtaatgtaaactttgatatatagtctttttatttttctcttattaatctgccaaagatgggaacagatacaagaatttttcaaattggcttttgtaagacaattgatgattgtaatagtgtttaatcttccagaaagctttatatgttgttccacaataaaattgatatttgtttcagcaaagttttcctgacactcacaaacccacaaactgttcctcttaatgcagatattgtagaatctacaaagttcaaatccatttttgatccaaagaaagtagaggagtatttgagacatgagtgtacccagccctttttttaatcacaggcaatgcatgggtctggctggttacactttgccaagaagacttgtcttatgaaacccaaggtatattttgttatgccattttatgtccttttcttttaacattgtggaaagtggta

SEQ ID NO: 21657 - DNA, 1089 bp, Homo sapiens
gttcctcaaatcatgcatactaagaggtagaaaggctgcccttgcagataaagacaagggcaggtggccacattttaaagtgagacagagtaaaataccctggaaagaactgataatgttttctaaatgctttctaaagacaacctgtaaacacatattggagaaaaagcagcaaggtactctccaactgggcatatcctgaggaaccaacaaacagtgttcatgaaggacccgtgtccatcagggtgggtttcacaatgcagctggctgtccctggaaggatgcagggatgagaaggagcctctccgatgttaaccagtgccacatctcgtgggcagatctggccagagtgagcccaaaacacatcactcactggcctagcttacgtaccctcagagcagctgttcaatgaacagtcttcagcaagaactactaaaagacagagaaactagatttttaaacagcaaaaacttcattaatttagcatgtacaatagttcaaatgtccgatttgtacatgattttttgaaagaaaagtttgaaatatgtagcaaatgcttactttgtatcagatcatgaaccctgtgccaatgatgaattaaaaagctcacgtatattgaacttttgtcatgttaatgcctctcaggattatcgcatttaattttcacaaggatctaagagttgagttctgttaccatccccattttctagctgaggcttagttaagtaagtaaactgcctgaaccagagcagggaagccaacaccatcagagaaaggaacccatacgcctatccacgctgcatccgggaaagaacagaattatttcatgagcatcccttacttatagcttcactaaaagcagttacaagctaaacagttaaactataatttgcaaagcatatttgagatttagactttccatcacatgattacacttctcatctatttctgtatctattctctacatttctgcaatgcaatgtaactacatgaaaccatttcctgatataactcactgtcttagttaactggtcaattctatgaaaccagtgcaagtctcaaaacgtccacactggctaccaagcaaca

SEQ ID NO: 21658 - DNA, 1033 bp, Homo sapiens
tgcaaaatattctgcaatttattactgatatcctcagtttttaaaaaccccctttttaagcccataaatatttatatgctttaaaaaatgagagtagggaatcaaatcatttggtactatgggaagctgctaaaataatatttgatagtaaaagtatgtaatgtgctatctcacctagtagtaaactaaaaataaactgaaactttatggaatctgaagttattttccttgattaaatagaattaataaaccaatatgaggaaacatgaaaccatgcaatctactatcaactttgaaaaagtgattgaacgaaccacttagctttcagatgatgaacactgataagtcatttgtcattactataaattttaaaatctgttaataagatggcctatagggaggaaaaaggggcctctgggaaattatgctgaagatcaccgaaaggaaaatgtaactgtaattttataatacaataccatttgaactgaaatacaacatgctttgtaattctattgccctggattgagactggattaaaacgttccctttcaaccataatgtacataaccagttgaataataggacttttattattattaaaaaattttttttgagctggtgtctcactctgttgctcaggttggagtgcagtgccacgatctcggctcactggaacctccacctcccaggttcaagcgatttccagctaatttttgtatttttagtagagatggggtttcaccatgttggccgggctggtctcctgacctcaagtgatccacctgccttggcctcccaaagtgctaggatgacaggcatgagccaccatgcccggcctatttttaaatttttcttaagacagagtcttgctctgtcacccaggctggagtgcagtggcgcaatctcggctcactgtaacctccatctcccaggttcaagcgattcttctgcttcagcttctcaaataggtgggattacgggtgcccaccaccaagcccggctaatttttaatttatggtagagacagggtttc

SEQ ID NO: 21659 - DNA, 1033 bp, Homo sapiens
cgctgccactgctcctccgccttcaaccgcttgcgatgcttctggatctgcaagggggagagatggggagggatgaaaataagatccacaccagggaggaggcctggccagacggttgacagaaatgaacactgatgaactcccctgacacctgccccattttgatgcaggcagttctgtccccacttgtgtgtgtgtgtgtgtgtgtgtgtgtgtgtgtgtatgtgtgtctatatctttttttttgtttttgagacagtctcgctctgtcacccagacttgagtgcaatggcacgatcttggctcactgcaacctctgcctcccaggttcaagcgatcctcctgcctcagcctcctgagtaactggggttacaggcacgcactgccacacccgtctaatttttgtatttttagtggagacagaatttcaccatgttggccaggctggtcctgacctcaagtgatctgcctgcctcggcctccaaaagttctgggattacaggcatgaaccacagtgcttggctatatctatctatctatctatctatctatctatatcgacatatatatatgatgatataaatctatatccatctctctatatctatacatagattgattgatcaatcgatctacctacctacctacctggagatatatattgaagccaagggaaggttatttaacttttccaaggtcacacagctagaaaatgcaaagccaagattcccactcctctgaagctagtgcccttttctagttcagaccagatgggtacagtcaaagagaaaattcagtagggcctctttcctgggttgttactgcatactgttggcactgcaaaagggagacccgagggatactgaaggttgcctcagtagcctctactctctccttctttctaatggaaattgattgtattcagattgccccccccaacccctcacagccacatttctcatgggcggtgggcaggttgatttcccttgctaaactagtccagaatgggcaagtgacctaattttggcacgtg

SEQ ID NO: 21660 - DNA, 1174 bp, Homo sapiens
ggggttcctggtgcaaatctatgtccttgttccagtatcttcctgaggcctggcttcttcttggacaacaggaggtgtttaaataaatttacttttttcttttttttcttttaagttacaggatacctgtgcagaacgtgcaggtttgttacatgggtatacgtgtgccatggtggtttgctgcacctattgacccatcctctaggttccctcccctcgtctcccactcctcaaatttaattttttcttaagctagctttggttgttctccaatacttgtaatcaaaagagttttaaccaagaaactattaaactttcaaagtcttattcatggccctctgggaccttaagacattttttttttctttacgggggaaggtttccagaatatataaaattaaagtcacaattttatttatgcttccaatagtcataaataacactttcaaattagagaatgattagttttgtctgggtcttaaaagtaacgaatgtgaagatagacaagatcatttagaaaagatatgttggagaacacaacctatcattgctcagaccctgaaaagtggctgcaatgctgcggcgttccaactaaaaagaagcttcaaaaatcctgccctagttacagaacacaaggtctggcaaattcaaaacataactgtagtgatgtatccaaacctacgttttcagtaacacttctaaaaaaacagaacaaactgcatctcatataatatttatgttctctttgaaaacacacaaatatttcctatgaccagcatggttgccaaacttgctctttcctgccaaaccatggccttttctttcctgaacaagccactgaggaaaatgctgagattctcttggcttatgtggctgaggaagaggaagccctgccccaggccctggtatccagtcctcaaccttcccgctgagcagaccaaggacaaatgtgaaatgaacactgtcatagttcccagggcaaccaaaagcactgaacagatacactataaggtaacattggtcttttttgtaaaatttaagtacaggcatttagagtttcctgaaatctcaaatgcggtgttaggtgcctcactggtagacattcttttatcattccttaacaaaaagaatatttcctcgctacagcaataatccctcttgccttttttttttt

SEQ ID NO: 21661 - DNA, 1049 bp, Homo sapiens
cttgtcttcaatagctgtagctcccaggagctagaatgtatattaaaaaaaaaaaaaaaaggaattagcaaacaaaccaaaagttttctgtaattacaggttgccaacctgtaaaaagaagggctaattatacatcctggttgctgctctcctggggccaatggccagtgttaacagggaaggctgccatgtttcacaattactgcaaaccaacacacctaaaaactttttccctaaaggatgaactatttaatttaccaagacaaaaatgcaagtacaaaatcaaggatgttaaaaatacacttttcttgtgtatttgtggctttatactgacataaaccgtaaaccagttgcaatactagctatttgttgaatattttccacttatctaaaccctacaaaaactatgtattaaatttggaaaacttttagaaacaatatatttttcttatttcaagattttgcagaatatgaattgtttcggtaattcccccaatgtaataagtattagatgcaggtttgttattgtttaaaaattataataaattttaataagtgatatacaaattatggaattaaattagaacttctcctaatgtattttgtcttttggtttctcataatggcaacttctgttctgctcctattttggtgaataaaagaaataaccttcttccattgtgccagtgtcaaatgctgaagttacaattatctcttaagcatgagatcaaatattcaataaaacttaataaaaatttcaattctgcttagaatatcaaagaaaaagttattaaggctaaaactcacaattaagtctttttcaatctcctcatatactttatccagagcttcgtcccggttggtggaggccacactggcagccataaactttttattccattctgtaaattctttttcttcaatttccttgtagcaaaggcatagggttctaagagtttcatttgcaaagatctgttttatttaaaaaaataaatccaccaatgcaaagaatagttaatttatgtaattcaggatcaagtctgaaattt

SEQ ID NO: 21662 - DNA, 1058 bp, Homo sapiens
ggctgaggcaggaggatcacttgagcccaggagtgtgaggttacagtgagctttgatattccactgcactccagcctggctgacagagcaagatgcagtctcttttaggaaaaaagaaaaaaccaataagaagaggaataaatctcacagccagatacacaaaagagtacatatgctacatgattccactgaaataagccaaaaaactgacagagctaacctgtgttattcgtagtcaggaaagtacttttcttgtaatcactggaaaggaatgtaaagggaattctagggggattgataatgttcttttttaaaaatctgggtgctcattacaagagtattggtttgtgaaaattcattgagttatatacttatgatacgtacatatctctgtatacacatgttgtacttcaataaaaagtttaaaaaatactctgcctacccaagatcttctatttttctactctagttattttgtctcaaaatagaaggaaaagcatttccgtggccagatgactttggacagaaagagcatttagttttccaaaatactttgaccaggatgaaggccacagatgcatgagcagcctcacttggaatggttggtgctctggggtaacggtggcagagagagctaaacacaccttccttccttccttcacaattggctcagaggattcactttttaagtcaatattaatcacttcctaattaataattaaagatgacacttagggtctctctgtatttgttcactcagaaagtcattcactagaagctataaacgcacttcctaaatccggccatctagcaatcatatacaaatgctagagggcaaactatttaaccagagacaaatcagcagcggtgagaacaaagcctttcccttcggcaacttaagttggcacagcgatatatggcataatattgacagcaaacgcatttccagcagagaaaaggaacaaaataataaaaagtggtaaagttcccacaagtaagacactcatatctagagcaaacaccttgatatttttatcattaaagaaaaaaaaatgttt

SEQ ID NO: 21663 - DNA, 1008 bp, Homo sapiens
atacatatgtaactaacctgcacaatgtgcacatgtaccctaaaacttaaagtataataaaaaaaaaagaaaaaaaataatcccatttataatagctatgaataaaatagctaagaattaagtttaccaaagaagtaaaagatctctgcaatcaaaactataaattgattgcaatgatgcaagaaactaaagaggacaccagaaaaatggaatgatattccatgctcatggattggaatattgttaaaatgtccacactgcccaaagcaatctacagattcaatgcaatctctatgaaaataccaatgactgtcttcacagaaatagaaaaaaaatcctaaaatttgtatgggaaccacagaagacccagaaaagccacagctaatctaagccaaaagaacagaactgtaggaatcacactacctgacttcaaattatatgacagagctataataaccaaaacaacgtggtattggcataaaaacagacacacagatcaatggaacagaaaagagaactcagagataaattcatacatccttagtaaacttgttttcaacaaaggtgccaagaacatacattggggaaaggcagtctcttcaataaatgatgcaaggaaaaactgcatatttatatgtagatgaatgaaagtagaccccatctcttgtcatatgcaaaaattgaatcaaaatggattacagacttaaatctaagacctcaaactatgaaactactccaagaaaaccctggggaagtctgagcatggtggctcacgcctgtaattccagcactttgggaagccaaggtgggtggatcacaaggtcaagagatggagaccatcctggccaacatggtgaaaccctgtctctactaaaatacaaaaagttagccgagcatggtggtacatacctgtagtcccagctactcgggaggctgaggcaagggaattgcttgaactcaagaagttgaggttgcagtgagccaagattgtgccactgcacttcagcc

SEQ ID NO: 21664 - DNA, 1084 bp, Homo sapiens
gtgaatgtacctaatgccactgaactgtgcactgaaaaaggatcaagatggtcaatgttatgtatattttacatttaaaaaaaaaaagtcaggcgcagtggctcacacctgtaatcccaacactttgggaggctaaggtgggcagatcacttgaggtcaggagttcaagatcagcctggccaacatggtgaaaccctgtctctactaaaaatacaaaaattagccaagcctggtggccatgcctgtaatcccagctactcaggaggctgaggcaggagaatcacttgaacccaggaggcagaggttgcagagagctgagatcgcaccactgcattccagcctgcatgacagagcgagaccccatctcaaaaaataaaaaaatttaaaaactcccatgaaataaacttctacaccaagaagacaagatcataaggaacctctcctcctctcaaagttgtactggtacaaatcagagcacagattttcttttaattcttacaatctttgtagcctgatgaacttcacacacttggagtccttactgtaacaaaagttctggaggttgctgggtgcagtggcacatgcctgtattcccaactactcgggagactaaggcgagaatcacttgagcttaggagttcgagaccagcctgggtaatatcttgagaccctgcctctaaatgaaaaaaacaaaaacaacaacaaaaaactggaggttgatacagcagctactagtgcctgacttagaggactcacactttaatttttcaatataaagataggggcattatttcccagcatgaaatgtacaaaacctacccatctccccaagtgagtaaatatttaaaccacccaagccaaagggttacctatgctgttgtttgtttgtttgtttgtttgtttttgagacagagtctcgctctgtcaccaggctagagtgcagtggtgcaatctcagctcactgcaacctccgcctcccggattcaagcgattctcctgcctcagcctctggagtagctgagactacaggcgtgtgccaccagggtttcaccatgttggccaggatggtctcgatctcttgacc

SEQ ID NO: 21665 - DNA, 1026 bp, Homo sapiens
ccttcaaatggatgaattgtgttgtgtatgaattacatctgaataaaactgtttaaaaatattaagaatgattgagtgtgacattattgcagcagtacattggagtttctgctaaattacttttgcattcatttcaaaaggaagcaactatgcccattgctaatttaataacctgtttgcttgtgcggtgtttaaaatggcatcatgaaaacatggcaatgtgtgatagattaagagccaattaaattttttattttgagttacaagatctgcattaaacagattttattgttgcccttgaatttccagtcttagatgagtagcagcagtgaaaaaaagagatcctaacttaagagttttcaagctttttgatgttgcaggtatttgaataagtgggtctgtcttactgaaatatttgttaattagcgataaagcaaactatatgttgatcttttggtagtccatgctaaggaggattagaataatatataaataatataatggtaataagtatcagggcaggaggattaaagaagggtggaagaagtgtgacaaaatgttactttctgtttttacattgtttctcttccaggtcacaactgtatttcaaatgtatttcattttcagactataggtggcaatgtttgtgctgttcactgtttaatgttactgttggctcgggtgttgcttgttgctggaatatggaaatgatagcataatttagagttgagaataaaaaaaactagatttagaaaactagaaactagatttagatttagtagagactttctaaatagtcctagttctgctgtgtggacccttctgtaactttctgttactctgagaaggagctgataattatcacaactactggtgtttgattagcagagacattcttgattcctgatgcaagaccgtggctgaagttgtagcagggcgtttggtggttggcgatgtaaagatctgggcctcttgtttcatgaataatagaatctcactatgattgtaatattttgttttgaactg

SEQ ID NO: 21666 - DNA, 1025 bp, Homo sapiens
tccagatttttaatagctggacgttaatagaatatttgaattggaggagccttatacaataactcatttaactcctgttgttgtcgatgagaagaaccaggtctagagcctttacataaacacatcagtcagtggaggtgccagggtctgacctgctggcctcctaagtcccagcccagtgatagtttgggaatgtattgaatctcatatgattagtattattctccaaaagagaaaactaacagattttggcctaccatcctagtatcttttccattaaagtatgggatgttgggtgatgaacagtcgtacagtgtaactaaaccacttttgttgtatgcatcaaagtactttcttgtgaaattggatgagagattctgctgagggtgcagttcttgtctctccatctctcatccagtgaggaccaagtgagttaagcagtattgagtagtataacagtacgttcctggagacatgggtgtgtctgtagactaatccttattctccaattattgagtataatatctcttgtttaacatgaggaaagggtcaaatttgaggaaaaatggcctcttgtttgatgtgttttagttcattattctcttctattaagagaaattcactgttaaaaaattgtttcccatttccgtatctgaaataatgactgtagttgaggtgatcttgccctgggtctgaaatcatacttccaaaccaaaaaggactttgaatacaaaacttttaagaaatcttgtatgaatacaagctatatctgaaaaattgtgttttataatattgatgcctagttttgccccaggccatctgcagtgtggttactatgcaaagaatgctggtgttgctgtttttttttttttctttgttggctattaacccagcggagacaatatgtggctatggtagtacttggaagttctagcattacacagactagcttccatttctctcatagaggtcatttttggcatttaaaacacatacttttagaaaacagatttggatgtatgtaa

SEQ ID NO: 21667 - DNA, 1041 bp, Homo sapiens
cttcctagttgctcatgtgcggcctcggtgatgtggatgtgaatgactggagacagcattctatttacaagaacggctactgcccaaaccaccccgtcattcagtggttctggaaggtaactccggggcccagccccagccggtgtcctccacctgaggcaggattgagggctgtgtggcgccctccattgtggtctgacttcaggactgatgctggctttggggtctgttagagcttggactgctgggggagggaagaggcaaactgagccagcagccccgtggtggctcctctgtaactgtagcagacagctagacttgaatgaagttggtccctacaaaagcacactggccttccttgaccacctcgtgaaagtgacttttatttgagggactggtcctccaatgcgtaaatagaaatggggggcttctcagggcagaaacaggcttcagggatggctttgcaagatgccactttctgttaagaagtcgttttctcaatttttaaaatatattccaacaaatattttgatctgtgtatctttcaaccaaagataacacaacatttgatttattatcttagggccactgtttgtatcctgttcagcttaggagggaagtaaaataggaatgggttagtccaaaggagatatagtaaacaaacttaaaaaaaaaaaaacagttatcccccaaaaaggctgattatttacttcaccccaaaaaggaatcatttaactttttcaaatttatttttatttatttatttatttattttaaagatggggtctcactgtgttgcccaggctggattcaaattcttgggcttaagcaatcctcctacctcggcccctcaaagtgctgggattacaggcatgagccaccatgcccggcctttttcacatttctaaatgccttttattactatttcaaatgccagcaggaatacagagataaaaaagcaaaatcttcaaagcctagtccaggtctcacttggcttgttttagatgtttgcctacagcagtccaagtggcattaccagta

SEQ ID NO: 21668 - DNA, 1035 bp, Homo sapiens
taggtggatttttttagggcagtggaactattctgtatgattaatgatgaatacatgtatacaaattttaatcatttaggaggtcagaggagggggattccaagatggaatacagactataagaaaagaacctaactgtattgcaaatgtatggtacagcctcactgaagaggggtgaaagagtacagtgctactgacctaaataactaagtaactgggaatgagttgagcctaatactgaaggcaaaaaaaattgcacataacacatgtgctgactcagaccttcttcaattgattttatgtaacatataagaataaagtttctacattaaaaaagtatgaatagtatataacatttgtaatttattgttaatgttaatttttatcttcataaaacttgaaaaaatagatagctataatgtcattacttattttacctatccattggccatgataagatgtcccatggggtacaggttaattctgaaaccactatttctcccaaaaacaccttacaccttgagaaactatgaatctaaccatgagaaaaacatcaaatctcagttgagtgacattctgcaaaatacctgacagttactcctcaaaaccgtcagtgtcatcacagacaaggaacacctgagcaggtgtcagaaccaagaagatacaagcctgaggagacacaagcagttgtaatgtgagatcctgaatggagtccctgagcaaaaaagaccattaatggttcattagttgtgacaaatatactattctagcataagacgtgacaaatacactaggctaacataagatgttaataatagagaaattaggtatggggtatataggaactctctctgcactaccttcacagtagttctgtaaaccttaaaatgttctaaaattaaaagttgacttaaaaagatcatttgagattactgtttttaattagccagaatatctaaaactatgaataaattatgaaagagcctagtttttgtcacttaatgaaaacagtgatggcttagaagtcctaaatga

SEQ ID NO: 21669 - DNA, 1102 bp, Homo sapiens
ttgtggcaggggttggttaccaagtcctggcctgcgtcagagggggtggcctgcagttctacccaggcggctcttcagccagttggctggggctgcaggtgctcttgtcaccctgtctctctgctccctggcatttctgtcactgctgctactattacgggtgctgcacacgccccactgtcagccctcaagaagaaagccgtcagaggctattattgtcacgggatggtcttgaggttttggtgtgttctttatttttttttttttatttttttcttccctttgataccagtgggtcttgagtttttaaccattgaccccattccaggctatcaaagaaaggtaccgtgttgaagacctcataagcactaagctaggtctggctttccacactgttttagatgggctgcacacctggttaagctagctgctactttttaaggcatagatacagatctttttttctcttatgaacaaaaaaactgtttctatcagaatacattatctttgagcaaagtctcagtgcactaagttcaaaaaatgaacttttaaggtactcatacacaaaatcttcacatacccctgaaatagcctcatctgagtcaaatgggggagtatttttaaaagatgctaagaggagacggtagtacatccacatggctactgcagaaaccaagaatacagtacccgtgaagttctctctctctttgatatttcccctcattcactctgatgggattcttcctgtcccttttttagttatcttgtttttagcctcttccattctcagcaaaacagaacctaatttgatgggaacccaatttcaaatattccttgtttaaattttctccaaaagtctagttgaatattatatcccttttgttataatttaataaaagtaaactttaatattaattactgttatgtttcatatacagctaataaatatcctttgcctggctctcaaaagtgtgaatatgcttaatttcagtttgatgattttagcatctgtgttcctcagagaatattgatctgcttacataaatagttctaaaatgaaattaaataatgaaatcttatttgaaatgaaataatgcaatct

SEQ ID NO: 21670 - DNA, 1135 bp, Homo sapiens
cggtaaaattttttttggatatgtgctatatttacatagtttaaaaatttaaacaatatgaaggaatatagtgaagtcttaactcctaagtttcttatcttgaagtctccttatgcaagtattagcatatatgcatatattctcattcttctaatacagaacacagcttccatctataattttgtgtaccagtactttctccgcttagtagttatggttcttttcgtatcagtgcattgagatcttccctccatttctgtagcggcacggcatcttgtggtatgagtgcatgcatgtatttagccagttctcctttgatggacccaccgtacacaatggtgcagtgaataaacttgaacacagtgacttctgctataacacttatgctgaaacaaatttatcccagtaccaagatttatcagaacaatgggagcttaacctgaatttcatgtttgcttatgtgtgatttcatccctgagaaataccaagtgactacagaatgctgtggagttgtgtaggaaaacacaaaacacatacacacaacaaacctccgatttcaccagggcctccctctcaactgtgggtcacatccatccacagctggtgttgcaagcttcccttccactaagattgccctccttcccccacttcacagtaactcacaagctgcaaccctctgacctccacaagctcactgcaggtctttttcaaggtaaagtgcagtgttttttgcatttcttaaccatttgacgtagttaaaactaaatattttcattcgatgtgtcactgacaaagtcttgagtgttgtctccgtgactccatttttgctagaggccctgttgttttgttgaagttttgcatagtgcagtgatttttaggagcaccgatgttgcattacagcagaaacgggctgtagtaagtatgcaggtctcttcatagaatagattgcccagtggaaggggtcagagctttaggagtgaattttggagggactgctgctgtgctatatttaaatcatgtgattggcttggtttttcctttttcataaaaaggtgtgagctgaagggcatgtgtcagcaacggttgaggataatcctgtagcctgcagtctttaagtttgtgggagtttctggct

SEQ ID NO: 21671 - DNA, 1050 bp, Homo sapiens
agtgctggaggcctgctctaaagtgaagggattgccctagatgattaactagctgtcagcctgcagttctggaggaaaacactactatatttgtagatgcaggactttttttaaagctaaaaattggtagcttttacttcagagttgacaattatcctggtttcttttctacctgatacaaactgcagagggtcctgtcagtgctcatgacatgttaatctcagtagaagtcatttcctttcgcacatgttaccaccttgagcagttaagaaggaagccacattggctcgttttatagctcctgagacctacttgactattgagtttcacctctgacatgtctattctgatcgccttttggacacagggtaatgctgatactgactttgtgcttctttccagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaagtaaagaggctttatttccttttggttttgttatgtaaatttttggtagattcatggctaattagaaactagtaaaagcactggattatgttctgagttctgccattgactcactgggtgactttggaccaaatgcttaactctttctgtaggatgggagttgtagtagttaaacccatagtaactcacaaagtgattatgagaattaaatgaactaatgtttactaaagcaattcataaacttaaattgctgcacaaatataaggtatgatgtattatgacatgttagttatttgaaggagctcaaagaaaatcaagtcacattgcaacagaggatggttttgatatgaaaattattttctgaaatgcaaaaaaagctagctgtttttctatgttacttgggccaaagtggcattttcagcagtaatattagtcctggatggataaaaattcattttccaactcatctcatgatttggccgttgcatattctgcatt

SEQ ID NO: 21672 - DNA, 1049 bp, Homo sapiens
aatgaagtgagtctggaaaagctccttgtcagcagcgtttttgtgtgttatgaatctggacttgaaagaattgcacagaggtgattcacatgattttgcccactgatgaatgacactaatacacttgtttacaggttaaaaaatgtcaggtcctagtttattcgtcattcccagaagccatgtggtaagaaggaattcttcattgtgtgctgtgctggaagcaaattgttgcccttgtgcttggtcatgctttttgttgtcaaggatacttgagtgttttggaatttaagtctacaaaactgtcattagatttgtgcttcagttgaatggttgtcttaagcagtcatcttagactaaaggaaggtcaggttatctttgactgtttttctaaatgctcctgtctgacagtaaagtcttgagtaaactaatatttttgttaatgatgctgtgctgaaaataatttttgagaagacattattttgctttccagagataatggagacatcaaatttctgactaaaggagataataatgaagttgatgatagaggcttgtacaaagaaggccagaactggctggaaaagaaggacgtggtgggaagagcaagagggtgaggattcacctttaagttatatagaaggttatgaaaaacacttagaaatgaagaaattaaatcaataggctaatgagtcgttaattacaaatatgacatatcaggagagttttaagcagttctagtttatcctgtgaagactaaatacaacttagaaattcctaaagacctaaaatctaaaactgaacccaattatattatctatatgatgggttcaaatctgtttcaaaataaatccagccaggcgcagtggctcacacctgtaatcccagcacctttgggaggctgaggcaggaggatcacttgagcccaggagttccagaccagcctgagtaacatagggataccccatctctattaataaaaattttaaaaaatttgttctaaaaaaagaagaaatataaatcctcactgagagattagttatttgtggatt

SEQ ID NO: 21673 - DNA, 1051 bp, Homo sapiens
aacaagtgcaagtgtaggcggctgtctctaggagaaagtcattgtcgcggcagaaggggcaggagagagccccggggaccgcctggactcccagcgcttccagagacggccccacaagggcccctgtgttcaggagcctagaaaatcttgtaacatttaaataatcgatattgtgggaggtggggataggagaataggagttagtccgctcctttttttcattcattcattcgcactccccaccccgatacatacagctccatcgtaagttttcaggccagcgccccggccccatgctttttctaaatctaaacagagaacccagtcactgcccagagcccgaagtctgtgtgggccatactgctgttgcatcagacgattatacgccccccccaccttttaagttactttcattttatagagctcctggggcgtgcgaaggaagtggtgcattgcaaatgtgaccatgcctaagttggtaacaggctgctgtctctggcgcttgtgtgggatggaaaaagctttgtctaccttttgtgatgtcttaggattctgaccttgtttctttctgaaggatcttacttatgcatagcactttctggtccgacttaattcccaagaacaggaagcagcacaaagtccctcttaaacttgatttgattgatactaatacatttataggtgtgtaatgcaatttttaaaaaattaaggaaatgaccgggaagtattttctgccttgttttctacatttttggtgaaagggataacttttccacttagaattcagggcttccagtgtcggacgctgaatggtatttggtttttcttttagaactgtatattaatatatctcaatctctgtagacaacatgtctatgtaaatacttcccaacatatttgatcttgtagcccataaagaataacaccttaagggatttattaggtctcttggtgtaggagttaggaaagatttcactcacttcttgtagagagaaattggttgaaatataggtttaagattttgctttactatatattgacagctttgatt

SEQ ID NO: 21674 - DNA, 1022 bp, Homo sapiens
tcctctcaatcacggagcagaaaccacctaaagggtcaaaaatcctgtaaatctcattgtcaatcgtcaaaggggacgatccatcaggaagagaacaaacaccttaaaaatagaatagtgactggaagtgctgcggtacaaggagtatcccactttagaatcttgaaggtggactttcaaggcaaaatcatgaatgagctgtgtgaccttgggcaagacaacctctctgagccacagttaatctctgaaattgagacttagatcatctttaaggtcccctgaagtttgaatcataaaatgggatggcaaaggagtctgaaggtctcccaccatagttccaagtctgtcggcccccactcctgagctcatttcagacactaagaggaaagttaagggtttgcaaaaagaagcaggggagtgggattttaaaagacccccccccccaaatttctgttttctggattcttcccccaaacattgattctaaatcttagaggaggttgagtgggaacctcttggacttgtattttcttagaaaggggagtttgctatgcatgcaagctttcccagtgattgtatcactgccagaattccttcttatgtggagctgaaagtagatagggtcacttgatagacataccctgcggtgtcatcacgtgaatcttctcaagtaatagttcatggttaaagagcaaaacatttgtcaatactgcccaggcactaactttagtttctcttttaaaaactttcagaaatctgtttagccaattcagggtgaaacattcatgctcacgatttattcccttatggttttcttccaaatataccattcttcaaatcaccagagaaacaggagagttggtaagagttatagatggggattttggattctttaatttatcaagtaattaaccacatgctctgggcacctcccaaccaccccccgccctgatacagtccatgtaatctatgctgtctgccattagacattgctcagtgcgagaagcctcagcttggattta

SEQ ID NO: 21675 - DNA, 1046 bp, Homo sapiens
ggcatgatgtctgctcactgcaagctctgcctcctgggttcacgccattctcctgcctcagcctcccgagtagctgggactacaggcgcccgccaccacacccagctaatttttgtattttttttttttagtagagacggtgtttcaccgtgttagccaggatggtctcgatctcctgacctcgtgatcctcccacctcggcctcccagagtgctgggattacaggcgtgagccacagcacccaggctgttcctttattttctttatagcatttcttgatatttgaaatattttattgtttttctttatgtgcttctcttctaccccttgtatttatatacgtaatggtgtgggctccctgtattttgtctgctacatacagtgcctggaagagagccaagcatagggtaggtgctgagttaatagtttgattctgacttaatgaatggatcagtggttttcctgacctgtcctgaactgttgacccttctcttcactacactcttacccatttttgactctgaaatgaataataccataatgctgcttaattctatttgaatttttaattatatttcatgttttcttgaatttccatattgcttagttggcttatataagcatgatttttttggtcataaaatatatttgaggaaatgatttcaagttgtttgatatattcactggacttttggtttccctgttttataagcctctgattttaattattctataataaatactggtgcaatggacttttttttctgagtgactatattctggggtttattattcacaattggtctcacaaccttctgtttttaaaatctaagtgcacacattaagtagttcctcacaaacatctctagaaacctttctgaaataaataattaagacattcaattttcacattctactatcagacaaatctctaaatctttgaatactaatatttttagctatctgagttttgtttctgattccaacttggtaaatataataagtgaccataatgtgatgttccttattccatctacattttgcat

SEQ ID NO: 21676 - DNA, 1023 bp, Homo sapiens
catatgcttgaatatacatatttatattacatatatacatgtttaatttacttatccaaaatttctcaaaaatgtcatcacttttggccaatgatgaaatgcattaggagcaaaatcatagttaactaacctccacagaagataaagcctgtgagtcaagagactgaatatttaaatgtcctggagaagttgtcttcttgccatcatcgtgacttaaggggcagaaattaaggagagcagatgcaccttttatgattaattaatgagtgtttatcttgggcccttaatatgcccagatctgtgcttgatttgtgaggaaaagaaaaagaagatatttgatcttctctttggaaagtttaccgtctagcttggatgataaaaaataacatacttaaagcatctcaggagccacttgggattcaggtaagcagtattggcagctacacagcatggtatattgtgcaggttgtttacagaagccctcggtgcagatctctttattgagctgtgtactttttatggtacccaagaattttcctgcttaggaattctactctccatcaagtaataatgtaacatggcataatatcatcctttctattatagctaacttatagtgggggaaaaagtatctctcatggataagaactaagactaaacatagatgaataagagacgtcaagaaaattaaaatatagcattcctttaatgtatttggtattatttcaattaacaaataaaaaggtgtgtttttagtaaatttgaagcattttttgttcttctggctgagagagtgtcaaccttgaatattcgtgttgtttaaagtgatgcttgtgttctggacttgtgctacatgccaaaagagaatagtgacttacttattgcagatttatgaagaaggtctataaaattttatttcgtcttacttaaaacaagagtcagggaattcatcccaccggatggtagtaacagccttttattacatcaaagttggtggtagcttacagaggaaaaattggcctt

SEQ ID NO: 21677 - DNA, 1080 bp, Homo sapiens
aattctgtccaggaaggaggaggcgccatgaggatgagtgagctaaacagaggaagcagtttatgaaatgagccttgatggatgagtaatatttttatctggccaagaagagtgttccaagagaaagatcagcatgtagaaactcaaagatgagagtacagaacatactaggggaaggacagttaatctggagtgacagcccttatctgatgtggcaaccccaattgtcaaccccttccaactcaatgtttagtcttgattaacttttaatttctcagtatgcatttgggttaaaactgatttcttattttactatggttgacaataagtaggactgcatgcctcatctgtctcaatctgaagattatttcaaaaattgaactaatttcaaaattaaacggatttaagtgctcagccaattcatttgatttgcattttggagatttctgttgagaaattataatgattcctcacagctcattatttttcacaatttgattaaaggttctgtaacttagctaactcaggtgtggaaaaacatttaggcaaacacttttaagtggttttatgacatgcgtgtggatgcgaacagtaatacaagttagaaattctttcaggtattttagtcagagtcttccctgaaccaacagaaagccagtgagggaaatcatttgacggcaacaaaaggactggggctttcatctctgctcctccatctactaggcaagaaattacagaaaatgataaactctgaaccttgttttcccatccgtgaaacagacataatagtaccatgcactctttacttcacaggacgattaaaatcacatcaggtagcacatgccatcgtttatgcaattcttaaagaccttagagatcatcttatgaggtctgtaaattttgctccgagaagttccattcagggtcccctcacagcaaaatgaaggcagggttgagacaggctcaaggacactgctgcaggatgggtggggctccccctctcacatctctactttcgtctgaggagtcctcgattacctgctttacatagtaggctccagaaaacctttcatacgaaga

SEQ ID NO: 21678 - DNA, 1035 bp, Homo sapiens
agctctcgggcagtggtcccctctacccactgaagcgatagccgggagggtattcctaagccaccactacaaccacccctcaattccggaacgcccccaatacctgcccggccgctgctgctatcgcgataattctcgggccagtctcccgtcagtccgctccacgccttccttctctgaccaatcatggaggagtcgtgggtggagttttgcttttgagcggagagcggggccttcaatctttgctatctggcgctgggaatgggcggagctgaagtgggctggggcggggctggggcggggctagatcggggagaggggcaggggcacgctccagttctcgcgagactggagaccaggaagacgcctgcagagccgggctgctggtgcagcagaggctgaggcatcaggtgcagctgcatccggatctcctgccttggagcgtactccttgtctctaagtcgggaggcaggacgtggtcaggccggggctgtggaggtgcgctgtgtcccctgaggcctagaggattcgggctgcggcccgtcggaaccagtcagggaggcgcccacactcctgacaggataagatggcggcgatggcgcctggaggtagtggcagtggtggcggcgtgaatccatttctcagtgattcggatgaggacgatgacgaggtagctgcaacagaggaacggcgggcagtacttcggctgggcgccggaagtggcctagatcctggctctgcgggctcgctgtcgccacaggatcccgtggccttaggaagcagtgcgcggccagggctccctggggaggcgtcggcggctgcagtggccctggggggcaccggggagaccccggcccgattatcaattgatgcgatcgctgctcagctgttgcgcgatcaatacttgctgaccgccctggagctgcataccgagctgttagagagtggccgggagctgcctcggctgcgcgactacttctccaatccaggcaacttcgagaggcaaagtggaaccccgccggggatgggggcgcc

SEQ ID NO: 21679 - DNA, 1030 bp, Homo sapiens
aagattggtagtatggattatctaaaacattattttgatttgtttttgtatatattttgattgatatgtgtctgatctgaaaattcagaatacttcagaacaataaatgtataataaaaagtggttttctttatttaatgatgtttaagaacaatgcaatcctattaacctttataattttagatttagtgaattatctccctaaaactgttgacttaatactgtaatatagttgtacttttaaacatactttaagaagtcttcatactgtttaatttttttcttgattataagaataatccatatttacaaaacattcaaatatgaacaggatatatagctttataagtttgatgttttcaatagaatttctattaactgaataaaattacttttaacagatattctaaggaaatctcagttttggataaattcttgtagcatcgttgtaatgttcctactaaatttacatgatgaaccaattagatcttttatatgtaatattatttgctggaatatacacacactctgtgtgtgtgtgtgtgtgtgtgtgtgtgtgtgtatacactgtatttttgccaggtgagccaggatagcttccattcagtactttgttttctagttacattgcaagataaaaattgtggtaatgacattgatgaacactgagcaggttatagtaacttagcaagagtaatgctttttctgcttgaagcattagggctctaatcaaaattagactgtaatttcttatgattagcccagttctttgcacagtagagatgtaatgtgatcaagtggagagggcaactaacatgccttttggtgatagatttcttttaccatgccttcagatttttataaggcagctaacaggaggtagtcatttatgtttgaatgtaatcatttcacctatgagcttgcagccttccaaaatcatcttccttttttttttctttttttttcgagacggagtctccctctgccaggctggagtgcagtggtgcagtcttggctcactgccatctcc

SEQ ID NO: 21680 - DNA, 1029 bp, Homo sapiens
cgtttcttattataaatctatacatatctctccctctatggggagacagagagagttgttggttttttgttttgttttgttttttgggtttttttttttatttgaggcaggttctcacactgtcactcaggctggagtacagtggcacagtcatggctcgctacagcctcaaactccagggcttaagcattaaatctacatttttataaaactcctgtgattgaaggattaatattttgacttcttatttctcaagtttgatatatattctcttgtcagcaaaagcctttttattggtatttaaataaaatttaaatgttctttagtaaactgaacttagtaatatcttagctgattaaataaagcattggaaacagggtttaatgttttgattaatatgtttacatggtgtaatttttttaatgtaaaaaaaatgtacaatgaaaattcctttattcctgtccttgagcttctgtcacatgcagtcagttttgctagcttctagagtattctttcaagtcctttgaccatttttaaatttgattgtttatcttcatgtttttgagttgtaagagtttttttatatattctgggtagtaaacccttatcatatatatgatttgcaaatattttctttcatcctgtaggttttctttttacactcttgaccatatcctttgatgggcaaatgttttccatttttatgaaatctgatttatctatttttttgttgtgttgtttgtgctctaagtatcaattttaagaaaccattgccaagtcaatcaatgttatagaagatatatatatctatatgtatatgaatatatataagagctaaagctatgaaacaattagaagaaaacatttgttatatatatttaggtcaacgattcattttgagttaatttttatatatggagtaaaacagcgtctaactttattcttttcatatggctatccagttatccagaaacatttgttcaagataaaaaaattcctcttttgaatagtcttgctacttttgtcaaa

SEQ ID NO: 21681 - DNA, 1050 bp, Homo sapiens
atttgatgctcagcctttcacttctgcaaaacaggtcattgaaatttttatagagattacattaaatctgtagatctctttgggagtattgtcatcctaacaacattaagttttccagttcatggacatggaatgtctttttgttttagatctttaatttctttcagtaatattttgtaatttttagtatacaattctttcacttctttggctaaatttattcctaggtattttgttctcttggatggtattgtaaatggaattgttcttttagttttcttttcaagaagggaaaggtttatcctggttatcaaaacaacactggtcattgtgtgttgatcttaaatcttgcaactttgctgcatttgcttattaactctaatcattttttatgggttctatgagattttctacatatatagaatcatgtcatctgcacgtagagagatagttttgcttcttctttacaatatagatggcttttattttttcctcttgcttaattgctctggctaggatttccaatacaatttggatggtaatgttttgagaaagcaatatccttgccttgtttctgatcttacaggaaagcttcaatctttcaccattgactatgatgtttgctatagaatttttataaatgccctttgtcatattaaagaagtttccttttatccctagtttgctaaatattcttatcataaaatggcattgaatttgccacatgctttttctgcatctgttgagatgataatgcgatttttcccctttcgttctactgtcatatgcctgcattatttatacattgcctgattttatgttaaaccacccttgcattcatgagatacatcccatttggccttggtttataaaccttctaatgtgcttttggatctgtcgttagtattttgttaagtatttttttgtctatattcataagggatactgttctgtggttttcttatcttgtgttttggtatttggtattggttttggtattgggctaaggctggcttgatagggtataggaactcttcagtctgtttcctt

SEQ ID NO: 21682 - DNA, 1077 bp, Homo sapiens
ctagtctatgtttcatttatctctgtaatctttattatttctttccttctgctggccttgggtttagtttgatctttctgtagttccataagatattgaattactgacttgagatcttttttaatgtaggtatttatagctataaatttccctctgagtactgcttttgctgtatctcattagttttggtatgttgttttcattttcattcatctcaatgttttctcattaattcttgatttcttccttgacctattgcttatttaagagcatgttgtttaatagccacatatttgtgaatgttccatttttcttgtgttactgattcttaatttcattctgttgtagtcagagaaatattttatatgactttgatcttttaaatttactaagaattacctatgcctaacttatggtctgtcctggagaacgttctgtgtgcatttgagaagaatatatattctgctgatgttaagtggagtgttctgtataattttattagatttagttgttttataaagtttgggttctctatttccttattgatcttctgtctagaatttctgtacagtatgaaagtagggtattgaagactccaactattattgtagaactgtcttatattccttcggagatactttgtgcatgtataaattcaaatatgtgatcttttccccatgatttaaacaaatgatactgtattctatgcactactctctactttgctgtttttatacttaacattagattttactttttatatcatgatataaagaactttctattagtgttttcaaactttgactacaccttcagtaaaaaagatgttttacatcatgtgccagtatgtacttacatatataaaattaaaagttttacaaaacataaagtaaagacaagcaataccaaacatgattttataaatattttggaaaaataaagaaaaaaatccttaagtaagcaattaaaaaagaaaaacatgctgttcatgacccattcaactgattttgtgacccactgttttaaagatagtaggataaaggtttaatcagagctgtctaataaattaactttttt

SEQ ID NO: 21683 - DNA, 1027 bp, Homo sapiens
gttgccacaacttatagaaatagttggcaaaattaatgttacttcaactgcctgtgtccatgaattctccagatttttctggcgcctttgccggacatttggcaaaatttttacaaacactaaggtaaaaacttgtattccatgttttcttatatgaaaaagacatagaaatgtaatgtgttaacactgtaacagggtaaataaaagcatgaaccattcttttatctaattcgcttctttaatatcctagaatactatgatagtaaaaaaaagttctagttggtaatattcttatctttactgattttcagaagatgatttagcctaagcttagttcatatccagacttggatataagctttactcattgtagatatcctcaaagattttcaatataggaagtgtcagctagggaactcaaccacaatcctttgaatgtgctgctggtacttactgtctatcacaggttcaggaagcagctgtttgctcagcacactttggtaaaaacctcaagcgattatggaaccacagcaacttatatataaaacttgctgcgaagatgccacctcttagaatagcatggacactggagataaattctacatgtttcagtcattaccaaaagtatcatttgtcacatttgcctatccaggttattttgtagtttcaaatattaacattggaatgtcattagatcctaatttattcattaatcctattaatccatttgtcttcataacattttgttaagccagtactttagagagctaataaaaacataaaaaggtgtagtttctataatcaaatgttaataaacacatttaaaaggtaagcattttaattattaaatttaatttagtgtagctctttactattaaatctatagttgaaacatttaaagtaaatagtatgctataaggaactggacaaaattcagaagacttgggttatggtcctattatctgttgactaatgtttatgatctttactatttaagttaaattatgtgggcttagtcttttcatgt

SEQ ID NO: 21684 - DNA, 1012 bp, Homo sapiens
taatcaaaataattaaactctcatttcttgaatgcctgtttgtcaggcacagtatttaggtatgttatttgcaaattcatagcacaacagccctttgaggtagataataatatcaccattttcagatgagaaaacttgcgtttcaagaggttatggaaaatactatgtatctaagaccacatggcttatatgtggagaactgacgtctgaacccagatctgattcccaagtgtaatactttccaataggcagccttatatctctgtacctcaaaagagaaggctatattatttaaaagattaggaattgtcctatatggttttaaaatacacttgctatagcacaataataagtggtttagtggtgactgctactcctgtgagtttggtttaaaaacagcccagtttgtaccctgttggtcatgataaaagcataccacccttactttgagaattttaaccatagagcacaatatgtgtcaaacaagctaaaaaagtattcttttcagttgcattttgatggacattgaaattgcttagactctttgaccaaaagtacaaactgctgttaaactggtgacaaaatctgttttcatggacgctaggctacttaagctttattttcctcctaagcattctctgcctttgtaaagcactctagcagcagtatttgcttagcttctaattttggttttgcttttgtgttttctctctttctcttggttgttccttccttcttcccgtggcgcactgtgtttgctctttccgtgcatcacctgtgaataccccctgtgctgaccaatcagctgttggtgaagggggtgaatgaaactctggtagctcagagggttgttcctgctctcattactctctccagtgaccctgaaatgtaagtgtcatccctgccttttatattcggcatccctttcaaaatgtgcctgtcaagaaataaccatcagctcttaaatttattgaagaatctctttaaattaataatactggattatgcttat

SEQ ID NO: 21685 - DNA, 1025 bp, Homo sapiens
tcatcaacaaaaaatactaagtcaggatttggactgcagtgtccaaaaaatcgattgaaggcatgcacactgatcaaactatagaaacacagtcatgacattttttttcactaggtaagtgtctttataattagccaactaacagaagaaagttgatattttagttagcactagggatagttccacatgttgcagtgtcaaatttacaggtgattctaggtaggaactctgaaggtgctttgacttttcgaggctgtagttgctctgaggcaaggagaccaactcttggctgctggattaaaggataggctcaacaggcaatgggtctttggtgtgtgccatgttgtcaagttaaatgggtatttgatatgttgtcatgttaaacgggtctttggtgtgtgcagtgttgttgcattaaatgggtccttgctgtgtgccgtgtcatatagttaaaacttttctagagcatgatttgacctttctatgtatattcaaaagaaagactcatgataatctgggaagaatccatctggattcttataggatctgctccaattattttgttgattcttcggaatcttttttcagtaattctgggactatagttatttttcaaattaaacatagtgtcaatatcttaatttctctttctagaattttcaagaatatctaaaaataacccttccattttatttgacagttttattgtagaatagatacctacctatcaaatttgtaggagttgttcaagaggaaaaaatgaattttcttctcataatggcccccaaataacaattaaaggttgttttgggaacagattgaggtgagaaattcccactgcttgaatagttctagtaaaccattatccttaaagcctcctgcaacttactgtgtacccacaagtatgtcttatacagtcttctttcacattttggtacaaccagatttttttaagataaaaattagcctttttttccacctttgtacttacttcccagtcaagtggcttctcttttgctttagaa

SEQ ID NO: 21686 - DNA, 1048 bp, Homo sapiens
agatgaaaatatagaagaaagaaggatactggaggaaacagagacaatgcaaggaggataaaaaaaaatacaaaaaattccccttaaaaaccaaaaagcaaaaaactagccaaacaaacagatgctataacctgtgagacaagagagtggggaagcagagaatacattcaaaaaagcgtaacctagagtttcccacatgatgcatgataaaagtttcattctctcagaataatccccaaagtccttatcataatctcaaggcactataggatctggccctctcttctagtacatctaagacttcatcttctatcctgtctcccttgctcaccctgcaccaactctgtcttctttccttaggacatggcaggtctagtcacacctcacagcctttgagcagcctcttcctagcatctgcagcatttattcctccatctccttcatgtttttacttaaacattatcatctccatgaagcctaccctgaacacttccatgtgaattgtaccgttctccactttggccttcctagtaccccttatcttactcaatgttttttctaaaacccttatcactttctaatacactacataatttacctgctttttgtgtatctgtctctcttactagaacataagctccacaagtagggaatattgtctgttttatttgctttatccccccccgtctaaaaagatacctagcccgtagtaggtagacaataaatatttttttagggacctccatgcccaaacatgggccaagaatattcagaagagccattcattttctggtgtggttgccagatattagagcagcagtttagttctctctaacctttctatcactcactcagtctccctgcaggaatcgtgttaacttttacacacccagcatatccctcattatattttaatagccatggtgctgtacctagtctcagctctagacattaaaataagggatcttgctttttgcaacctggagaaagcaaaggggcgtagaacaggacagcttttactgggaaaatatgtgtgtgaccatagtgt

SEQ ID NO: 21687 - DNA, 1050 bp, Homo sapiens
actttatttataaaaacagcaggctagatttggcctgctacctgtagccaatacttaggaactttggttgtctagcgttagtgtccatcagaatcacctggaaattgctgagtaccatccccagagtttttgattcagaagattggagtggagtctgagaatttgtattggtaacaagttcccaggtggtgctaatgctgcaggtctaggaaccacaccttgagaatcactgctttaggaaccagactctagtgaatagagaagtgggtggaagagatgagaaagctgttacaggaacccatgataagatgaagtgtggtcttggatgggaaagtaacaataagtaatgcttatgaaccagataccattctaaacatttttcatatatttgctaataattgtcatactaagcctacaaagtagatacttttactattctcattttacagatgacagagaggcaggtaagttgctcagaggccacctagctactaagtggaggaaccagaacccaggcattacggtccttgagaccgtgacttgaaccaccatgttataatgccagtgtatggcagtgaatatgagaagatggatttgagatccgtatttcagatgtgaactcaatttaacttggcagctgattaagagtgaaggagaacagaatcaaaagattcctacatttctgatctgaacatttaaacggatgatgataaaatacaacaaaatggaactataggaagaactattctgaagaggaatatttaaaatgtgaggcacaggtagagaaacactataggcagttcattgagatttaagaaccattagcagcatatgggtggtaattaaaggcttatggttggagcagtggtagataaatgatatcacttgaaaagggggctctgatggggagaaggtgaccaggcatggaattagacaccaacatttcagatgcatatggaagaacttaactgagaaatagaaggcaaaccagaatggtgttagaaatcaagtggagattttatttttgtttttgtttttgtttttttcaag

SEQ ID NO: 21688 - DNA, 1027 bp, Homo sapiens
tactcaggggctggcatgggaagatggcatgagcccaggaggatcacttgagtatgggaagattgcttgaacccaggaggtcgaggctacagtgagcagtgatcacaccactgcactctagcctaggtgacagaatgagactctgtatcagaaaagagtcccaaatcctttatcattcgttttgggttttctttgaaacagggtctcactctgtcacccaggctggagtgcagtggtgcaatcactgctcactgcagcctcaacctcctaggctcaagcgatcctcctgcctcaacctcctgaatagctgggtccacaggcacacgctaccacacttggataatttttaaagttttatagagacagggtctcaaactcctgagctcaagcagtcctcccacttctgcctccccaaatgctggggttacaggcgtgagtcactgtgctaagcttttttttttttaatcaattataatattgtttgtgacagttatagtttcttcatgatcttctccaataaactagacacatattttcatattgtacaaatcacaaaatgtatgagcctaacttttggcagcagaatttttttttcaagagctatgtgtaaaatatatttcttagaaatgaattatattttaaacactcagggcattttctgttaaaccctgtgattctctgtatctacctctgttgtgacttaggccatgtacctgactggtataacttaggacctccaagtttttaatgtgttacatgattgacaggtttcccaggtagggtgaacacacccatggggtgtgccacgtgatccagcaaggtgagcaggggatcctaaaacactgcccctttatcctcacggtctcttataacacaccatcttggtaggcgcctatgcgatgttgttctgaagcttgaaatgtgaagctctggtttgtacaaaagaaacatgcctgatattttctctgtgaatctgtaagattgaaattctatctgccgagcttatttaaaatgagaatgtctagga

SEQ ID NO: 21689 - DNA, 1050 bp, Homo sapiens
cctctgttaaaattcttcatttagaacatttgttctggaatatatttatgttgccatttaatcatgggacacatcatagacttgacataatgtttccataatgttcccacctatttttgtgtggtttaatcctccctgaaatcctgtaggtagccatacttatcccttttattttatttgtttatttatttatttatttttttaatttatttgagacggagtctcgctctgtcgcccaggctggagtgcagtggcgcgatctcagctcactgcaagctctgcctcccaggttcatgccattctcctgcctcagcctcctgagtagctgggactacaggcaccccccaccacgcccagctaattttttgtacttttagtagagacggggtttcaccatgttagccaggatggtctcgatctcctgaccttgtgatctgcccgcctcggccttccaaagtgctgggattacaggtgtgagccaccgtgcccggcctatcccctttaaagattgagaaacggagattcagagaggttgaataacttctccaaggttaacacgtgtgaagcaggactcaaaaccagctctactcttcacctttttcctaaactataaatattttattaacacagtctgatctccttaccagactgtcttaagtttcttgcctggaatgttttttaaagtatagtttatttgaaggaatcaggagcaaaatatgtctcttaattctcttaagaaacagaggttcctttctctcccttctttcctttttccattgagctcattttttgaagaaaccgtgatgttagtcctgtggagattgcacaggccacattttgttggttgcattcccttggtatcatttaatgtattattctgtcccttatatttcttttttctttcttttttttttttttttttgagatggagtcttgctctgtcacccaggctggagtgcagtggcacaatctcagctcactgcaaccactccctcccgggtttaagctattctgctgcctcagcctccccagtagctgggattacaggca

SEQ ID NO: 21690 - DNA, 1109 bp, Homo sapiens
ccacccgcctcggcctcccaaagtactgggattacaggcgtgagccactgcgcccagccaatggtcaggaatttaaaggcctagtttttgcccttccacaagcctcacggccttccaaaaataatattctttttttttttttttgagatgggggtcactctgtcacccaggctggagtgcagtggcatgatcacagatcactggagcctcagcatctctgggctcaggtgatcctcccacctcagcctcccaagtagctgtgactacaagcgtgtgccaccacacccaactaacttttttgtatttttcatagaggcagggtttcaccatgttgcccaggctggtctccaactcctgggcttaagcattcacccacttcggcctcccaaaatgccaggattacaggtgtcagccaccgcgcttagttccccaacaataatattcttggttcagtccatgaaacaaaggattctgaaatgtttagatattctacttaggcaaaagggtttgaggtccatctgaaaaaagaaaacaaaaatgaatataggtcctatagaatatttaggttatcagtatcaaagatactgtttgccatggagcaatggcatggaatgaaattctcaagatgaaagactttacacaaaccataggttttacctggattcagactcatcagaggttctcacaagaaagaagtaaacaacaatggattcatgatgatctgttgaaaaataaaatttaaaatggcagagaaataatatataccatgacataagcagataaatcagtgaggaggataaagaagagatgagaacgaattcaaaaccataaatccatcatacagtggctggagatatcctctgtgcagttttacgtgatactgaagagcaacagaaccagcaggcgatgatgtcgtagtgagaacacctcatgatggatggttttgcatttaatctcatctcttctttattctcttcatagacttatctgtttgtgtcatggtgtatattaaaactagaggaactaggtcaagaataatcatacgactaagcaactttaaattgcttattttattaaataaacatggtatgtttttaatcagaatagaa

SEQ ID NO: 21691 - DNA, 1066 bp, Homo sapiens
gaatggccttttcagtcctttccacactttattggtgtcactgattggaagagttacttgttagataaagagccctgcttgcgattacttcatgaccatagaggtgttttaaatttttatatactcagatttattgatcttttctcttctggtttcagggttttgtgtcatgcctagaaagaccttttcaaagatatgtttgaaaatgtatctgaaatatgtttcaaaaaatatgttttcttctgatacttcctttttaaaaaaatcttggattcatttgtaatttattttgatgtagggagtatggcgggaattcgtatattttcccaaatggctggcctgtggcctcaacaccattaataggatgtcaggacacttccttctcagtttgtgggttttaaattagtaggtcatcatttgtgtctcagaagtgtagcagttataaaggaggcggaagaaaggaaactgagaaataggaagtacttattagtgatacagatcttggttggtacaggacacactgcatttagtctcaaatatgctgtaggttaggaaaatgaaaatacggcctgaaatgtgcatttggggttggatgatttctgtcatgtcagaatgtgaccttgtttttctcactcatttgatttatcaaatagtttatggccactttgattttttaatatcggtataattgccatctgtggttattcattaatgagccttgactttagtttgcatgctgatttcagtccccgcctttatctcatttgtggtttaaatgtaatactcagtgttcctgtagtggatgtatacatagtatttggagttatatctgggctgttgcctgggactcaggccttgaattgaaggtgtgcctgtgcttttgaccagttggtttctaacatgactgggtgtgggttccaccactgcctttggattttaatgtcagccttaggtaatatgttcagacctggaaatctagatttgctcctgaattcagatctcagttctttcatctcttaatttcacccatgtcttcctgttgaatgtttactttcacattagaaga

SEQ ID NO: 21692 - DNA, 1049 bp, Homo sapiens
ttccaaaatcctcagtattgtatttgtcaaccatgttaagcactgttacctgaaagtctgtgtccaataagtttatcatctgaattctgctggggcctatttctcttgtctgtttcttttggtttttgatctcattatcctgttccttcatgtgcccagttacttaagtgctcatgacagcagtgctctcaagatgcaggttgtataagcctctctgtcccagctgtaagcagtgtatgatgatcaccatcgcatagtgtctaaaagcagagtgtgcagctgttactactctttttagagacaagtattaatgataaatagatgtgtagtggtttatttctcatagtatacttttttttcttagacctatcattaggcattccttgaagaaactaatatattgaagaaagggttactgtaacttctttgttgaaatgaaataggttattattgagggcagattttcacactttcataaacttttctttggtagcaatattggtacaagttgttctccattggatgggcttaccatgcaatattctgaacagaatggaattgtggattggaggaagcaaagctgtaccaccattcaacacccagagcactgtgtgacctcggctgaccaggtgtgtggggagtttgttttggagctatatagttaaagcattgctcctctataagaaaaaaattaagttctgtaagctttcagtcagacagtatatctggtaagaaatgaaggaatgtttaagttttagactttatacttatatatgatctaagctcttctgagacctgaaaatgtgtatttagattacttttattgcttgtgtaagattagtacactttaatatgacaccttcccaggcgccatgggtcacgcttctaatcccagcactttgggaagctaaggcaggaggattgcttgaggccacccatttgaccagcctcggcaacatactgaaaccctgtctgtataaaaaatttaaaaattagctgagtgtggtggtacacacctgtagtctcagctactcgggaggctgaggcag

SEQ ID NO: 21693 - DNA, 1046 bp, Homo sapiens
ccaagattctattgcattaatacaggaacaaaatagttcagtactattttgatttgagagtaaaggaatttgaacaaagtttaatattactaccaccagaaagaagaaaatggtcttacctatgtttgagtaagataccaaattttatgtcaacttcaggctgttattttcacttgcatttgacctttgtcgttttgccaaatcttacccagaaacaaaaaaagtcttaaattgggaatatatttacttggcattcttaaagaaagatcaagtttgatagcttttagattgaattcaaagcacaaactttacattgctttttaaagtgagcggattggccatttggagtggcactagagctgacgaaggtgccttgtggagagcatgcccgtgtgatagcttgtacgtagtggtttgtgatgacgtttgcttgtaagcggtgacttagttctgtctttcccattttaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgcttttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgta

SEQ ID NO: 21694 - DNA, 1059 bp, Homo sapiens
tatttaggtaactgtgaaatagcaactctttgaagatgtgtgatattatgctttttatcaagcataataacagttactggattaatgaagtgttgttattctttgactttagagttggaatggttttgttgtgttaccatgacttggcctcatatactttttggtatgttaggtgaaacaaggcataaccattttgtaatgccacatgcatactgaagtaatttttttccctgttgtattttttacatttgagatttttatacatcgtaaagtgtgtttaacaataaagtgtcttgtggaggtgtaagcctagtggcctctgagtttgtgacctagaagttaataatgaaaactccataaaatactttgtttggaggttgcacatattgtatgattttggagatatcaatactttagaaaaacacaagcaaaaaacatccagaattttggcatatttttttctaactggagcttggctaaaagtaaattagccttgcttctagtttgtgaaagcattcagttgaagactgatgaaatttgaaatatttggttttggaccatttcaataatgagtgaaatctaattagaaagtgaagttagagagaatttgaattggttgtaatttttttaaagggtttttctcacattctgtttaagcaggaagagatttgtatttgttgctctctatttcttctgaatcagacatctgaggaagagcaggtggagaatgaatcttttcatatacctgcctcagttaataatgtgttagagtgtttgggctttcttttcaaataccaggcatgtttttaaatacagcaagagcttggctggtgtgttgggggtgggggttgggtcaaagtcactctcctcttcaaaaacagaactttgggaaacaattttttccttttatctcacactgtgagagaaaatgtactgctttttagagaaagtagtctgagagttgggaaacttggcatgactttgggcattcattttaacctaccctgggctttgatttcctcatttgtaagacgatggggttggagtagagcgagtcca

SEQ ID NO: 21695 - DNA, 1045 bp, Homo sapiens
tatttattgtaatatgctttttctcgagctcatcaaccaagtaatcatagtgtataccatctgttgtgaattcatgagtgatttcaactactgctgaatttttggaggattgatccttccttgggccatcctaaagcaccttactgcactggaagggaaacggggacaaaggagaggtggaggagctgattgccaaacttggttttacaggttcggcaatgcttgcattgggtaggtttgttttgatagcaagcacagcttgtagttccctgctcctaatctgtaggggtgtgtatgtgtttgggcgggagggagggtgggtaggtcgggaggcagaaaggcaggatgttcagaagccttcatgaaagctgcgggtagtaaataaccaagctgggattgtgctttctattatattctgtttcctttctgtttataaactcatttatggatatttctgagatagatttgatttttttcttatgacttcttttttcttatgacttacaggtaagagctgattctgaagaatgtattttccattcttagattatcataataactcatggattaaatctgtttataaagtgaacataaagacatggtaaattttaagttcaggtagatatgtagatataaaccagatggtatagaggacaattaataaataataaacactgttaagaaaccatgctaaacctatcatggaaatcttgttaattgtagtaagcattgtattttcattttgtgcttaggactgggctagatgccaagattttaaattatggttattgaaacaaaaacgagcattattttagtttttcttaagaacataattatggctgggcatggtggctcatgcctgtaatcccagcactttgggagactgaggcaggggatcacctgaggtcaggagttcaagaccagcctggccaacatggtgagaccccatacgtactaaaaatacaaaaactagccaggcgtggtggtgcacacctttgtaatcccagctactgtggaagctgaggcaggagaattgcttgaacct

SEQ ID NO: 21696 - DNA, 1043 bp, Homo sapiens
gctcttttgcccaggttggattgcagtggaatgatcttggctcactgcaacctccacctcctgagttcaggcgattctcagcctcccaaaatgctggaattacaggtgtgagccacagcgcccagccgatttttgtctttctttccctttcctcctcttacctttcctaccttccctcctctcccaccttccctcctctcccctccccttccttcgcttccttcttcaacagggtctccatgtgtcattcaggctggtgtgcacagtcatgggtcactgcagccttgaactcctgggctcaagcgattctcccacctcagcctcctgagtaggtggactgacaggtgtttgccactacacctggctaatttttaaaaaatgttttgtagagacggggtctcactctgttgcctaagctggttttgaactcctgggctcaagtgatcctctcgccttggccttccagagtgctgggattacaggtgtgagctactgtacctggctgattttttttcttttatttcatgaattgttttaaaggtcattttgatgttttcaaatacatcagaatttgtaaattcagattttactatttcagattttatcgtataattgtcaaagtgcctggatgatattgattctttggtattggttgagattaactttgtgatctggtataattgttccatgtctgcttgaaaagaaggtacattctaattgttgggtgttggttaggtctaatgtgttccttagatcgtgattgttaagtatttcattcatcttctatagttttactactcaactattcacagtactatatacatgaagtccttcttccataattgtgaattcatgaaattccccctttaattcaatgtattttgaggctatgttgataaatagcaggcaaattcaggatagggttttttttgttttttttttttttgagatgagggtatcgctctgtcatccaggctggagtgcagtggcacaatcactgctcactgcagcctcagcctcctgggctcaagtgatcctcccac

SEQ ID NO: 21697 - DNA, 1027 bp, Homo sapiens
tagggggcattggaatggtaatgtgctccaaaggaatttattccttacagtgaatgtattttaaaggatttaaaaagatttttatttttaaattttgtgttttcttttttagagacaaggtcttgctctgttgcccaggctggagtgcagtggcatgaacatgcctccctgcagccttaaacacttgggctcaggcagtcttctcgctttagcctcctgagtagctgggaccacaggcatgagcactgtgcctgtccaggccccccgcgcccccacccagtaaagaatagctcttaaggttgtgttagtagtaagttgggagttgacacagagaagcagggtgttcaagcaaacatctaaacattttaaaatctaaacaggaagataaagaggctaaggaatgcttttctcttctgcatggtctttaaaagtaagtattatttaggtttggtttagagtatgcgaccttttacaacagacgctgaattgttgttatatctccagtcttttcaaatagatatgcagataaagaggggaactagaatgattttgttttgtttcgagaggccagtgtggtagaaaatagataaagatgagtgtagatggattcttgagaatagcatggcaccaattttgaattgccaggatgttctcttggttaatagtagttctgtaacccaagggaagcttgatcttgttgcgttttgtttgctttgaatgaatacattatcaggggatggtcaaggttagattccactcttgttacatgttcaatatctttttcaaaacttttgggatcatttcaagtgtctgctctcttactgtctcagtagatccttattgaagctgaccatgcagttaaaaacaacaacaaaaaatcaaacagcttgtcaaatccctgaaaaatcttcagtagacaataagtgtgaataactggatgaaaactaaataaaagtggagagtgtagttgtgtgttgtgccatattactactgtgacatacatttaaaaattataaacaaagaaaaa

SEQ ID NO: 21698 - DNA, 1034 bp, Homo sapiens
gaacccttgactagatgcataggaaaccaggtaatagaataaggatgaagaactgaatatcagtagtttgcattgagagaaatagtgcagagctttttctgttttgttttttagtgaggtgggcatgaggatatgctgcacattttattatggttaaggatgttttcttaggtaaagttctcttttttaatatgggaagctgatgacaaaaaatgtttttagttcacagtattctatatgatttatcattttaatgtgctcttttctgatttaatcaactgagtttatataagtcacttaagaagacttttacaatatggtttatatatagagtttgattagaggaaaataactgaaggcttgtttttataatagtaatataataactatcatttgttgcacccagcaatgtcccataagttgcacaggcactttgcatgcattgctggcatctggtcctgttccctagcagatgtttctgttcactgccttcctaaaaatttaatcaggtcactgtagatgtgtgtagctgcattcaggtgctctactaaatagtgggactttagaaattcattagttactaaacattgagacaggagcatgccctgtccatgctgcccactctaggatgggcttcacccttccttttcaggatataacatgttactattgttgatgtaccttccaacaaattaggctaataaaagtataatttccctaagattatgactttttaaagtttgcagtttatttctctgcaagttcaattaatgaaattgactgttttgtaagatttcttactatgggccaaagaaagagaaaccatagtaatttttgatcctgtgagattgaggctattgcttttccttgaagtcagcccttttggagttgggttggttattttcttgagctgtcacctattcctgattgtcaataaaggctgtgtggtgaaagcattttgttacacccatgtaactagcccttcagcttgtagttcccaccctgcttgtcttaaacacttcagctgttcttct

SEQ ID NO: 21699 - DNA, 1064 bp, Homo sapiens
cttgtagctactttaaaaaattacataaatatgacagagggtgatttagtactatgtggtgggatccgtatcaagggtttgcatgcctataatggtatggagtgtatcagatggccctgtcattcagtgagaagactgctgcagaaaaaacacaggtaaaaataattgtcttgcaacctcaaaaagtttgggaaaatgtttaaaaaatgtaatcatttccatagcttaaaaaaatctccactcacctgttaaatgaaaactcttttcagccttaggtcagtgtgtacttttggagattctgttgtgtttgcagctaaaatgtttctgaatttattcacaaagatatttctttggaaatgcaacagacagaggatgcatagagagatgggaagagttagctatattgagtatgttctcatttgtgtctttggcttaagtaatatttgtcaaaatctcttgaacatactaaatatttgtcttaatttcaagatcttgcttgaaatgtaaccacactgatatgcttactttcccttggctatgctttgatggctaaaattaaggactaataacgaaatgactaattctacccacccaaattaatcttgttcagaattagtgatatcttcaagtttctgtaactggtggttgactgactcagttaagagcgggttttgcctgagcattaaaatcatcttaccatttatgtatcatttcatcattagctatattgttcctcccctcccccaacccaatcttctcttttgcagccttgctctttctttgggaaatagaaaactaaaaccctgggaatgaaatatatagttagtgactaatttcatcttggcttaaatggatatgattcatctagtttttataatcttccggctgttctcagacctgtgtctctttgccccttgggttccatacttgtctttgtatttctgtttctattagaaatgatagtagtgcccccagaatactggaggttgaaaactggcagttctaagggatggatactagtggtctacagatttatattgtttgatcagtggtgtgtttaattt

SEQ ID NO: 21700 - DNA, 1816 bp, Homo sapiens
ctgcattttggggaataactttctttcttctggtttcgtgtttgcatgcttgtatgggatgggcattcactgggataatactcctggcctctctagtaactccctcactttagtcttccctaggggaggagaagtgacttatcttcgagtttggaaaaaggaactgggcctgtctagtttcagctcattcctttcctacagatcttgcattctgctgtgcttgttcacgctgtgagttttataggggcagtcctcctcagggaggcctctgcctggtgagctgcacctgtgactaggtagagaaactggcctaattctggggtgaaatattagccaagaccactcaactaatagagctaagctaccttttccaacctacgctttattagtaataaagctattatctgtgtatatcactctatataatatatcagctgtatattatatatcagataaatatatatttttctttctggctttcctgtcttactggttttgaacttgggctggaaaaataagggtgttaaatattgaatctcttttacttcaacaccaaagacttcatctctaaaatcgagttaccaatcactaactcttaagagttatgtgagggtaacaaatttaaaatgagaagtttttgaaagataaactgtctacagatgtatagatttataaatgttcttgggggtggaaagtagaaacaagctgggacctgttattttataattaactgccatccacagattaaattctagctcctgccagccactctcctgccagatccttggattacaagaaatggtggagggggtggcagtgagtggatacagcaaatgaaaaatatctcgctttgagcatttaactcggtatcaggccctaaatcatagtattatgatatctcagtatatggaaaggagacaatatcagatcaggaaaattaattttccaacaggaatggggaaggttaaaatacataatttcaaaggagaccactaaaaccgagattccttcagcttttcaaaagtgccacaatgttatttggccttctctcagttaatgaacagtgggaaatgtgcttacattggcttaagagagccaaaaccgcaattcctgcaaccacttgagaaagtcctagaatttgggagaataaacccattactgtataaaactagagagaaaatcatttgcagttttctgttggatttgatccattcttccgtacatgaaaagttacggcccatatatggcaaaacccaattcagtttttgagcgctttaaatgaaatgattgaacagtttggagcatgacttgcctgtggcataggcgtgaaatcttaggtaatgactcataagaattactgttgccacagagttttagaatgcaagaattgatctgtctctgaaaatatttatatttgattgcatttctaaataggtaagtgggtaacagctgtttgaatctggtggcatgtgtgtttggaggcatgggggagaatatagactgtactgcttttgtgttagagaaattgtgctgttttattttttcctatctggttaaatagagtacaatagcagaaaaccaatcagttcagggagtggcccatttcagtgtggccctcttcatccacaaagtggtttggaatgaaaaatgctaagatgcagtatttggctggcacttagataactaagaaaagagaattgacttaactgtagcaaagagagttgacgtgaggctcaagtcatcttagggctcctaggagaggatgagaatccattagcacctctatatctggggagaggggtgttgccaagaaggc

SEQ ID NO: 21701 - DNA, 1046 bp, Homo sapiens
aggttctttcatctctttgtattcttatgtctgtttttctgttgtgcaaagggaaccagttctaccaggccctttcatcttgttgttagcaaataagaggtgtgtttaaaaaaaaataataaaacagaaaacccagcttaacgtgcaatggaagtggcttgcctccattcccatcgctgagttcttaatgttgtggcagggaagcccataaagctaaattaaacaaagccacatcaaggctttgtgtcaaggcaataaaccaggcagggagaaccacactgatgtcagatgagcacacagggggtggggaagcaagatgagctgaaaatatttcaggagtctgaactatgccgggtgatttctttccttaagcattagtgaatatatgtaagattttgttgttttccacagaaacaaacaatggcagagagcattttcatataagtaggtgacatttttgtcttaaaagaatcgttgcttgaaaaaaatctcagatggctatatgtgtgtttatgtgtgtatgtgttgtgtgtagctgtattgatcaaatgacagatttagttgttaaaaacaatgcctttgtttttgaagagtcacatggacaaataacgtttcagattttgtaaaacatctgaattgttcccagaattttctgggcttttttaaaaatattgtttgcagaggtgaaataccttgttctctgcctcaatggtgtaggtgcagtagggggtggggactgactccctccattcttcatcagtgtcttctcacacagcacaaaccttctgcaccctgatgcctagtctccaggtaccatactttttatcttcaagttcctgctctgtctggcttttgtttctttatgctgcaaatccctgatgctgtttggaatgcacctttttagttctatagggctgggaagttctgagtgatgaaggcaagtagttcaaggccgcacccgagaccaatttaatatatacatatatatgcatattcatctacatgagtataaggaaagtaaacatataaacctttgatgcttttca

SEQ ID NO: 21702 - DNA, 1035 bp, Homo sapiens
tgtaatcccagcactttgggaggctgaggtgggtggatcacctgaggttgggagttcgagaccagcctggccaacatggtgtaaccctgtctctactaaaaatacaaaaattagctgggcatggtggtgcatgcctgtagtcccagcaacttgggaggctgaggtgggagaatcacttgaacccaggaggcagaggttgcagtgagctgagatcataccactgcactccagcctgggcaacagagcgagactccgtctcagaaaagaaaacaaaaaacaaaacctgtataaagcttatcgagtgaatgtagattgcaggggggtgcttgtcatgatcaacaagtcacctagatatttgcatagaaaatccattctggaaaattgaataatggttctggttctttccaagtctaatgaatcaatcttcaaagctaggttttaccacctgctgctgtttcgccttcatatcatcttgcctgcctgtttgaaccatttcattctaactgccagatttacctgttgatggaacttgatctacttatagtttagcgctggccattcctgacactggtccttgtccagacagtcagcctgctccttagctcttccatagtaacaaccataacctggatttattgaacatagaacttaatatacattataacattaatttagttaacagttattgagtgcttgctatgtattaggcactataccaaatactacacataaatgatttaagtgctagttttatctgtttctacggaggaataaactgatgattgaatttgtaacttgcccaaattcacacactagggagaggtggagccaggactcaaacacaggcctgtctgactctagagtctattctcttaactcctgtgccatgatggtaattccctgctctacctcctgtggtttggactagttgaatgtttctcaaactggggtctgtcagcctgccagttgggtcttaatttcctttatgttcaatcctatatcaaactgaaattatacaagtttggtttcccaata

SEQ ID NO: 21703 - DNA, 1056 bp, Homo sapiens
gtggctgatgtctgtaatcccagcacttgagaggctgaggcgggttgatcacgaggtcaggagttcaagaccagactggccaagatggtgaaaccctgtctttactaaaaatacaaaaattggtggcgcagtggcaggcgcctgtaatcccagttacttgggaggctgaggcaggagaatcgcttgaacctgggaggcagaggttgcagtgagctgagatcgtgccactgcactgcagcctgggcaacagagcgagactccatctaaaaataaataaataaataaataaataaataaataaataaataaataaataaataaaaataaattactggattttgatgcaacattttgttcaagataaatctttgtgaccatggttacctgtaagtttcctttctgttactgttctcatgtgggtcttggttatactatcctcatagaatgggttggggtgttttccttcatttttttgtttgctggatgagtttgcatgagtttggattgatctattttttgaaactttggtaaaagttacctgtaaagctatatgggcctgattttttttgagacattaaaaaaaaaaaaaacttctatattttaaatggctatataggggccaggcgtggctcatgcctataatcccagcactttgggaggccaaggctgtaatcccatctactcaagaggttgagataggagaatcgcttgcaatcggaaggcggagtttgcagtgagctaagattgcaccactgcactccagcctgggcaaggagtgaaattccgtctcaaaaacaaagttataggactattcaatttttgttttgttttgttaacactggattttactccattgtacaggttggagtgcagtggtatagttactccacactatagccttgacctccccaggcttgggcgatttccccactttagacttctgagtagctataggactacaaggtgtgcgctgccacacccagctaacttttgtttttctgttttttgtagagataaggttttgccatgttgcacaggttgatctccaactcctgg

SEQ ID NO: 21704 - DNA, 1177 bp, Homo sapiens
gtgaatcttttaatatctggctggattctcatatctctttctgtattccatcaggtatgctattacaaaagcaggtactgtctggaagtctccactgaaatatgagagtgacagttaggtgtgcggaagaaagtggcacaaagcaagtaacatcttagtattgttataaaaatagtttgaacagccaggtgcggtggctcacgcctgtaatcccagcactttgagaggctgaggcgggcggatcacgaggccaggagatcgagaccatcctggccaacatggtgaaaccccgtctctaataaaaatacaaaaaattagccaggcatggtggcgggtgcctgtagtcccaactacttgggaggctgaggcaggagaacagcgtgaacccaggaggcggagcttgcagtgagccgagatcgcaccactgcactccagcctgggcgacagagcaagactccatctcaaaaaaaaaaaaaaaaaagtttgaccatgtggatcttctgaaagggtctcgggtacctcctctggggtcccccaagcatgcttttagaatcactggactaggaataagaggctctgtaattctagcttgtgttttgcagtgattataaataatcagaatagtggataggcttttttttttttttgaggcagagtctcgctctatcgcccaggctggagtgcagaggcgtgatctcggttcaccacaacctctgtctcccgggttcaagcaattcttgtgcctcagcctccagcatagctgggactacaggtgcccaccaacatggctggctaattttttttgtatttttagtagagacaaagtttcatcatgttggccaggctggtcttgaactcctgacctcaggtgatctgcccacctcggcctcccaaagtgctgggattacaggtatgagccactgcacctggctgaggataagcattctttaagaaggcctaacggccctaatataaaacagtttaaaaacgattatccagatttaggaataattcttccctaagtgattttttttaaatttaaaatacaattaagtctattatactcagccatccaagtaaacaggtattatttaaaaatcaaggtaacactcaacctgtcaaataggtacatggtcagctttccatttagaatcaacttttatttaactatttagaa

SEQ ID NO: 21705 - DNA, 1043 bp, Homo sapiens
cactgtgctggatgcataggacattgagaaatgactaaacataggaattatcctcaagaagcttacaatcgaatgaagagtttaaactaactgcacaataaactatagtgaaaggtaggtttaagaaggtagaatagacggaaaattacacggttggtctagtataatttaggctcatggtataatgagcaacattttgttgttggatgatacaaagctgtgtgtttggcaaatagctgcaggcattggtgagactttgcttcagttgcccttccattcagtttgctacttaatacaaatcttaaaaatatggaaattccttttttatatttttttgtgataataaattatggttacagttctgtgtttcgttatataactgaggaaagggctttatatgtttcagtggttcgtgttctgaagtagaacttgcactaccaagtgtcaagagaaatatcagagaagcatgtgttgttggacacagagcagaagaccatattttgactcatgagagttttcctttgctctgaattttgcctgctaaagccagtctcatagttttaattacgtgatactgtctgttaagtattacagggccagacacagtggctgacacctataatcccagaactttgggaggccaacacgggaggattgcttgagcctaggagtttgagaccagcctgggcaacatggcaagaccctgtcactacaaattgaaaaaaaaaaaaaaaaaaaaaaagtcaggtgtggtggcacacacctctggacttggaaggctgaggtgggaggatcccttgagcctaggagttcgaggctgccgtgagctctgatcacgccacctacactccagcctgggttacagagtgtgaccgtgtctcaaaaaatgaaaaaaaggtattacaactttagaatagtatatattaatctgctatacctggtagcaggaagctatttggtaaccaaataacaaacaggggaatctatgttacattagacaacttttagttatcttcatcttcctctaaatacttgaggaagat

SEQ ID NO: 21706 - DNA, 1511 bp, Homo sapiens
agctaaaaatagaaatatcattccacccagcaatcacactactgaatatgtacccaaaggaaaagaaatcatttatcaaaaagacaccttccctgcactcatatgtttattgcaacactattcacaatagcaaagtcatggaatcaacctatgtacccgtcggtggtgaattggataaagaaaatatggtacatatataccatggaatactacacagccataaaaaagaacaaaattatgtcctttgcagcaacatggatgcagctggagactgttatcctcagtgaattaatacagaaacagaaaaatactgcacattatttcttaatacatgggggctaaacagtgtatacacatggccataaagccggaaacaagagacactgaggactctgaaagagataagggatatacggtttgaaaaactacctattgggtactatttggtggtacccaaatatttgggtgatgcctaaatgccagcattacacaatttacccgtttaacaaacctgcacatataccttctgaatctaaaataaaatatacatgtacttgaacttaacttacccccaaaatggaaacaacccaaatgttcctcagctcatgtgtggataaacaaggtgtagccatatgtgaattatgaattatatctcaataaagctgttaataaaaaaataaggaaaatagtacctcaggtatggagggatacttctttaacattatatacacacacacttagtcctaaagccaatttcttaatggggaaaccccattggtatttctactaagatcagtaacaggacaagaaagcccgttattttcactcttattcaatattatattagatatattagccaggtaattagacaagaaaagatcaattagaggcatgagcgttgggtaaagaagagagaaactatctctattgcagttaacatgatagtatacttggaaaaccctagagaatcactgataaatgaattcagacaacaaagtatttcaacaaagtagcagggatataaagttaatatgcagaaatcaaaagcctttgtatacacaaacatagccattggaagacatattatattggtagtgaaaatcccatttaaaatagcatcaaaggaggttacttaagaataaataagaaatgtgcaaaaactgtatgaataaaacgttaaaacacttctgaaatttgcaaatttgaacaaatgaaacaatattccttgttcttagataggacgacttaatattattaagatatcagttttttgtagattactttgcaaatttaacacaatcatcatgtaaataccaaaatgcttttatgatcaagttagacaaattgatgctactgttcatatggttaaaagaatcatataagaatagccgggaaaacactgaaaaagtaaaactattaatacaagggagagacaaaccttaccagacagctaaacatgtatgttttagttctttctgctgagaagaaggcctagaaatagtgacacgcca

SEQ ID NO: 21707 - DNA, 1043 bp, Homo sapiens
cgtattcaagtgattctcatgtgtcagccaccttgaatagctgggattacaggcttgcgccaccacctggccaatttttgtatttttagtagagatggggtttcaccatgttggccaggctggtctcaaacccctgacctcaagtgatccaccctactcggcctcccaaagtgctgggattataagcgtgagcctctgtactcagccttctttgttttttgttttgttttaagaaattcctttaaagttcattttaatgtttgagctatagttctcatggcacggagattttgtgagcaataagaaaatctattaggattttttagttaatgcttaattttaaacgtggagataaaattaagtgaaaaatataggaagaataaagaacatggattttctgttattcaaagaaaattaaaaaattttttttgcatttagcaaaatctattttaaatgtttatggcaaagtaacagataagcctccttttccacatttgtctagtgtattataatgaatggtcagactgatttgcatgcaaagagtaggagtatagaattccctgaagagcttctctagaccatctctttcttgtttgcacttgttcttttttcagtgtgtggacctgagctgtaatgagctaagtgaagtcacattaccagaaaacctgcctcccaaactgcaggagctagacctgactggaaacccgcgccttgtccttgatcacaaaaccctggaactactgaagtaagtattctgtaaagcactgtatccccatcattgtccactggcaatgggattcatatcttagtgaaaatgggaaacaaaatatgaagcatcattgacttgttagctgtgttaacacacacaacaggatatacaagatgcagggaagcaatgaacaaccaagatgtaacttaaatctcagtagtcactgataacgtggttgtgacagttaatgcaaatattaaggaaggattttaaaagagatggatgatgtagggaaaattaacagtgtagcgctgaaatccaggttatttaaata

SEQ ID NO: 21708 - DNA, 1051 bp, Homo sapiens
aaaagagaaacttaagtcttgaacatcatatgtttattttacacttagagcatatctcaatgaagaatagccatattccaagtgctcaatagccacatgcagctagtggcaactatggtagacaacgaaaatttaaacgactattttatggctaattagaaatgatgattgttcataagagaccatatagatgatggtgtttttggtaaagacttacttatccctcaagtcacatttcaaatgtcatctcttatgttggactttctctgagaatcctgggcagaaataatccctttcccatacatattttcctagcatattttatattgctttatatttaattcattctataatatttaactctttattttttattcaaattgttgggcttgttgatggcaagtccagcaagtctacatatttctagtcacatttccttgcctataacttattaatccatttatcaaatatttattgagcacatacttactatcatgtattattctttgtgcttagggtaaatctgtagaaagcaaagtcactgcccttcatatggcttacagttttagcaatcagtactcattaaaaatattattgaattaaatggaatttaggctttaaacctgtggtagtagccactaaacaatggattaaacttaagaaagtgatatttaacagatacaaacataaatttatccaatttggttttaaaaaactttctttacagagttttaggctaggaaaaaacctagtgggatgtaatttacattactgagtgattttaaaaggataccagattcaacattttaaatatgttaaaaaaaattagtggagttactttctctttaatataagtagccttagaaagccaaatacctcatgttctcatttataggtgggagctaaacaatgcgtacacatggatatagcatggtggaataatagacgttggaaactacaaaaggtgggagagttgacggggagtaagggttgaaaaactacctgttgagtacagtgttcactgtttgggtaatgtacaccaaaagtccag

SEQ ID NO: 21709 - DNA, 1017 bp, Homo sapiens
ttacactacaatacctaatgcatataataaattgttaacatatttttgttaaacagatatgtaaattcctgaacaaccagaacaatctaagtgtcacacatggctaaatttcagctagacctaaatcttttcttctatttccactcagaagtagaggtcatatgacacaaaagagaaatgataaaacctcttaaaatatataatcttctgcttacttaggcagagtattcttcttaatacagtgattagcaccagagtctatgaagaacagttaattcttgttctatgtaaacattaaattctattttttatatgcgcttacatggttagaaattaatattttctgagatcattcaaatgttaaaattatctaaccttccaaaataccatgtttttctttgccttggacaagattgggaaataaagcaaactgcataacacattaatatccttgatgtgtattgtaccttagggctggtatacccacaggcactgtagagttttactttgattgaagacctgagaatcagaagtcaagtttatcagtagcatgaaatacatttacaatagaatataagaaataattgatatatactatatatagcaatatatttatgacaaaatttattataattaaagaatttataattttgaaatgttttgtctacttagacattgatttaaattaagagaccgcctaattattatataactcttaccctctttatacccttactgactctcatactcattcatttcttacacccttttgttctcaactggacatttctcctccttaattatgctgttcaacatgtgtaacaggtgtcttatttctacctgcctccatctgtgcatcccatcactattttctctcaacgtccctcttcattccatgctttacttaatttgatttctcactaagaagtcctactgggttctactttctttctactacaattgctttcattttggggaaactatgtgaaaaatttcagaaactaaagttgtatatga

SEQ ID NO: 21710 - DNA, 1049 bp, Homo sapiens
gttttttatttttgaattatactcatcccagtgggtttggtttctcattgtgattttcctttgcattttcccaatgactaataatgttgaagatattttcatgtgttattggccatttgtatatcttcttggcagttatgtgtactcaaactctttgactaattttaaattgagttgtatttttgttggagaattgtaagaattctttatatattctggatactctactcatatgtatgaaatgcaaacattttgtcccattgtttatgtcatattttcactttcttttgatacacgcagttttacattttgacgaattctattttttttttttttttgtcatttatgcttctggtttcatatctaaaaacccattgttaaacccaagattctcccctatgtttatttctgatacttttatacttttacctgtcatatttacaccattaatctattttgagttaatttttgtatatgtaagaaagaggtccacattcatcattttccatgtgaatatccagttgtgactgcaacattttttgaagagactatttttttctgccactggattgtcttggcatactcatcaaaaatcaattatccatataggtatggtttatttctcaactattttggtgtcaattctattattttggtgtgaatgtttatctttatgccagtgctatactgttttgattgctgtaagttttgaaattaggaagtgcgagtatttcaactttgctctttttcaatttcattttggatattcaaagcctcctgaaattccatatgaatttgagaatcagcttttccatttttgcaaataaaaaaaaaacgccattggaattttcagggacttcactgaatctttagattgcttttcagagtattaacagtttaatgttacgtattcttatctgtgcatatatctttccatatatttgtgtctttttatttcagcaatgtattgtagttttcagctgataagtctttaacctccttggttgaatttattcctatgtatttcgttctttcaggtgtacttaaaa

SEQ ID NO: 21711 - DNA, 1076 bp, Homo sapiens
aacatgactattcacagacacattgtatgcagacaaaatagtgtcttctacagacattttacatttcttactcaaactcaggtgagagattggtgttgatatgtgtgggttctgaaggagtgtctcaggatagggtggtgtgtgtgtgtgtgtgtgtgtgtgtgtattcaggtacacactcaagtaatcaaattatcttggagtgcccacagtttaagaggcagtgtacactggtgtttgtgtgtgtattacagagtcatattgtgttaagcctgaattagttataataaagaacccctgcatcattgctactgagagtacatcgggccagtcattgtcactttgcaccaacttcgctgtaggggaagcagggaaatgtggagggacagattgcgagttttgaagagcactaactttatgagctgagcacctattgagaattttgctttttcatatttttgttttaacatcttattgtggattcacctacctcttgccctttctcccttcttgattaaaaccttaagacacctccattcctggcttaaggataattgatctcctttctgtaaacactgtgagttttcctttcctctctcaacagctttcctcggagtatttgttcatgagagatatttatgaaaattcacccttttatagaagctcaatgattaaaataaatagaaatagctggacacggtggctcacgcctgtaatcctagcattttgggaggctgaggcaacatggtgaaaccccatctctactaaaaattacagaaagtcagcggggtctggtgatgtgtgcctatagtcccagctactcaggaggctgaggtgcgagaattgcttgaactcggaaggtggaagttgctgtgagctgagatcatgcctctgcactctagcctgggtgacaaagcgaaactctgtctcaaaataactaactaaataaaataaaataaaataaaataaaataaaataaatagaaatgtgcatatgtgcatttgtatattttgtcctttagaccattttacaatttctttcatctccaagtctgtaaaaactagtttgtaaagaga

SEQ ID NO: 21712 - DNA, 1013 bp, Homo sapiens
tttagagaaagtgaccatcaagctgacaagtcgtgaattaagaagtgtttgttaaaaagttctatgcataagacacaacatatccaggtaacaatatgtgtctagatgagatgagtgtggagtaatgagaaaagatccagaataagggtgcttgtagtgttctaagaagctgggaagttactgatgtgttttacaagaggggttaaatgttcattgtcaaattaacaaaattcctgagcctggggtgtagaatagattgtagtgaaataggactgttggcaaggagccaataagaagtgagtttcagtatctaggaaaggtactgtatgcttccacaggctagccaggatggagaaccattgccacagaagtattttgtttttctagctcttgggaaaaatgagtctttcacctactattgtttgcattgagaatccatctggcagtcttatttttgccatttgaaaatgattagtctcttttcttctgtctgcttttaacatgttctttatctttggttttcaggagttttgttatgacatgtagaaatatagttttcattccattcatctttcttgatgtttatagggcttcttgattctatggcttgatatcactcatcagttttgaaacattctccaccactacctcctcaagtatcagttctgtccattctttctctttgtccttactcgtatgtaaggaagcagatatttggcaagtaattactaccttatctcaaagtgtctttacgcttttactctttcatctctttgcctctcagatcttcaagataaatatttttcttgcatttctttcagtttgctaattttctattcaactgcaaataacctactgttaaaactattcattgctatcaatttcgatgattttattttcatgtctagaattatcatttggttcatttaaaaattatacaaataaagtatcagttttatctttggtagttttcgatgccttcgaatatatatactttttgtatgtgtgcagca

SEQ ID NO: 21713 - DNA, 1030 bp, Homo sapiens
ccacctctaatgcagtgtctgtaatttgtgatgatttttgcattctcacagttgtaatttctaagcctagtataacaagttaaacctgttaaaaagagagaaactattgttttcatttagatgcacagtataagattcattgctcttatctctggaatttttccaaagataaattggttaaactattcattatcattatgaaacattattattgattatgaaatgctgataaattagccgtttttatctaatgaaatttcctttttatgaaagtgaaccataaaaacaatctcagtgcataaagggttatgcagctgcttctgaaataaatttctaagtgggcattttacatcattgatcttcaaaactcttaattatcaaaaagcttttaatctgtagagggacaattataactattagatctacctgtgttggaaggtctaggatttgactgattacgaaggagaagaaaaagccatcatttccaaaaagtcttaggttgtctacatcaaaactgtcatctttttaacatccaattttagaatatttattatgcctgtatcttcagtctaagcattcagaaagggactgtagttaatgacaaggaaagtaggtcatttttggcttattcagatttaaggtacaggttatttctttttactttcgcttttttattattttttgagagcaagggactattctcttcaaaatataaaaaagtctttcatcataaaaatgagttgctctttattaaaatagcaatcacaaaacgtagaaaacgataaagaagttagttggacttacccaaaatctcccccgcttcctcattaggattagtatcattattcattctttgaatgaatctacctagatgtttttctttccctaattggaatacatacataattttattttgcaaaaatagcagagagtatatgcaatgctttataggaatttttttcccgcttgaaaatagattactggccgggcacggtggctcatgcctataatcccagcactttggaaggcc

SEQ ID NO: 21714 - DNA, 1038 bp, Homo sapiens
tttataaccaatttatctcattagtcgttttaatacttaaattgttccaaatgtagccagtgagagcttatttaagctgacttctgggcccttttgccatttcattgttagtttttaagcacttctgtactttctggcacaatatataagggatataagggagaggagaaaattcctcattactaaggaatgacaagtgaaaatgcaaaatgattgatgtaaatagaaagacatatttttcacaattactaaagcagtcactgaaccactcaaacatcatcaatcgttgggtgaaaaacagaaaacaggatattcacaacttaagtaataaaacttatcaccaatgataggtcaggtgtaattattgtacattgacatgatgcaataacaaggagatatatatgttaatacatcaatcatatatcaataaaatatacatatattgaggtatattaatatcaatgttttatgcaggtgtagctaaataatatcagtcagtttatgctttatgtaaaactgttagatgaactcaatcaatgtatttgtacatgaatatattaatgtttccgtatctatataacatcccaaaatagtaattaaatattaagtcatgcatacccttcatgaacactgaagaaattgtaacaaattgttgatatctggcaaactcattggtatggtaaatttatataatcagttatgtgtttttattattttgcaactaaaccactgaatatactacttttctactcataaagacgtgttaaaatagtggcttcttgccttataattgtattgccctctttcattcttcataagcatcatttaaaagcctacctctgcctttcctgcagtctcatcttgacttcgatcatgcccactttttaactgtcagagcagcaacactttctgcttcatacttggtcttttgaacctgtcttgtttctgtgtgtgtgtgcacgtgcaaaataatatggtactatgtttgaggaaagcacagaaaagccttaaactgagttacatttcccgaagtgcctt

SEQ ID NO: 21715 - DNA, 1032 bp, Homo sapiens
atgtgattcccatacctagccctcaatataaaagggatgtcgagccagttaatacatgagatgaaatgtagaagcatgttttgcagggttctgggattacaggaatacaacgttttcctcagcttttactttgctgcagatgtgctttcggtaatatggtcatcataatacacttttataggattaattctgagctctttgaaaggaaccaattcattaatacaagttaatattatgtaacttaaaatattcttctccaagtaatcattaactttggcaaattttcacacacaaaaagaaatactccttatcacctgtggtatcagttggaatggaattataatttcttaccatgagcagaaaaaaggtatttaacactcttaagttgagatataaaaataattgagcaaattgcttagaattttataaagggctttgaatgaaggatgccactaatatgattaaacatttcttttgcatctgtttagtctcttgtgagtgtgtggtagggacctgattttaacttaattatcagaagcattaatagatttagacacaaatcaagagggaaaaagtcaatttcaaaacttattagtaaattggcacactcaaaactcatttatttctccagcttctaaactaatgaggtgttacagtctatttgttggcatattaataaaactgaatgcctttttattaatcaaatatgcactacttgaaatggtaaaataaatacaagttagtagtagtgataattcaaaataagtttaactttaagatgaatgataaattttagtttttaaaaaatattttatggactctatcattttaaatatccttattggtatataatttaaaagattaaagctaataaatgatacatgtgggaaacttcctttttatttcccaaatgtcatctaacttttgagatgaaaagtttaccactcattttgatatgataaaatgagtgtcaaagatatgaatcttgactataatattgacaagaaccaaacagatttttatttgctagtt

SEQ ID NO: 21716 - DNA, 1033 bp, Homo sapiens
tagtttgagtaaaaagaagtggaagttagtctgaaaaggcagaatggagatggtgtggatggccttgtgtgtgggatttaggcagttagaatttacctgctagacaactggatgctctcaaaggtgccatgaaattacaaaagcattagtatgattatttttattgtggtttatagaacagtttggagaagaagagaaggattaaataggaaaccaacttagcaaacttaacaataatttagtattatgccaaactttaagctacttcgcttttctgcctgaccgacccattttgtaagcaggaataatgatattgcctgccttgatggatttgggtgtggcttaaactatgttaatgtttgtaagtcactttacaatggtgggaaacagaagaaattaagatgttagttattattactgaaagtcaagattgttgctgctaccctatgaaagtgatgaccaaaatgttgacccaagagaaaaagataagttaagccataaaattaaaataatattaaaacaaatctagaacccctccaagtccagttacgtagcgctacacgaaaagctggtacattttacacagcagctaacattaaatttaggagaacaataaaaatgaaaatataaagtaggaaagaaacaccatgtactttttgcagtttcagagattgatttttttttctgagtaaaaacgcttgcttaagacgtttcatttcaagggagctttgtacatttgaaatcagtcattcttgaagttatttcttccatgggctttcgagcctctgaagctttcatgactcgttcatgcaatgaggtgaaaagcttctgttcatacaccgagcgtggattagttcctaaggctgcaaggtgccatggtctcaaacatcatttagttgagatcttgacatttcttttacttttgattttaaaacatacttattattgcagtcgatttgtcttcttctaatgaaaggatagaaagattgtccaaaggggtattttcaaaggagtctgctttgggacaaaaatc

SEQ ID NO: 21717 - DNA, 1028 bp, Homo sapiens
actcataaagaaggaatatgatctaatttattttatgaagccagcatagtaacatctgatattattttgttttaacatatttttaactttaagtttaaaaattaacaaaaagctacagcaatataccatagcaggaaaaaggtaaatattcgagagcgatttaattactatataaaggaaaataacaagtcttatttataaacaaaatagatcatttccttggatataaaaaaaattaaaataataaacttcttccaaaacacaatattaaaatataaacctctcccatgttaatactgcattttaatatagttcctacttggatgtcaacaaaattttacttttggagtagggaaaattatttaaaatttatatggaataatatctatgactaaccaaagacaatatgttaaagtctaaaaaattttcaaagaaaatttggaaaactgtgtgcataatctagggagagaccttctttataaagacagagctccaaaactataaaacacgacaactgatacatctgagcctaaaaaatcaaacagctctcctacagcaaaggattcacaagcagagtcactacacaaattagagttttagaataatattggaaatgcaggtaacagataaaatgttaaaaactataatgtgaaaaaacccttataaagtgacaaggaggaaatgttaacaattacagttatgcaaagattatgactaggcaattcacatttttataaatacaaatggcaaaattgtttttttaagaagacttaaattataaaattgttagagatataaaaaatcaaaatgataatgagaataaaaccaagattaaaaggaaccctcagttcaagttataaatttatttaaaatcttataacagcctttaatctattttgatttgatgtttggatgtagtataagataagggtccaatttcattattttctatgtggatttccagttttccaacactatttgttgaatagcttattctttgaccactatgtgttcttggcacccctgtt

SEQ ID NO: 21718 - DNA, 1041 bp, Homo sapiens
ctgagtttatgtagaaattcttcgatattttcttgtagtgcttttttttccccatttgctttctctgaaatttatatcaatggaggaagatacatggattcaaatttttttttttccaaatgactaccattcaacagtttattgaagaggtcagctttccctaactgacttgagactctacttggaccatatgtttaactattatatgaactgggtctatttcttgactttctgtactgttgctttactgacttttctgtactgttgttttttacaagctgtctgtccattttgcctagagtttcttagattaaagtctgactcagagtaaccaatcttttcatagcagcaaaaaaaaaaaaaaaaaaaaaaaggaaaattctagcatcgttaaatgacaataaagattaaactgttaacagaataagtgttaattggttttaactgctctgtggaaaagctgtgctttgaagaatttcattatgttctataattaaacgttaaattttaaatactgaatagaaataccactgggtttttaggaacatgctcctactctaccccattactgagagtttaaaatttctgtgttcacagagactaaatatttggttattaaatatgtacacaatattgcaaaacttacagtgacaatgaaattatacagctgtgaagatggacaaaattgccagatgtcaactaattcatctgtagcaaagttttatctatagacccacaaaaaattatcttaaagtatctacacttactttaagtaaaatgtctccataatttttgacttggtaaatttctttcacacatcatgtgggaagaaagagtggcatttcaaagtcacgccttcatagagagccaagtttgagagttacagacaagaaaaagagggcgtggtctagtagttcaatgctagtaatattttctccagaaaattcctccacgcaccatgttagggctgattctgcccttgaaggcaactaagagaaccatgaatagtggagcacctcctctggagttcggtttccttca

SEQ ID NO: 21719 - DNA, 1031 bp, Homo sapiens
atatatatgtctattcctattttacaatgggtttggggtgtcaggaattgatgtttagtattttttcagatccttcttgtgactcatagctatgatcatattattttactcctttgatctaaggtaatatatattaataaacttccaaattagagccacgttagcaatcccaggatataccttatctagttgaattgttttctccctaccactcccaatgtttgctggtatttacggtttgtacttcaatgttcataagtgagatcagtttgatttttcttttttttggtcgtctttgtcaaattttggtatcagtatacttttgacctcaacaataaatttgggagctttctgttttctgtgtgctctgaagtgtgttgtgaattttggacctatgtctttattgtcctccccttttttctttctcctgaaggaaaaagagccatggtagctccttgatcactttctcagtttccttgacaattattagcttcttttggatttctgtgtcttctgctgcaaattttgatgatatatattttgctataaaattatccttttcatctgagtttcaaattaattttcatagaattttcaaagtagttttacacattttgattcctcatgcatgtgtggttattgctctatttctgattttgtataagcacattccctttcttgattatgccagctagttgtttaccaattgagttttctcttgcataatcaaagaatcaactcttgtaatgtttaatgctgttactttttattttctaattcattaatttgtgcttttatctttattttttctgatttttcttttgctggctgggggtttataattagcgacttcttgaattgaatgcataatttatttcttttaattccttaccaggtagttttgtaagtgtttaaatctttgaatttttctgtggacccagttttagggtcttgcagaatcacatatattttgatatgtttttttgtttttgtttttgtggttttttttgagatggagtttcgcttttgtt

SEQ ID NO: 21720 - DNA, 1032 bp, Homo sapiens
tcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatca

SEQ ID NO: 21721 - DNA, 1084 bp, Homo sapiens
ttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgatcatagcttcctgtgatagcatttttttgtgtgttacctatccttttggtaaaatgttttatctgtgatttctttagcttagtcaacattttcttgggtgaacttgattgtcaactaattttcataaatggactggattctcttgcaacattaatgtttataaaaagttttaaattgatttgaatagaaagaaaacattgttttaaagttggatttatatttttcttctatgtagttactataaaagtgtgctggatttgaccaatccttacccccactataaagagaacccgtgatgactttagtttaaaaattgtggaaattgtggagcaatttttctcacaatgtgagaaaaattctaaaccatattagataatgtggaagtcatattgtctatcatatatactgccatttaaaaataggtttttaaaatttagctaagtcttaagtaatttgccgttgctaataattttatctccttgagtcggttgttggggagagatgttatattcaataatttttagttattttgtaatgcagagtgtttattcatttcacagttctgcaatggatgtagtattttgggattgccctgtccagaaaattttcagctacacacctttaaaggaaaatgtttctatctcagatgaaacatgtaatttgggatggttcttcctttgtcacttaaaggaagagataggaaaagtctcttacccactttaaacatgagggtaaaggtttaggtcaaacttactggctttgtcattcaagcatatctgaatcctcacttttttctctttgctttttagggtcagaactgagatattaccaagaaaaggcacaatgccataatattatggtgttatggtattttgacttaaaggggaa

SEQ ID NO: 21722 - DNA, 1065 bp, Homo sapiens
ggtgactagggccttacagcatagtttcaagtcgagtaatgtaatgactccagatttgttctttttgcttagtctagccttggctatacaggctcttttttggttccatatgaactttagggttgttttttctagttctgtgaagaatgatggtattttgatgggaattgcattgaatctgtagattgtttttggcagtatggtcattttcacaatattgattctacccatccatgagcatgaagtgtgtttccatttgtttgtgtcgtctatggtttctttcagcagcattttgtggttttccttgtagaggtctttcacctccttggttaggtatatttctaagtcttttattttatttttttgctgctattgtaaaagaggttgagttcttgattatcagcctggtcactgttggtgtatagcagagctactgatttgtgttcattgattttgtatcctgaaactttgctgaattcatttatcggttctagaaactttctggaggagttgttagagttttctaggtatacaatcatatcattagcaaacagtgacagtttgacttcctctttactgattaagatgccctttatttctttctcttgtctgattgctctggctaggacttccagtactatgttgaatcgaagtcgtgagagtgagcatccttgtcttgttctagttctcagggggaatgctttcaactttttcccattcaatattatgttggctgtgggtttgtcataatagcttttattacattaagctatgtcccttttatgctagttttgctgatggttttaatcataaagggatgctggattttgtcaaatgctttttctgtggctattgagatgattgtgggatttttgtttttaattctgtttatgtgatgtatcacatttattgacttgcgtatattgaaccatccctgcatccctggtatggaacccacttgaacatgatggattatatttttgatatgctgttggatttggttagctagtattttgttgaggatttttgcatgtatatttatcacagacattggtttgtagtttt

SEQ ID NO: 21723 - DNA, 1059 bp, Homo sapiens
agatcatgccactgcactccagcctgggtgacagggcgagactctgtctcaaaaaaaaaaaaaaagcattctcctacctgtgaaatatctgttcgttgttcaaagtttgctaaaaaacggacaagtagagagaaaaatacttgcctagaatccaaagacagttagtattttgaaatctaccaagattttctgttgcttttttcctagttgtgatcatgctgtatagacatctttgcatcttgcttttatcttgtatcatggtgacataagaataagataagcatttttgtcaaagcatggaatgttaggtctgaaaagggtcttagccctgctggtccgggggattactttacatggtggggaggtgacacccagaaccacctggcctggtgcggccgagcctgcatgctgggcgggaactaggaagcctccccaacctctggccccgtggagccctcagcctcagctgcagtggaggcacctcgggctctggggcaaccaagtgtgacaggtggctgtgcacgggcagaggtcctgtggaagatttcatgtgacgggcagaagaggaggaggaggcaggggaggaagcacatccatgaacagggctgtctgggggcagcctgggtggtcgtgaaataggactcagtagccttgagtcctcatttaggccctgatgttctttagcctgcctggcctttggcaaatcgccagcttcacgcacaacctcatttttcacctttgggtgtgggggtcagagtcgggagagcacctgcaaagccacaatgatccagacacacggcaaggtgggcacattcccatcaggctcctcggggagagcagcgcttctgtgcccgggagcagcgaaggtcacacaggaggacccgcacctcctcgtgtcggtggctccgctggtataatcaggactcacgtggtgttcctcgtgtcgtggcccttattgcagagggagcagcacaggctttcctggaagctcccctcggtcatgtggggtgactccagagagccccaccttgcgagactggaccagtccaagtggcctgg

SEQ ID NO: 21724 - DNA, 1036 bp, Homo sapiens
gcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgat

SEQ ID NO: 21725 - DNA, 1046 bp, Homo sapiens
tagttttagggttgtgacaaaaactgccttttaaagttttgtataagttgtatgaacctagactgattttctttgaatcttcaggatcagttttaagataccattacccccttttgccctgccccactggcaaatcttaactaccgtatatcttgggtttaagttagtttgacagaagaagctgaatgtattagatgcctaattcctattaggtcgttaggattaagagttcagaatttaagttttgtgtactcaaggtttacctgctcatgtcatggtaaaaatttcaaaaatgtattgctttgtacatcatgttttaagtacatgttatggataacttcaggttaagagccatttattttactttcacttttgggggaatctttttttttttttttttttgaaaagttgagtttcttacttgttaaaaatatccaaatgtgatcgagagaggaattttatagaatataggtgtgtttatatttaggcacttgatggatagttaacatgaaaatctgttatgactctgacatagggcttagtgagagagaaagtaagaaataatagaaactatacctattttttatagttaatgcttttatttaataattttgtgtttagaaaataggccaaatgcatatttttattacatccatgatctttacctttatttctttcagtagtcaaaaacgtaaaaatctcgatgacttacaaaagttattttaggcaccatgtcttgttaaattcttttaagtttattttattctctatgtacatataaggtagtatacctggtactctaaatagtatttatgcagtgcattgtggtctaataaatagccttgattaacttttatctcacttgttgatttccatagctttgtggattgcttaccttatccttcttatccccattttactgatgggaaacttaatattcaaaatgttttcagtgatgtacttaaattatttgactagtaatggtagaccactctttcttccttttaactatttcttttctatatttctccactttttgtaatatc

SEQ ID NO: 21726 - DNA, 1032 bp, Homo sapiens
atcttcttgtagagtctcaggattctgtaaccttcctgatccccacagtagaatattaggtgggtagccattctcctgatttcctttgcctgttccgtatttttttttcttgttaaccttcctctccctgttctgtttcttacagtcctttactttgtgggtacttttgctgtttcttttcacaagagctggatgagaaggaggtatgagaaatgcagatagaagggaggcataactgctgatttattatttgtttatgatttctcatttggcagatcctcgtgttttcttttttgtgtgtgggcatggtgacaaggtggtgcccgggctgtctgtgttgcggaagccactctaggagaaggagcaaggctgagtgagaacacaaggctgggaggacgagctctgctgaggagcagaaggaaaatcttttctcacaggagggttatctttgagttgggtcttaaaggatgaggggccattcacaaggcacatttggacgtttttaacagagcgaacatgaggggaagtacagagatttggaagagcactgcaggcaatttctgaagtgtatgtgactaactgggggaagtgaggattaaacaaacacctgttggatgtcagtatatgccagcactgtgttagtctttagggttaaaaaggtcaaaacgacacctgcctcagatggagaaagcttaggtcaagaaataccaagtctccctagctgcttcagaaaacacttccttgggctggtaacatttgatatgcagcaagtggaagttaggcagattagcaggggcagcccattccaggcgggggttgcagcaggatcaaccatggcgtgcgggatgtgcacgaactacagggcagtcaagacttctggaggctggattgtgaagccaggtggacagttccagggacaattgggtgaggtgggcaggggtcaggtcacagagctgggccatgctgaggtgttgaatgctggcctttccctctgctttccatcaactcgttttttcgcttgtctttcttccc

SEQ ID NO: 21727 - DNA, 1035 bp, Homo sapiens
actaccagcggtggtgggaaggtactcccccacccctccacctccattcttagggtagcgttcccaatcacggtgtttgcctttctctcaggctctccttttgggggcatccagtgtagagaccatttgttgttttgtttgctgtttcatcatatgcctggtacttagtaactacttggaagttagttattgaccaggggttggacaatggtgcctcagtgtttctgtgtttctctggctctccacctcctccagctgagcctgcagcttgtgtgcctggcctgtggcacgtgctcatctctgtgaagtgctgacctggacctggacgaactgcatctctgtttttagtcctctcaggttagcctggttagagtagaattttcagaacgctccttgtggggaaaaaaagaagtaaagttgttacaaaaataattgaaaaacatctaaagaattgtgcaaagtagaattctcttttttgaggctcaaacacagtttttagataatttaattgacaaaacccgtagactccctgtcctttttcctcaaccctctctgaggagagcccattctgtgagagagcgatagcttcaggcttagtgggatcttctcccacagcctaatttctgatgttctctgtagtctgacatgtagtctttattctgtcccaggactacagtgataggaaccaagtaacatgttcacatcaccagagtctgatcaccgtgccaggcattggggaatatttttgagggagttcctgacagttggactggatgacattaagattttttccaacacaaagattctaggattctgtgtttttataacccccagttaagaccaggatgctcttggacttagattaacatgtttatttagtttaaagaatcgcatcattattttcttaaaaaattggtggaagttagatgatttaatgtagcatataaataagagcacaaaattggatgtctgaaagatcttaggttagatcccatctccagcactcattaggataggcttgggatgaatctgcat

SEQ ID NO: 21728 - DNA, 1045 bp, Homo sapiens
cggtattcccaaacgcaccgagtcacgttcagttataagcacaattcagtgggaaactttgttctctaaagagcgttctttttgagattttacagattgtaaactgagtatcgtactgtaaaccgaattatttgcatgtaataatttgaaaagcacctgacaattagaatggacttagtttaatcacagttcatggaaaactaaggagtaaactgactttacaggaagcttctgtgaatggcaaaggttgcctctttgtttaatgaattaccttcacgtgagttcgaactttagttatctagtaattttccctttggaaaccatctgagccatctcccaagaacatatcagaactcagcaggtggtattccttcttgtcatttttatggcctttggaggaaatgtgtttgactataaacctacactttcttcaccagtttatttaattggaatgctgaaaaaaaacctgatcaacttaacattatttattgttttctgttttttaaacttagagacagtgtggcactcatcataaacattttactataacagtaactttaaagttgtcaaaactatataattttttgttagcttttttcttttcttcacattatataattagtaatagaaaaactcaaagtcttaaggattatagaaggttgtttttattataaaggtcagggagattatgattgctgttttaattgtctattttttttcagggaatatgaagtataatgccttctgttatcatggctttaggaggaattcagaattgatataaataagtagacattgaaacacccacgtgaagagatgtggttatgtgttcatctgtactttcaaagtatattcagagcccagctgctcaccatctatcctggcatcccccggtcctggcactgtcttccttctcctattactgatataggtctcctgctcaatggctgaccctctgtcctccctcctcagcaccatcacagtcttgatctttttcaggcatgtgcaggccatgtcacttctgtgctcagcacattgttgtact

SEQ ID NO: 21729 - DNA, 1020 bp, Homo sapiens
aaaacacacttttcccctttcttccccatgattttgttctaagcgtgttcatctgttctccgtttgtgattggttacctagtttgtgaaacagagatacagtaatttttctgtgtctacattgttggcatgctttacaagcatttaaaagaagagatctacataaatatattatgagactacggtgtagtgtttcttttaagttgatggaaagatggtcttccagtcaggatttcctttaaggttaggtttttggttagggtatttggtgttacatgggaactgtgctgctagatcattactggctagttttcctggagaatagagtgcttcggattatgacttacacgactttacagtccaatcactgtaaggactgctgttcagaaacaattgctgtggttctcctagagcacatctccaagaacgaaaatctaggtggacacaacgtgtgctggctgttggagtggtgatgagaatagagcccttgacagggagagtggagcagaggtctgttagcttgttacttttggtagtttcaaaaattaaactccaaaaataatttattttttcctgttctcccaaattatgtgatcatataaagtcaaataataaacaaatgcatactttggaacatgaaagtttcctgttctccagagaaaatcactctaatgtaaccagttttccttcctgacaatgctgccaggcatgctggatctaagtgttgaaaatattacttagcaaaataatggaaatttagatgcaaagctgttctattcggagcaatgactgtattatagttctgcttctggctgtgaaaccattgatcttaagatgcctccacggaacttttcttagaggttctgtttcccaacaaatatatcatagggttataatgtgtgtgtgtgtgtgtttgtgtgttcacatacatacatagacaaatacacatacacatgaatgtatgtatgtatgtattttattttatcaaaactggcagtgggtgctgatgagaggctttgca

SEQ ID NO: 21730 - DNA, 1039 bp, Homo sapiens
tacttaattaaaaattaaatgatgaattaaaacttagattattcaaaactaataagctacattaccaagaccagcaattaatacactacaatatattcaggaaagatgctaacattttaacatttgttttatgttagaattgcaatttgcagtgcatgctgttttgaaacatttattttgaagagctcagcatgtctgagttaaggcataaatcaatgacctaggatttttaatggttatagaatttatcatagattataattctcgagaatacaaacagcacagaagaaaaaatccaattgtttttaaatcagtggcaacatcatatcagcatatttgattacatttattcattgtaatgtgcaggtcaacagtgcagagatgcattcaattgacatcatcctaaaagcgatctattattttatttgataagattgtttttcctttgttcatgcataatggatataaatcataatcctgacagttaccaagggtttgaacttcagggactttctacaaatgaatattaactaaaactaaggacttctgcagttaagaaaatatgagccatttagaaacattctatctagtgattcaataaagcagaactttaagtgtacattttattttaagatggacatatcaacatctagacttataaccagcatagctgagttagtcatttgtctctcacctgatggttcataccgttgtccttctgagctggttgtatgtataatgagctgttgtccttctgagctggttatatgtattatgtgtgtatgtttgatgtttgcatcttttagactgagcaatctctgatgtttgataggagtactccgtatgtgtgtgggagtgaggggaaccttcccaggtcaccctctctcattaatccttgcaggggacattcatggtgtgtcaggtgttgagctctttgctccacactcagcatacaaagaacaaaaaggctcattgggcctttaccctcaagaacatatgattttagtagagaaagatgtaaactgagaattgtagcata

SEQ ID NO: 21731 - DNA, 1045 bp, Homo sapiens
ttagttccagccttaatggtttaggctgtggtttagtgtgtggaaggctttgaggagcatgtgctttggttagtccttttcccagtagtcatggcgaagccatccaagtggtcacatctcccacccctgagatttgtatgtgagaaacagaattcattttctgaggctttcctgtggaggccatgagaggaggctgtctccctggaggcagggaggctggttctgaggctgacaatctaggcagggtgtgatgcatgttggatacaggtgggaggaatagagaatgtagaggactattgggtagatagctggactggctagctgagcaggttctgcagtggggaaagagtatgaatttgtagaagcattgaggttttgctgtcagttggctatccaggaagggctggtgagatcagaagtggtgttaaggccagggagcataggctgtgggtcactggtgtatgggagagtgctggagcatacagaaggaagaagacaggaagtcagggtttggtgggagaaaaatagcaatgcatgggacttgggcagattttttcttagaagatggctaaaatggcatctggaaagcttgtcattcccttttaagtagcaagggttggaacatagaggacctgccagtcagggccttttgttagatacttggccttattgatacctgcatttcaactttctgcttcagttttctgaacggtacagctagcgcttgggtaagtgatctctgagcacactggcagatgttaaattccctgtctcatgcctttgctccacattaggaaaggaacacaccaggggtttggaataaaggaactccaagactcctccaatctttaaaataaatgacatgggcaatttatacattaaaaaatcagcatttttctatatttattaaggtactgagtaaaacttactagatttacctggaacattttagcatcttttttttttttttttttttttttacatatcttgcagtgacagtatatattgtgttagtattatgtgattaaaacatagtttcatttaa

SEQ ID NO: 21732 - DNA, 1026 bp, Homo sapiens
gttttgcatttgttcttcttttactgcctattttgtgttaatatgaattttctccaccttctttatttgggtatgtctttacttcccctttattatttaaatatagttttgctggatggagagttcttgattgatactttgaccgtgttattcttctgacttctaccttccattgtttgtcataaatcagctcttaattgtattttttctttatatggtatgaagttagctgttcttgtatgtgatgaaacttttttgttgcttgtaggattttctcactgtctttgtctgttttttttttcagcagcttgattatgatgttttgggtgaagatttcttagtgtttatgtttcttgatgttgaacttttatctgtagattactgtgtttcatcaaatttgaggaactttcagccattaattttttttctctactgctttccgtatttctcgtaggatccttactgtacttttattggaatgctttagatttttccataggtctctccggctcattcttaaaattttctccttctgtttcacctttttaaaaaaagtttttaaaataatttttgcgtggagatcctctctagttgtcttactggtttttcatttatagaatctccttgccacatttcttgctagcctgtcagttgctcaagcatggctcacacttctggggttggctgtgtgtcaggatttcctcattggctttctgtcaactttgttacttttagctgacaaggatgtggggttttgccctcaccccagatttcttcctcccttcctcaccttggcacagagctccagttttttgtttcagtcttgtgtcagtaaaattaccattctgcctctccaagttgaggagttggtggagggaactgtaacatcccaggcaggcacccctcccaccagctctcttacccaaaactctagtagtttttcaagataaagtgcttttcaatttgttgctttcatttgattttcagaatgttgaaattgttgctgttgacaattttatgcagttt

SEQ ID NO: 21733 - DNA, 1034 bp, Homo sapiens
gtaatggcttctctagcttgaatgatttttaaaacatagattctgttacattatcagtcaagattaaaatgcaaggaatggccatcctctttaaaaaattagcacgatgacaggtcatttaaccccttcctgttgatacttggatgtttcacttttcctcctgactggagaaaagaagcaattgctgccttgtgtcctgtcattacccgaagtagctactgcccgtcacaaatgcttgtgtctctgtaaatcttcattctcttcatttatggttcaggtcgctgctacttttccttttgctgtcactggtaactatttcttggtgttgccctttaagggtatcttgttcaacattgattacacttaatgggtttaaccatcaccctgtacaattcttcgaagacccttggcaaccttgacctttggctaaaattattgttagtctataaatgtattcattttctcactattttccaaagtggctataggattatagaaagaatgatgtattatataaaaagcttttccaatgtagaaactacaaaagggaaggtttaaatgagcattttgttcagctggtcatgaagtaaaagcataaggaggatataaaagtccaatcatcccccttaagaatttttgatgttgaacaatattttaggtttgtttttctgaataacttgtacattaatatctttaaattgaaaaataactttattaaaaggtattcactgactgttcagacttacacttaaatcttaattatgagatattccatctcttattctgttattttactacctctttagaaggagagaagaatattttttatcttgatttttcttgaaactctgtaggctctcctgtgtttttggcattgatttagcaatttatgtaaaaataatggaatttacagattttgagtcagtgtaagtggaactgtataataatttgtccaaaagggaatgggctaatctacaatcataagcttcctttaatttagaaagacggtaccgttggtaagatgcatttcgggc

SEQ ID NO: 21734 - DNA, 1034 bp, Homo sapiens
taaatcacttcatacatttatatacacgtatgtttttgggtagaattttaaaatgaatctaagtgaagtttaatggtttgtaacattgaagaatttgtcaagaattatcaactacagttctacataggaaatagttaaatgttctagtttttaggattataaaagctgtcaggcattagaaaattaaaatgttgcttggtgatttttagaatatttaaaaaatgtgcttagtatgtttgtaaatatggggatatgttcaactattttaatgctataaagtttcttttcccaggttaagctcttgtgattaggcatgactcagggcttgcaaataataaaaattatgatcaataattttcacacagcaagttttcagagatgataaagtttttcagtgttgctgacatttaaaaattctttcttttttttttttttgtcctctgcaataagtagtcaaattcttgaggactcctaatatatatctggacaacactgatcagaaaaagcttgggttttactattgagaacatgattattcaaatagcctttctaccaccaaaattacacattacaggtttaatttaaaattagctgacatatcattgctgcacatttttatttgaaaacattaaaagacaacttacaaagttttaatttaaaattgtttattaatacaaataagattttgtttctgcttcagttttatcccttttgactttaaaagccaaagggaaaaatttcttccaatcactttcaatctatagaaaatgaaaagaattttaattttatggccataatcataaacagtacattaggttttgtataataacatgtaccattaaaagacttcattatggcagtatcctatgatcttcacatcaaaatgaggaggaaagaacattattaagtatgggaatttcatggcagttttacctgttgtggaccctgttatgtcaaaaatatagtgcagtgacttctgaactagctgacagacacgaaagccgttgtgtcactgtgtgttatcacctcctgta

SEQ ID NO: 21735 - DNA, 1127 bp, Homo sapiens
tgtagatagattgtttacagtaggcacctctgaagcctttttaaggcttttcgggcaaattagcctgcattatttgcaagaagtaatgcaaagagagtccctgtattctgaggctgagtaggaacgtgaatgatgagaaaggcagcattaaagagtattctaggtggagggaacagaaagtacagtgaaactgaattaggaactgaaagtgttgggctgcatgtgctgaaggagggtcctgtggctgtaacacacatacaggccagcttgtaaagagacatgagcagggtcccgagagtcatggaggtagtcttcgttgtgcatggatattcatgggaaggttttcacagggcaagcaagactttgaacagtcacactagttatgctatagtatggtgctcaagttcccctatgatagtatttcaaacttctgtatcccctgccccagttgttggcaactgagtattttcatcctaagtacagaagttggacaggatataatttcaagtgtagaataaaaattgacatagtaaagtaatatttgtaccactttaaaatgtatccaatagaatgttaacaccatgatgatttgattcccaccgtccattcatttaaaagtacatgaataagttctttaactgtcagaaaatttgtttttcttcttgaactcacatcccttatttcccccacagattttattgtatttgtatgtggacatattttaatgatcatcttatcatttctgggtatcagtacatactcacggacacatacattgatgtaaggtttttttaattgttttatttttaaaaaataaaagatgaggtcttactatgtttagcctaggctggtcttgatctcctgggctcaagcgatcccccacctcagcttctcaaagagctgggattacaggagtatgccacagcacctcacatttttttttttttgagacagagtttcactcttgttgctcaggctggagttcgatggcgcgatctcggcacaccgcaacttccgcctccgaggttcagatgattctcctacctcagtctcccgagtagctgggattacatacatgtgccaccacgcttggctaattttgtatttttagtagagacaggggtttc

SEQ ID NO: 21736 - DNA, 1039 bp, Homo sapiens
tgtccaacaatgatagactggattaagaaaatgtggcacatatacaccatggaatactatgcagccataaaaaatgatgagttcatgtcctttgtagggacatggatgaaattggaaatcatcattctcagtaaactattgcaagagcaaaaaaccaaacaccgcatattctcactcataggtggtaactgaacaatgagaacacatggacacaggaaggggaacatcacactctgagggctgttgtggggtaaggggaagggggaggggggagggatagcattaggagatatacctaatgctaaatgacgagttaatgggtgcagcacaccagcatggcacatgtatacatatgtaactaacctgcacattgtgcacatgtaccctaaaacttaagtataaaaataaaaaaaaataaataaatttcattgaacttaatctttgcctattactctgttaactttgttttaggaagcctttatccttttgccattgtctttgcatgaagtagcatggcagactctctgagagctgtttcagaaagctctggatttgtgtcttcgcttttccacttaggatttgtgagatgtctggcagtagcttagaatttttgtgtgtgaaaggaaataatatttatttgagaaggttgtgaaatgtaaatgagatacacattttataatacatagcacacaaactacttagcaaattgcttacaatgacttctttactctgtttcacatatactaccttcaatgtaatccccctctacacccagagaaaacagccagaatttggttttcccatattattgtttatttttttctagataacctataattcctttgaaggtaacatctcttttttccaccacttctgcttttatgattttgtctttggttttcaacacattgattataatgtgaagtgagagtgagagagagaaagttgtgtgagcgtgtgtgtgtgtgttcgttctatgaggtttgattagcttcttgaatgtaggggttgttgtttttctgcagttttgaaacttccc

SEQ ID NO: 21737 - DNA, 1109 bp, Homo sapiens
tgtctcgttgcactcttttaaaacaccaatgtgatacttactagtgggttatctgtggtgagttatgtaaactctctgattgtattttcctaatgcataaaaggggttaattttcattgttgccttattggattatgatgatgaaatgaaatagtaaatgtaaattctcagtatagtacctgctgccttagggctaaccgtcctcctctacctccccctctgcctccttgtctataactgacaaatcagacacaatagaaagggccccacatgttatgttggttaaacagggggccagtgggcagcaacttaaaaatcacattttcaaagtatacttaattacatgggaaaattcttcatgtcccgtattttaatagcttaattctaatctttacatttacataaaataaaaagaactgtcatgtgactcacacacaacataaaatattaaaaggaaatagagatggtcttttgacaatgggctgtttatccatcattttaattttttgctttatgcttttctgagtagcctgtagtcagaatgcactgtttagtaatgtagaatcatttgtaataggcattcagtaaatggttagtactgttatgaacctacgaattccctttgtatgatcaaaaaccgcccattttaatttttcttagctgttgtcatagttcaatgaatccatcgtaaccttacctatttgtaagatcttggagagcaactcctggatctcgatttgactttcttgaaaagaaagctggcagagactttcaaagcaatgttcagcatttctgtaggtctaatttgggtgagtgaaggggaacagagatttagtgttttgagtacaggctttgctaaattttgagcccagattgaaggaaatctgccccaggaattaaataattttaaagaatgaggcttgctaccaagagtagagacaaaaacactctggaatgataattattgctttaggtttctttttgtttgctttttttatattaggttttatagcatctttaagatgtgaggtttctggatcacatttgaaaaactgctaattctggtctttcacctaagagagcctgtttttttttttatttacaaaatt

SEQ ID NO: 21738 - DNA, 1036 bp, Homo sapiens
aagacaattgcaaaggtacacgcagaaaatcaccttaaactaatgctgtgatggaagggcagagagtggcaggtgatgggaaggtgaacgaatggatctgtgggcccagtgaatggactgaggggagggtgacagagagctgcacgccatccttcgggtgtgctggtcagggctgctgggtgagtgaccgtgccagtcagggaggtcctctctcctggaggaggatgtcctttaggaaaaggatggtctgggatgagctgcttatgagatgcccatgtgatgtccaaatgaaaccaggtcaataggtgtatagttccatactaatctatgtggaacttgatgtgattgatgttttccttggaaaatgtgaaaaagtgaaacaagaagagaggcaaatagcctgtatgggagacagagaagcaggctcacagacaggggagggacctccaggaaagagaggtgtcatacaccaagcaaagagtgggcggcgtgccaggtgttgatgaaataggagagtgcagcccgccagccacagccactgggtctcagattctcttgggaagacccgttttagtacagtagtgagaacagaaaacaggtaagtggagagaagtgcagaaatgataagcttgccttttgcctggtgttcacagaaactttgccttgaggcggctctgtgaaaacactgggccagagggaaagacagagggtggcagctgaaggcaggtagacggatgcgtgctgtctttgtgttggcattcatttgtttgcgtaaaatcactttctgaaatgtactttaatgtttatgtgccaaatgtttaaatgtccattgaaaccgtgaggctgaaaactgcattattcgtgatggctagtacagtgtatacgtgattagggttggtgaagcaggggcactgctaatagttagatcctctgaggacttctcagaacactcccgagttgagccagtgcctcactattgtcctgtgggtcgtctctctgcacatggagaactgtggcttcaggccttccctgtcat

SEQ ID NO: 21739 - DNA, 1050 bp, Homo sapiens
ggaattataaaaggtttacattctctttgcacgacttaataaaattaataaagtatgcatttttcgattaatactcagcaactgtagacttagggagctctgtacagcatagagttaaagctagaaaacatttttttgaaagacttttcaaagataagtaagttcactcttgcctatggcaacgtagtataaatattggactgacaagagctcccaaaaaatgaactctcttatcatatgttgcaccttccccctctacctctccatgggatggatcacccaccagtgcctgcagtatgccaggtgtggaggatggaatctttcagacacttacatagtgtttaaattttatggctgcccttgccccacctctaataccctaggtgagtctaagagcttgtggtgacttatgtgaccaggcctgccagactgcccactaaactgtgctcctatacatgaatgccaaaagttgttgttttaaatctagtctttttcccttagacattattagattgtcccaagtgaagccagcttccggcttgaactctcagaaatattgtgaaacatgatgctgcttcagtaaaaatgttacgtacatcaccttaaatttgaaaagctttcaactagaaaaatacggtaaattattcatatatgcacacatatatatgtaaatacttaaattgcttgatttgtcaagtaatatttttttctagacaacgtatttcaagccaaagttgtatgtattattttatagagttcatgtcctttttgggaatatatttctgtctaccatttttactgtacctaaccactctaaaaaaatgatggcttggatttttggaggttggttaggctcccatttttctgttgtatttccttaaagatcttttttttcctcagaagtttttcatccatctgccttttctggttttgcagcatctcactttgctacacctagtgagttaacagaagtggaaagaataaaacttttcctatgagggaataaatatgtagcgatgaagagttcgggggtctatatttatttcagag

SEQ ID NO: 21740 - DNA, 1046 bp, Homo sapiens
tgtgcatacaaggttagggaaaatctctcttaagaataagacttttaaaaaacagttttattgaggcataattaacataaaataaattgcacatatttaaagtgtacagtgtgatgtgttttgacagaagtataaacccttgaaaccatggccataattaaaataatgaacacatcccatttctcccagaagttgtgaggaaatggcagatatctgaatgaagggaaggccagggccgtgaaaatgtgttgggaagagcactgcctggaatggttgacggaacacgaggccaacatggacttggcagagccgttggtgatggagcagtgggagtggaatggaatatggtcatttgggcttggagtgaagagagaagtaaggtagaccacacagggcatgtagagatgtttcttctgactctgacggaaagccatagaatgacggtgagcaagagaggagcctacgttgatttgttttttgcaaaaagtcactctggcttctaggtggagaaaggactgcgtggaaatgagacgtcttggcaagagagagtgatcacttgaatgagggtagtggaggtgatgaaaatggttggattcaggatgtccttgtcaaggggacattgcttgagagctggggtccgtccaggctatctgactcctcagcctgtgctctcgtcagcttggcatgccgccttctgtggtggataaagaccatcagtgctgcaggagcagcaaccaacgccttaatgtgtagattttgttatctgtttttttctactttaatttggtggctttgtacatctgccgtgtatgtctgcttacgttgtatcatggccatcttttctctgcaggcatccttagtcgccttaacttggatttttttaaacttccagattgctaatttcccttgtattacatttcattcctgatagacatgcagcttccttgaggaggagctccctgcctctgtgtcctgccccacactccgtaacgctaggcttcgtttagagaggagcttttcaactcttgttagatgtcctaaattgt

SEQ ID NO: 21741 - DNA, 1057 bp, Homo sapiens
ctttatcggctattttaaacatttggactcgatttggagcctgcctgttaattgtccatgtttaaattcagaaggttgactttgaatcaatgcttgcacacagtataggatacagggtggtggggaggggtgcggcgggcattggatgtagggtagaggcctgggtctttgttctttcattaatctctttttccctgttctttctcaagcctcagtttccttctctgtaaacaaagggcttatattattagagaattcctaacgcgtgctattctacaaccatgtgatccattgcacccatctttagcacccctgagttggaggaagtcgccgtcatgaagcaacagctgtcctttttttttttctttcttagaaaagctggttgtacttagagaatttgcttttggtaaaatttgagtttatttctacttatgaaattggaaataagctgaaatcaacaacttctgggccctcctgccattttcatgtcaaggcacatggagacatgtcagtgcacgtgggacgtggaagctgcacaaggggtgttcttgggtgtggacgtgcatggtgggcgcacaggcctctaggaaatgcttcctcggttctgggcaccttcaatcatggatgatggggctggaaacttgcctatagctttttaaagaaaaattaaatattttgaattgaattcagcaatttcttgaacacctactgtttgtgagtgaggcctggcggtaggtgagcatggcgtggagctcgcgggagagttggagatgtgatcgcttctgtccgtgtgtcagcgtgatggcctgtccacgccgctttcttctgactgtgagctggcccatctctgtacgcttgccccacaacctcagcatgccctttggaacatcagaagtcccccacagcctcagcaggtcttctgagaactaggaattagagccccactgtcgtggaaatcaactcgtcatcaagtagggccgacaatgagacagctgaccatcctccacattccgagcctgaaggggaaaggttttcccaaggagaggtgctggtgggc

SEQ ID NO: 21742 - DNA, 1023 bp, Homo sapiens
gaggacactattcaacccatgagagataccaaaggacaaaattacattatgtcctgtcatttgtgcagcagcctttattgaggactggaggtagagaagtaacccactctgaatcacagatgtgctcaggatactttgtcaagaaaacagccattaatttggtttgataaccaatagttgtggataacccatagttatcattgataataagcaactcacagagtgtcctcttgaccatgtggtgttttgactttggccattgctggccccacagtgacacacgagctggctggtcccagcagggagtcatcgcatctacaggcacttactcagcagctgcaaggaacctatcactttaccaggtggggagggtggcacaaaagaaaggtccccaattgcttatcctcaagaaacttgcactgttttgattccatggtacatgttgaagcaaactgaggtcagtaaataggtggaccatttgtcattctgaatacatttccatgaaattcggcagctcattagcaaaatatttcttttatttggtttgggcatattgatttggatatcatcttcaaacaaaatggtagctgatgtctgctacatagggtccagcttttgtagaataaatatcagcagagctgtcgttattagatttggtaatgacagagatgtgggcagttcagcagtgagcagtggtgacttaaagtgagagagggttgggtgaagggtactagctgattgttgcttggattttatggccataatgcatggtgtttccatagcttatacttattcgtttgaagcagatctgttcctaatatccgtgggtcctgagtcttgaaattctttgctttccaattctgtcttcctccacccctagaggggcctcctagtgaacatgtgttgctctatcctgcatgtcactctgctgtccctgaggtgcacacactgggggtgctgtggtcatgcaggagaacagcccgggggatggggccggtgaggtctggaggcagatcagagagg

SEQ ID NO: 21743 - DNA, 1098 bp, Homo sapiens
agtagtaaattgggagtgggaaaagacacacagataacagggagaaatgatagcagatgacctaatagtaagcaagaagagaaggaaaaaaactatagcaaaataataaataatatgaaaagcacagcactgtgggccttttcttagaaatggaatagctctttgccctttctggttatcactgatcgctcacaggttttatttctagttgttagagaactttaattttattcagcatgctttaaatagtgtggcaaaagcatgtagattttatgtagatttttccagtgcttaaacatttttataaaattctgtttaaaagggtaaactcccaattatccagaaaacccagcctccaaaaatgactccccagaatagttgtgattttacttcatgatatactttcaataattgatagtataaattctttaagtattttatggacacattttttgcatatagtctctcgatgatgaaacacaccttctgtatctgttttaatgtatgtatcctttgaattgaatttgctggaaaaaatttggttctgttcctctgacatgtatatttcctttcttcctcctctaccatctgggatgctttctctaatatcgcatttggaagaggatgacgctcactgtgttgtttcagcatatgtgggtctggttgaattcacgtctgcctgttcacctctagtttttcattttcacacctccatggaggtggtatgctgctcttccatgcctggtagagctgtaggaaatgttacttaaatgtgtgaatgtgaccaccagggtacatttatctcaataggaaacaaatatgctaaatacaggtaacatgctatttatacttacaggtaataacttatatcttctaaccaatcattttccccctaacatagctggggatattttacaagccaattgtcgcattaaaaactgtaactctttgattttatatgtgatacaatatctaataatactcccaggaaaatgccagttgtattttttagtacctgtgtgattttcttgattgctaaaatatacgtatgtagattgaacataaatgaaaaaattgaagtccgggtttgaagatttc

SEQ ID NO: 21744 - DNA, 1083 bp, Homo sapiens
cttacccaaaattgagcagataatatggagcagatagtatggagacaccttctgtctctcctcacagtttctcctattggtaacatcttgcattggtgtagtaaatttagccaatgttgatacattgttattaactaaagcccatcattcgcattaggatatattttctatgttgtgtatcccatgggtttggacaaatgcatatttgccgtatagtgtcatacagaatagtttcactgccctttcctccgcctgttcatccatcccttccctgaccaatggcaagcactgatatttttattgtccttatagttttgccttccccagaatgtcacatagctggaagcattcagtatgcaacctttcagattggctttgagtaagacatgcattcctccatgtcttttcaaggcttgataggtatttcattttgttgctgaataatattctactgtatggatgtatcacatttatccatttacattttgaaggacatcttggttgcttccagtttttagcaatatgagtaaagttgctataaatatttgtgtgcaggtttgtgttggatgtaagttctcaagtcattgggggtaaatctcggggactgtgactgctgggttgtatgggaaaactatgtttagttttttctaacaggctgcgaagctgttttccaaagtggttgtaccattttgtattctcaccaggaatgaatgagagtttctgttgtacatcctaaccagcatttgggattaattagttttttggattttagccattctgttaggcgtgtactggatatctcattttaatttgcaatttccatcgtatgtttaatttttaacatacgatgttgagcatcttctcataggctcatttgccatctgtgtatcttctttggtgaagggctgtatgccgttttattactgatttataggaggtctttatatactctggatgagttttttatagtctcctattcactcttttaaagataccttctaatcaattaaacaagttcttaataacaatttgtcagtcctttagtacttttcggatctatttaaataatatttgaaaataagt

SEQ ID NO: 21745 - DNA, 1027 bp, Homo sapiens
tacaggtgcgcaccaccgcacttggctaattttttgtattttcagtagggatggggtttcaccatgttggccaggctggcctccaactcctcgcctcaggtggtccgcccaccttgacctcccaaagtgctggaattacaggtgtgagctgctgtgcccagctatacgtctcacctttagattgacacttcatctgaatgtgatttgaagagggaaaggtcaggatttttttttttttttacacatatagatacccaattaatctgtagtatttgttggaaataccatttttgtcttttttttacatggttgcaaatcaggtgaagaattgttctgtacttactcttttccactgtttttttttttgttgttgttcctggctagtcagtttcacactgtcttaattatgctattctgagtcttggtatctggtatgggaaatataagtcctccatttagtttttaatttttgcgatcatcttgacaattgttggtacttttcaatttcatgtagatttttgaatcagcatataagttttcctaaaaaaacttgctgggatcttgatcaaattatattgactctatagataatgtgggtggaactaatgtctttacaatcttgagtctttgaatctaaacatgatctctcctatcatttctttcctcgttatcgtctcttggtaatgttttgggacttcaagatacaggacttatacaaatattgttaaatttactcctagatatttgatatttcctgaaactattgttgatggtattttaaaaatttcattttctatatgttgcttgttcatagaaatacaattggtttttaaaaattggtattgtatccaaagtcttttacatatttattatttgtaatagtttagctgtagattcttttggaattttctctgtaatcatatttgtaaatatcaacaggtttatttcttcatttccaatctttatcactttcgttactgttttttctagctcattgtactggctaggatctcttctataacggtga

SEQ ID NO: 21746 - DNA, 1049 bp, Homo sapiens
aaccctgtgagtaggtaggacagaaatcattatctttatctttgggtgaagaatcaggctgagagagtttatttggcttgctggagactcacagctcttggcaggaatgagactcaccctcaagtcgtctgactccaagtgctgtatttatcagtgtcttcccagtctctgctgtgtatctgtattttgatatacagatatccacctttcaagatgcatgttttattgaacatggggacagaatctcagaatgggctctccacagttctctgtggcgctctttagctctatttatctaaaagttaatatgtgtgttgttttgatgttcacacaaattgtatgtttgtagaggtgaaaacagaataatggcagcaaacaaaacaagaaattatgctatatatagaaaattagttttttgcactgtcaatggaagcactctactttgcaatatgctgctggatcattttcagaaaggccctgttactttcagatcctgagcctagaattcttagagttctggttaaaggtaaggctatagacacttgaggtgttattttgttataatttaatatgctgtggtttttttaaatttgggtaatgtgtgtgtagtgcatgaatatacatttacccaagtttacagtctttctttagaaatacaaatttacaggtagtaaagcaagtatttcaaagggggtcgatgtttctttaaaaaatgagggagaccggccgggtgcggtggctcacgcctgtgatcccagcactttgggaggccgaggcggatggatcacctgaggttgggagttagagaccagcctgaccaacatggtgaaaccccatctctactaaaaatacaaaattagccaggcgtggtggcacatgcctgtaatctcagcttctcagaaggctgaggcaggagaatcgcttgaacccaggaggtggaggttgcagtgagctgagattgtgccattgcactccagcctgggcaacaagagtgaaactctgtctcaaaaaaaaaagaaaaagagggagacgttaataacattaagcat

SEQ ID NO: 21747 - DNA, 1067 bp, Homo sapiens
gagatgaaagtcagtgaagcacccagcagtttgttgggtgtagacagtattgggggcaccagtgcagggtcccctgaaaccttggaaataggactaaaattgcttcctaagggttaaactctgaaatcatcaacattggattggagtagtaaaaagttacagttaaaatgggtgcatttgttatatgtaaagtatgcctcattaaaattggtttagaaaataacctgtaaacatgtcttcttaaatatacttaggaactaaattaactttttagtttaaggtgttccgtttttaagttttactttcagaacactgaaatctaatttttagttactgctctattgagatttatagtctaaaattcacactggtcactactctgtccaaataaatctcaaacccagaagagtaaaccagaaaaattactgtagtttttaaatcacttaggaatttttcttaaaagtcacataattattgaaggtcacattattttttgagtaaatcacttcccttaaggggtgttacagaatgtttggagaaacaacacatgcatgcccacacacactcaacacaaacaactttcccacggaagacattgttcacatttattgatcatctcagtggcacgtacaaatgaatagtgatggatcaggttctgtaagtgttgagggaagagcagcgttttgtggggtgggtttggggtttattttgtgtgttgagcagtagccgaggtcagcagaggcacactgcattaggaaaagaagcatggcttctgagaaggccaggacaggagacaggatgatgatgggggggatcctggaggggattcggagaaggggaaaatcccaaacactcggagtctggtgaacacacgctgccatccgagggccggggttggacaggagagcagccttgatgcagtcagtacctagcattgcacgctctggtcttttagagatgatcgtatcttcagcaaggtggagacagatgaaaatgccatgcatttctcttgatgatttcccatggccacttagcatcatgagaattaccccaggacagcctctgcc

SEQ ID NO: 21748 - DNA, 1130 bp, Homo sapiens
tggtcttccaatagctgtgcctcacagtgtgtgtgatgatgtgaggggggtgaccagaatcctgctggaccatgcctggattgtgtatgccccagcagggctcctgtccaaaggaggctgagtacattgcagcatcgtcatctagaacaggaagggtatctcttcgcaggcagtgtcgtgactgggccacactctcgccgtgcctcctgcctgcctgccctcctctcctgtctgccctcctctcctgtccccacgtaggcagtgctgtgactgggccacgctgtcaccgtgcctcctgcccccctgtcgtcctctcctgtccccatgcgggcagagccgtgaccgggccacactctcactgtgcctcctgcccgcctgtcctcctctcctgtcgccacacaggcagtgctgtgactgggccacactcaccgtgcctcctgcctgcctgtcctcctctcctgtccccacgcaggcagtcccatgtccaggccacactctcactgtgcctcctgcccgcctgtcctcctctcctgtccccatgcaggcagagccgtgaccgggccacactctcactgtgcctcctgactgtctgtcctcctctttcacacccttgccccctccgagttaaagcagggatttttaccatttgtgtactgtccccaagcttgttatatctcattcacttatttaaccctaaagctgttcagagaagcagggatctgatgttattatgaactcagctgctttctgtttcttagggagtgaaaatttagtaagactagaaatttaagtagccttgcagttaggttctaacctaactcgattttgtctttttgctcattccttcattcatcagatccgtactgcatgctagtgtgcacagggccctgttctaggtgctgaagagccgcagcgcacaagcacttgccttcttggagcgtgcattctagggaggggaggtggacattaagtaaaatgtaaaaggtcaaatgctgagaagtctgcagaaaaatcaagcagagaagggggctaggggttcccagggaggacacaggagattttaatgttaaatggaatggaccggaaagtcctcagtgtaaagacgattttgagcaaaggcctgaagaatc

SEQ ID NO: 21749 - DNA, 1050 bp, Homo sapiens
agagcactagccattgaaccagcacctgagaagggggcaccatgagatcctggaagagcttctgtcaatttctatagcaagcctgctgctcctgcagcttctgtaaaccgtgtagcctaccagtgctgtggtgtcgaaatataaactgcgcaggagtcagcagtaccttggtgaagcttgagctagccggtccaacagtaacttctgttgttttttatagttgacaaacatggcttcatcgttactctcgttttcaaagatagggtcttcatcataagttcctttgtggcaactgacatgattgccgctgcaccggctttctgctgatctaagatgtttcaaaatctgaacataatcacagcaaaagccagtatcttagaggaggtcccgtcatcaggagctagtcaccgcagcgtcagtgccatccttgtttcagcagcttctagtgcctcttgagcattcttgatatccccattctgaattcacgtagtccagctaactatcagtgactgtctctctcctgtgaccagctgagaaaacctggccaggaaatcaacatcatcttcgtggtcaatgctgaaaaacccagcagactgtagtacttgttaaaaagattctactggctgggcgcggtggctcacaactgtaatccccgcactttgggaggccgaggtgggtggatctcctgaggtcaggagttcgagaccagcctggccaacatggtgaaacctgtctctactaaaaatacgaaaattagctgggcatgatgatgcgcacctgtagtcccacctactcgggaagctgaggaaggagaatggcttgaacccaggaggcagaggttgcagtgagccgagatcacactactgcactccagcctgggtgacagagtgagactccatgtctaaataaataaataaataaataaataaaaagattctactagctccatttcatcagcagggtccgttcctcgatttacagtttcagatatccagtcacgtgcttctattaacccagtcctagcagcatatctataaacctatcattggt

SEQ ID NO: 21750 - DNA, 1046 bp, Homo sapiens
tataactaatattttaagaatttggcttcagctgttctaggagaaaaccttaaatgagttaatgaaataagtttggtttcaactttgggcttcagattgttttttctcacttattatgatggataatgagaattggctatacagttccttatcccattttgaaagggctgcaaaaagcatttaatttatggtaacctgttaaaagcatctagatattccatagaaattttcaaagatttcatagtgtgttcttttttccattaacacataggattataaatgcatgcaagtactagagaatgcacaaatcacttcagctaagttttgcagactttaggcagttcatgagtcctagcattcagaaaaaggttacacgttgagtgaaaagcaaagacagtcctttgcctcccggaattaccctgtccagatacaatgaaagtccttttacctgatgttttcagcccagttattaataaaaaggtatataaaattgggaaccaaacaagtgacatctgcatactttggagattcatccacggatcttttgaatatgggtctgctcaggtgataatacattttctactttttaaaatttttgcctgtactcatgttcatcatgcagtttcatctcctgtttctctttctttagcattgcatgagaatgtaggtcactataaagcaatcatagtgcagcatacttttgtcttttgaatctttttctctctgattttgtgtagttgtcttgcctacacctattttgacagcagaatgtttaaagtatcttgtctttaccaagtttttccaaggcattcaatttggtttccattggatgtccaacagattttttattctcatattcatttctagttgccatactatttgatttcattatatcattacagtagctgatgaagctggcataaacgggttttgaatcaagcaaatgtgttttagtaggaatgtattgcaggcatgttagtgtgtacttgagagcattcagaacacataggataggaacacagcacacgggaaaccgcagcatcgtg

SEQ ID NO: 21751 - DNA, 1045 bp, Homo sapiens
tgtcagtccaattaaacctctttcttttgtaaattgcccagtcaagggcatgtctttatcagcagcgtgaaaacggactaatatagcatcccctcctcaattcttaatttccttttgggggctcagcttgtgtagttccctaaaacattgagaaacacccctcaccttaaagcacaggagccaagaacatcagccatgcttcctgtggtcagccacggttttaactgtgtgtaaaatatgtttagaatcagtgctgattacagcagttcaagttgcatgctgaattatttctataaatttgcagtagatattcagaccttttaagctgcagcttcctctctgctcttgtgccccataccaccctacctttctcattctctcgtattctctcagatctgctctcatagctagaggtgtgctgggctggtaagaagacttacagtagttttctatagcatagcaaaattgtatatgtgtttctaagcaaataagtgttttttaaatatacacacatgtagagactctgagatgtaatttatataagttcacctaattatttaaagtatacaattgaatggttttcagtgtatttacagagttgtacaaccatcaccatggtctaattttagaacgtttcatcaccccttaaagaaacgtggagccatgagccatcactccatgttcccccgacccccggcccaccctcaccgctgcccctggcaactgccagtccactttctgtctccgtagatgcatccgttctgggtatttcatagaaatgtgatcatccgtgtggtcttttgtgactggcttttttcattccttagagtatttccaaggctcctccatgctgtagcatgtaccagaactttgtaccttcttattactgaacaatattcccttataccacattttcatttgtgcatttatcggttgatgggcatttgggctgtttccattttttggctatgggtaattctcctgtggacatttctgtacaaggcttctgttttcacttctcttgggttgctgggttacatggtga

SEQ ID NO: 21752 - DNA, 1050 bp, Homo sapiens
tggttacatgagtaagttctgtagtggtgatttgtgagattttcgtgcacccatcacctgagcagtgtacactgcaccctatttatagtcttttatccctcacccccttcccattctttccccccgagtccccaaagtccattgtgtcattcttatgcctttgtatcctcatagcttagctcccacttatgagtgagaacatgcgatgtttggttttccattcctgtgttacttcacttagaataatggccttcaatttcatccaggtggttgcagatgctattaattcattcctttttatggctgagtagtattccattgtgtgtgtgtgtgtgtgtgtgtgtgtgtgtgtgtgtgtatttatgtatataaataccacagtttctttatccactcgtcgatttatggacatttggtttggttccctgtttttgcagttgcgaattgtgctgccataaacatgcgtgtgcaagtgtctttttcatacaatgaaaaagattctacttattttcctctgggtagagatacccagtagtgggactgctggatcaaatggtagttctatttttagttctttaaggaatctctacactgttttccatagtggctgtactagtttacattcccactagcagtgtggaagtattccctgttcaccacatccatgctagcatgtactatttttttttttattttttgattatggccattcttgcgtgagtaaaatggtatcacattgtggttttgatttgcattttcctgatcattagtgatgttgagcattttttcatacgtttgctggccatttatatatcttcttttgagaattgtctgttcatgtccttagctcactttttgatgggattgtttgttttttttcttactgattagtttgaattcgttgtagattctggatattagtccttttcagatgtatagatagtgaagattttctcccactctgtgggttgtctgtttagtctgctgactgttccttttgccattaaaaagctctttagtgtaatgaagtcccagctatttatctttgtt

SEQ ID NO: 21753 - DNA, 1031 bp, Homo sapiens
ttttgttttggtgtcagggtaatactggccttagtggaatgagttaagaagtgttctttcttctatgttttggaagagtttgtgaagaattattattaattctttgttaagcgtttgatagaattcgcccatgaaaccctgtgggactggactttactctgatttttaaaaaattactaattcagtttctttacttgttacaggattattcagattatctatttctttccaagtcagttttggtagtttgtgtctttttcataatttgtccactttatctaggttatctaatccactttatctaggttatctaatctgcggccgtgcagttgtttttaggatttccttacagtcctttttatttctgtcaggttggtagtaatgtaacctcctttgttcctgattttagtaattgaactcttctctctttttttcttggtcagtctagcttaaaggtttgtcaatcttgttgatcttttaaaataaccagcttttggttttaatgatttttctcacttgtttttctgttctttatttcatttattggtttctgtttttattgttttcttccttccacttattttctgttcagtttagtcttctttttgtagtttaaggtggaaagttagattatttacttgagggtcttttttagtacaggtgttcataactacaaatttccatctaagtactgcttttgctgtatttcatgaggtttggccatacatctcaaaattattttctaatttcccttgtgatatcttctttgattcattgcttatttatttttagtttttatttttatttttattttatttttgtagagacagggtcttgctttgttacccaggctggagtgcagtgacatgattatagttcactatgatgatcactgtaactttgaacccctgggctcaagcagttctcttgcctcagcctcccaggtagctagcaatacaggcatacaccaccacacctgggtaatttttaaattttgttgtagagacaggctgtgtctgttgctgtgttgc

SEQ ID NO: 21754 - DNA, 1026 bp, Homo sapiens
gataatacactgtttattataattacaatattttaaatcttaggtatgatggaagtcctaagtgttaatatatgcagcatatcccagcttgaacactggcagctgggtgcttgtcagtacagcatggtgggttgctcatggcatcgtattgactgtgtattaacacagaatattctgttgggctgtgagctgattgtttagaatgtaaatgaagctgctgatggatctggtgactgatggcttaaattccaattaatcaattacttcatcactttcttaattcagatcaaatatctccagagtgcacacaattcttttagtggtattaagagaaattaatgctttagaactaattttcatcaatctcttataaatgtcaatatctttttcacttgtctcctaagtgatgacattatactttaagtgtttgggacatattatagtacctcagctgtctgtcacttgttagtgggacggggtggtggttaaatgacactgtactcatccacatggtctctgtagtgctattcgtcttgctaccagcttgaaaatttcatgcagagtcattaaatcgtatgaatgatttaaaaattaagtttaatggcagacaatctggtattataaatgcaaagtcaatgcctatctttcttttgttggccgtataccctagccgatctctttcagagctgttggatttgtgagctgttgtaggaagtctactaatattacagggtaacttattatgcgatatgacagactcgtgctccgacggtgtcctgtcagtttcttcagcacacttgatgcaccctcctatgtgacacatacacgagttgatcttaattgtcattaagcctgttgactcttgtcagttgtataaaataaaatcaagtattcataagcagtctgtaataggatataagcaggccaacttagtaatacattttttgctgagccttaactggcgtcagttttagcgagtgctttctgttaaaaaattattagatgcagttcttgtgaaataagtca

SEQ ID NO: 21755 - DNA, 1054 bp, Homo sapiens
ccatattacagggtacttaaaaggattaaaaataaaattggtgactgggcatggtggctcatgcctgtaatcccagcactttgggaggccgaggcaggcggatcacgaggtcaggagatcgggaccatcctggctaacatggtgaaaccccgtctctactaaaaatacaaaaaaaaaattagccagacatggtggcgggcgcctgtagtcccagctactcaggaggctgcggcaggagaatggtgtgaacccgggaggtggagtttgcagtgagctgagatcgcgccactgcactccaggctgggtgacagagcgagactccatctcaaaaaataaaataaaataaaattggtgaggtagttacatagatagggcagatttaggcactgagttgctagaagctataattagttgaaaatgcatcagctaggagagaaaagcatttaatatttgtgtagagtaagagaccacaagaatgctcagtagcatgtggaaatacttttaggaggttcagagggggaaatgagggtattatggatgtggatttgcatggacattttagttgtagaatgttctgtggaaagggtgggctggactaagccatgtgaagatctgttcttacataatctactttaatgatttctccaaatttgagaaacaactagctaccatgatacgagttcccagtatatgacactcatgacaggctttcacgtattttccctgaattttacaacataactccagggtaagtcttatacagattaaaaaactgaggtctaacaaggtcaagttatttgaaagggagcattgagtagtcagttacagggctggtgttcagcttctgactgtctggctctgcctactctgttatgccagtttgggatggaagcctccagagcaggcattctcacctctacctagcactgttggtgctttgggcccaatatgtctctgctgtggtgggcaggtctgtcttctgcactgttgggtgttgagaatattcttgtcctcattccaccagaagccagtagcattctcctaacttcctttc

SEQ ID NO: 21756 - DNA, 1033 bp, Homo sapiens
tggaagattggcaagaaatactcaacatgagagtcttgaaacaaaatcatgaaatggtttgaaacattgacagctcaagtgtgtgttattaaatacaaggatgtctgaaggtacacactaaaagggcccagcatgcacgtgagaaaactccaagacgtgtaactgctgtcatattttacatatacagggaaaaatcctttgatctccctgggaaaatgaccagctccccacagttggaaggggccaggttggtgtcagtgttctcagcatacggagccatacaagagcagcacagcctttccaggaggctcaggggaagaatgtgtgagtggagtgttttgctccttcaaaactgtcctgcaagtgccaattctgtggagagcagtctcaagcatacagagttcaggtgtgttgtacacatgagccttttgtgaataatcttacagaggattagctctgcctggctgatagatgacctgggtggaagttttatggtgagcactgaagatctaacagacgtaagaataaaacagtggagggaggatgggtggaagatggtacagtgtatatgaattttatacgcttcctctaataatcagctgaaaagcaggaagaggaggagaaaatagaaggagctcattggttgctacgtgggtgttaaggcagtcagagactattgaaagctgacgagctcaatagtagctgtcaaagcaaggagagtaggatgaaggcaggctactgggacagtggcaaaatggtagtgaccagaaaatacacacctcaccaaaaaataaatttggttttaaaaattagacaacagttgatcaattcatatggctaaagatgcatagtatgcaggctctttcacacagaaaattaattggatcagaaagcctaaaggaaagatatatcaagcaaatacaaataaaaaggaaacaggagttgcagtcttggtacttaacaagaataccagtatagaatcgagaaagcatttagaatgaggtgaagaaagatgctataagataataaagtc

SEQ ID NO: 21757 - DNA, 1126 bp, Homo sapiens
aagtcactggaaatgtgttcaggaaatgtgaacctgacttcagctccacaagcaggctcactggcctgcgcctgctggccctgccttccctgaggcgcatccttgcctccatagttttactgaggttagtgttaccattggatagaaaactaagcttttctaaccttgaaaagctcctgcttatcctccttgcggcctttagccggctcctgtttgcctggtcagctttgttactagcacttaacataatcactgcccgcttggttctgggggacttgccgcttgtctttgccattcctttcttcttagccttttggagacattttgttttaaggtgtagctcttaaattgcataaatcagtatttatttatttttaaactaaaagtgctagcctttaataggaatatttcttcctttcacaatcctggcataggtgttcagccttgctcctgcattcttgcgcgttcatttatatttatatgcacacattcatctattctatgtggcagctctgtgtgtgtgtgtgtgtctgtgtgtgtgtgtacactgtgtatatgtttgtactgctatacagaatgtattttactttaaaatttttaaattatttgaaaattgcaaaactctcttaaaatttgccactgcttgactttatccaatacatatttaaaccttgatttcaaatatcaaagtcaagaaccaaacaataacgtgtgactcctcttaaatatgaggattttaatcttcatttattctttttttctcctttgtacttcctagtatttgatcatttaatctgtacctgcaaaccctaattttatagttatttccttttaatatggaaatcttaactttcaaccagcaatgatggctctcctttgaggttggcgcccatgtttgcttaacaacatggagtcattaatctcggtgctcacctttccccattcctgagtttccaattttgattcattctcaaccaaccagagtacttttcaaacagtgttcttgagcttgcctggggaatgaagccccatttgtccccagagttcaggcacaggcccctctgtgtatttcacagtgacttcccacatgaaagtcggaagagtcctgagtgtgagggaagccctg

SEQ ID NO: 21758 - DNA, 1035 bp, Homo sapiens
gtggaacagccctgctatttagtaaccatttgcaggaatgtccttagcttttcctgagcctttcctgcctgtcaaacactcctctgaacatttggcaggcagcagttcacatagtcttcagcacagctgataaaggtttcgtctctagcccatttgttaggaggcactggaggcatacaggtgggtaacttgtaggcgtcagcatggccagccagcactcctcgccagggagctgcagccgtcctgcaccaagaggccaagtggctgctgtgtccggccttgagtgtcatcttgcaggggagctttgagtcatcttcgcttagtgcttgtgtctttgattagtttgtattttaaatagcgaaagatggtgaggtgctggtttaaaaagctgtgtaattgtcaaaggcttactttctaactagtacatagaatttttaagatatgaactctatggacagataagtcaaagtatgattatttaatgttctttaacttacatacagacttccttcattgactgtgattcctaaagactatttttcgagtgtgtacttattaatagttgagctatgtgaattgccattttgctgggtcaaaaatgtttgaatatcagcagtttcactctgtggtataagtacatcctgtctgctttcttgacaggattaaattagacacatgtgaacatttttgagttgctgtataggaagaactgcgctgccagcagccgcatgagcagagcctgcctcctaaagtgatgtgatgtgagctcatgttctgacatggccgctctgtaggtttccaggcctacagggttccagccttctgctccactccactgcctccaggcaaggttctgcagaattgtccccagtcagatgactcatcatatgtgctttaattgcagtcttactacacggacttaaattatgaaattttaaaaatgactaaaaagtccagggcatagttagcagataccattttatttgtcatatcatatcccatttgttctgttttccagtttagctcctgaaacac

SEQ ID NO: 21759 - DNA, 1029 bp, Homo sapiens
ccatccaccagggggtggaagagctgcattgtgtccatagtgtgagacgctggcctgcagcacagagaaagcagaggacacgctcggcaaggtgggcgagtcctgacaccgctggcccgaagagacccactcgcagagagcggagaccacccagagagaatagccaggtgttagcctgcggggaacagccatttatgtgagactcaacggcagcgagggaggcaggggtctcccacctggcgcatcacaggcctcgtccttgggggtgacggagatgctccgtgtcatggtcacacggcggttccatgacacttgtcaaaattcatcacatgctgaaagttatacctcaagaaagtaggtttatgaaaaggaggcagcaatggggtttttgttgttaaaggttgaagagatagggaggggttgttcaaagaaagttaacaaaagtaattaaagatttcgagggaagtacaacagtgttgtacaagtttaacgtaataaagaaattaaagattgaatttctggatagagttctctaagcatgtagatatttagtgcccagcagtaactcatcaagaaaacagaatgatgtgaaatagactaaaagtaccttagaagaaaatgtttcatatagaacctacaatagttttaaaaatagaacggtctgcatttagtgaccgtggaatctcagtcatattaaaacagaatataacctttaggtatccgcatgtttcaaggctaaaatataacgtggtgtcatgggtgtttctggttctctgccacggggtaactttcccaacttgagataactatgagagtgtgttctcataggtgacaatgtcatttaacaacaacaaaaaaaaccccagccaagtgcagtggctcatgcctgtaatcccagcactttgggaggccgagttgggaagatttcttgagactaggagtgtgagaccagcctgggaaacatggtgagaccctatctctacaggagaacattagctgggcatggtggtacacacccgcggtcctagc

SEQ ID NO: 21760 - DNA, 1044 bp, Homo sapiens
agagagcaatcaagctgcctttcttcccgataccgcatcagcgcctgttgaatggaattcctctgccgtcatctgtcggcgctggagcatcctgagtttccggacgggcccggccctgcgagggcgcgatttcctgcgctcccacaaggtgtcgctggcgtccgctcggtgatgtgggcgcgtctggtcgctgccggaggctgcctgggagtttcccttctgtgccccgagttggtgtctcctggaagtcacgtcctggctggggctgacttggatttcacctgtcttttcgcttctgccgcagcagtttgcgttaggggcattgggacggtagaaatcttaagtccacagccagcagctcaggagatggggtcacacactcaggcctcgggggtggaggccaagggcaaatcagaggctgctcccccgtgcacctttaaaagtaaaccacccacctgtgaaactgactaatagaataataacattgtcgataacctcagaaaagctgaacccctgagcctttgggaataacactgcagtacagctttcagatacagaaacgaccagccttcgatcagttggatcctgattgggagacagttgaagatttgtctcaagaaatcgagatgtattaagggcaggtagagactggaggaggaaggggtcttttcctccgtaaacgaaaatcaccccctgcgggggctgctgctgtgagggttaaatgagatgcacagggcgttcccagcagacgacgggcatgcagcaaggcaatcagaacggggtctgtgacacggattttctgctaaagaaaataatagcccactaaagggtcattagatcggcattagatctagttccagctctagttcaggagccagctcgggtcaggcgaggggtggagaggctgtgtttccacctgcttgcggcgtaacctcatcgctttttaggttctggacctgtgtcagccctagaaattctgagccggccgtacagccccagaggccttcaggagggcgcccagcctggggagagcattctgcatgt

SEQ ID NO: 21761 - DNA, 1050 bp, Homo sapiens
ttaacagctgtatgttttaaaagaaacttaagagcacatgtgaaaaattgtgtacttcaagtttactggttgttttttgtttgttttttgtttttttgagacagtctcgctctgtcacccagattggagtgcagtggctcgatctcagctcattgcagcctccgcctcccaggttcaagcgattctcatgcctcagtctcccgagtatctaggactacaggcgccggccactatgcctggctaatgtttttgtattttttttagtagagacgggatttcaccatgttgtccaggctggtcttgaactcctgacctcaggtgatccgcccaccgtggcctcccaaagtgctgggattacaggcgtgagccaccgcgcccggcctgctgtttcatttttaatctcttaaatggagtttgctttaatatatatattttctcatcataaaggaacttcatactcatcgtggacatttggacaatataaaaaaggaaataaaacctagtgtagtctcaccaactgagacataaccactgctggcattgggcatgcgtcctgctccatttgctgctgtgtgtggatgttcacgcagacacacacacacacacagagtacattatattgtggatatatgtgtttgtgtgtgtgtgtgtgtgtgtgtatatgtatgtgtatatatatatatttatttatttatttatttttttttttttgagacagggtcttgctgtgtcatccaggctggagtccagtggcttgatcatggctcactgcagccttgacctcccaggctgaagcagttctcatgcctcagcctcgccagtagctggggacacaagtgtgccctattctgcccagctaatttttaaatttttgtagagatggggcctcgcggtgttgcccaggctggtcctgaactcctgggctcaagcaatcctcccacctgggcctcccaaagtgctgggatgacaggtgtgagccaccgtgcccgcctgtgcatattttgtgaacaaaatgggatgtgctgtgtctacggtttttgtactttctat

SEQ ID NO: 21762 - DNA, 1033 bp, Homo sapiens
attttcttcccactagagagatgtgatgagcaaagatttccgctcagaactcctaacatccaagtatgagttggctttgcaagccgaaggggagcatggtgtctgtttttcttcagagaatttctgactgtttgctaaggcacgtttccataagaaggactggagagaagcaggccttctaaactgctggagagcatcttgaatcagctctcccccaaagcaacaaaaatacagcatcactgtcaaatcaaccaccaaatctggcagtcagccaagaggacagaacaaacacagatgcattcactcaaggaagagcggccccagggggaagaacaggatggcagcgtcttcacttggggccgctccagccccgaggcgcacagccgtggaaagccggtgacagcacagaccgtggaggagctgggctctgttgaaaaccccatcccaggatgcagtccgcatttggactggtcatggagctcctggaaaaggcccgttccgaggcacaatcaccgttggctgcagtcgtgatcatgggagctgccccaaggctgcgatcgacattggagcaaacaagagcctggccagaccaggtgaccccggggactttgaaaaaccttggagattcccgggcacatacgaaaatggatgtgtgaaggcttcggtacagagagggccccagccactcttctctggctgacctcaaaaccccaccaagcagaagtgagaggtaaagctgcctgtggctgggaggcaggtcctgacacacaggttttgtgattagagggaggagactggcttcgtggctcaaggatttaaggaaacttcctgtctggtaacagcagaccattaaactctgctaaccagagggtgatccctaggcagcctggcttaaagacagaaacaagatttaaaaacagagagaacagaaaactcagtgtccacattctgcaaggaatacagcatctagataattagtccaggaaagtcatgagtcacataagcaacaaccaaggagaggggaagccgagaa

SEQ ID NO: 21763 - DNA, 1030 bp, Homo sapiens
ctgcgaagcctcctaccctggagccgctcaggcccagcccacagccactctcaccactgcggtgatcccagggactgggaacaggtctctttctgtaacaccagggcttagtgctttggtgctactcttacttctttatttgacttaattaattccaactctccagccagttgacaaagctcctggacacttctgagaacagcagggcggaacctggcctatgggattgctgtgggccagtcagtgaacgggccagcaccacctagagcagaaggatgtggagaccccccgtctaggaagtcagggtctgttctgtactgtcattctaatcagtagaagcacgatggcaggacagatacgtgcactgaagtgatactgctgagatttggtttcgaaattatgtgataatttaaagcagccacacgatcagtactgcgaacagcacctgttctttagacgctgcttttcatactgttgaataaaatatccaggggggtggctcgcactgtagtcccagtgctttgggaggtggacccgcaaggatctctcgagctcaggagttcaaggctgcagtgagctgtgatcgcacccctgcgcttcatcctgggccacagggtgagagcctgtctcaaaaaaaaatttttcttaataatttaaaataaaatcacaaacctttgacttattttttcttcagtatttttatttatttttttttttttgagacggaatcttgctccatcgtccaggctggagtgcagtggtgcaatcttggctcactgcaacctccgcctcccaggttcaagcaattctcatgcctcagcctcttgagcagctggaattacaggcacgtgccaccacgcctggctaatctgtgtatttttagcagagatggggtttcatcatgttgctgaggttggtctcaagctcctgtcctcattgtcttaaactacataaagtggttaaagattagatacaaaactggtgttttaataattcagccttgcttgaagtgagctaggaatttctaaga

SEQ ID NO: 21764 - DNA, 1091 bp, Homo sapiens
cataccctgtcattgtggggttttgctgggttctgtgtgtgttaaacactttcctactttctggcactacaagatactccaggctcatcttgtgtgtttcgtaccacagccctaaaatcagccatttctccaagaagccctcgttccttttattggagagagagattagaaaccatgggtgctgggtgtgttcattgcttctggggtgtctgtcttttgggccatctcatctgacgaaaggatatatgtgtttctactaacccttgtgtaaatatgcacctataaacatttccgtgtatagccatctgtctccaactccagacgtactgtgtggatcattctagcctcctctccttgctgatctgtaagtcgcactccaatggtgagcgtggctcccaccatccatttgcttaattgttcagtctcagtctatgcctataacagtatctgaatcctttacttgaacttccatgggaaacatctttatcaattagcgtatagtgtttatgtgcagtttggtaggtgtctttttaagatcctctctctaaccttgggactagaagtagaatttaggtaaaaattatgaggttgaattaaaaccatcttcagcctcttccccacaacccatgttgttatcaattaaattctgaaattttttaagatgtccagtaatgtaacatctaagtttagccccctataaacagttatggtatcataacctcttaaattagcttatgtaactttttgactttgccatcactaacataatgcttattttctccccaaagaaaaaaggtttggtatgaaagtccttccttgggttctcactcggtgagtataagccatgagccactttataatcttgatgggagtgagggtttaaaagttggcaaaactcttacctggaggtctttccatttctgtattggaggggatagtgtctatgtggatgcgactggatgccattggcaacatggagttttgatcttttcaaaaaaaaatgtactgacattaatgttttctggaaagtcatatcttttatcaaattataatatggtaatatccattcagtttttagtgtgtgtgtactg

SEQ ID NO: 21765 - DNA, 1048 bp, Homo sapiens
taatgtcccagcccctgtgagctgtcaggttctaaattcagaattctctcaattctgtcaggttctgcactacgagtcagtgtcatccctccaagccctggctctctgccagtgcagcagggctgtgagaatcaagacggcacagggaaggcatctgtcccagcatttgcacatgacaggtgcccacggtgcaggagtagaatctgtggaagcagcagtggctttagttgctgtgccctgccacctcctccccaaaaaggagaagtgtccaagggatagcagacccgtagcactgagcggcctgccgtgctgaccactggatccaggccacgtgctgcagacagcggctgtgggcgagtgatgaggccactacccagaaagctgcatgtgcactgtgtggggtaaggacagtaggagatgctgctgcaagatgctgactcccttgtttttcttttcatttgtgctctgggactaagctgtgtataagtcatcaaatggcagaagcaagatttttcttttgagatctaggaaattatttgtttatactctacactcttatttcctatatcaggatggggaggccactacctcaggccagttaaactaagaagaaagaatttaaggcaatttgtaaggatagacaaaaccccacatgatggtatgagtaggagagagaaaaaaaaaagggagccagaaattaggttacaaagtgtacaccacacataaaggctgatgcctctgttacaccgtgagccaaatgtttatctctagggtttctggtagccagttgcggggtgtccagtgaaggggtgtacatgtctgtggttaatcatataggtcaggataatgaggtgatactgcagtgacaaatggcaaatctccctggcttacaacaaccagtttgcctcttattcttctaggggaccatcatgggctgaggtcaggccaaggccttttgtatctggtgttactggaacatggctatgtgaattcatttatgtacaagagacctccccatcctgatgtaggaaatgaatggtgatgattt

SEQ ID NO: 21766 - DNA, 1078 bp, Homo sapiens
taggaatagaagtacagttttcttccccactccttttgtccagaaggaaaacctggttttacatcagaaacttgaggtactttgaaaatttgccagctgccttgaaggagagagggcttgagtgtattttgggggaagaatgaggggacaacagggcagggagaagggacagagctagaggaaggacaggcctgtgccacccaggccagggtaaggggagcagagaccttttggttcctggtttgtgacacaggaagggagggaactggggaggacaggtcatgatcagtgtttcctgattaaaaattttttatttttatttttaattatcatgggcacagagtaggtgtatatatttgtggggtacatgagatgttttgatacagacatgcaatgtgaaaaagcacatcatggagactggggcacccatcccctcaagcatttatcctttgtgccacaaacaatccgattatattgttttagttatttttaaatatgcaattaaattgttattgactatagtcacccttctgtgctgctgctctactgtggcctcaaagatcataaatgctgtgggtgctggcaagatactgaaataaattaattctgtatttctaaaaataatttcatactttctttttacagaaggaatatatattctttgttgaaaaatgttaaaacagataccaatagaatagaggaaacaaaagccccatgtagtctcagctaccagagacaccactgttaaattttggtgtagcatcaggtgcggtggcacgtgctgttagtactcaggagactgaggcaggaggatcactggagtctgggagtttgaggctgcaagcacattgattgcacctgtgaatagtcactgcactccatcctgggcgacagagtgaggccctgtctcaaaaaaaagatggtaacatcagaatgttaaccgagcatgaggtccccatgcccacatgggcagcacacctgggaagccagccctgatgtcagttaatcctcaggcctctttgaggtgtgccatttgccctagggatgtcctgtatggcaaagggcctgttccagaggc

SEQ ID NO: 21767 - DNA, 1034 bp, Homo sapiens
gaacatagttttggaagttctagttagagcatccaggcaagaaaaagaaataaaaggcatctagccaggcacagtggctcatgcctgtcatcccagcagattgggaggctgaggtgggtggattgcttgagcccaggagtttgagaccaacctgggcaacatgatgaaaccctgtctgtacaaaaaaatataaaaattactcgggcatggtggcatgtgcctgtagtcccaactactcgggtggctgaggtgggaaggtcacttgagcccaggaggttgaggctgcagtgagccatgagtgtgctactgcactccagcctgaatgacaaagcaagaccttgtctcaaaaaacaaaacaaaacaaaaaaaaaaccccacaaaatccaaatgggaaaagagaaagttaaattatctgtttgctgatgatacgatcttatatctagaaaatcctgaagactcttccaaaggactcctagatttgataaattatttcagcaaagtttcaggatagaaaatcaatgaacaaaaataagtagtagttctatacaccgataatgatcaagctgagaaccaaatcaagaactcaattccatttacaataactacaaacaaacaaaatcctaggagtacatttgaccaaggaagtgaaagacctttacaaggagaacttcaaaacactggtgaaagaaatcatagatgacacaaacaaatggaaaaatgtctcatgcccatggcttggaaaaatcagtatcattaaaatgaccatactgcctaaagcaatctacagatacagtgcaattcctatcaaattaccaatgtcatttttcacagaattagaaaaaaaaatcctaaaattcatatggaaccataaaagagcccaaatagccaaaacatcctaagcaaaaagaacaaagcaggaggcatcacgttacctgacttcaaattatactacaaggctatagtaaccaaaacagcatggtactggtataaaaatggaaacacagatcaatggaacagaataaagaacccagata

SEQ ID NO: 21768 - DNA, 1033 bp, Homo sapiens
attcagttctgtgtttcccctgtacccaagatgagatttctaatacagtgatgtgtttaaaattaaccatatctccagggcagcatccagctgtgagccttggtgaagaaggtcctggagacgggagtgaatggggtggggccatccttggacacacaggaggttcctgggccctggggatgtgtccgtgggtgctgaggagatgaggggtgcatgctgtctgggttcttttctctccgctccatctcttgcaaggtgaggaggggtctgctgttgattcctgtcctgcctgtggtgctgaagctcccctcaagctgggctttctcagcagggagagtttcttcattgcttgtagaagtttatgcttccctgctttagtctgggcaaattgctccccaaaggacatgagagctgaggctgtgtttttagagatagggagcagctacagggacttagcttcttaatgaattaattcacaaatctcagcagctcctggcgataagatatgcagagctgatggcagggaggacacgaggtggctcaaagggaactaagctttgcgtgtgaatttagggtgaggctaagagccctccaggcaggcagaggagggtgctggagggaggagaggccggtataggaccttcgccttgaagaaagcacccaggtaaggctgggcagtgttgggagagagctttagttgatctttttgtttttggatgttttctgatggtcctctatggctttggaaaatggagagaagacagagaggcgtaggcactgaaggctgcagctgtgattgaggatcacgacgcctgttggggctgctcacctgcctaggcctgggtgaggaggtgctggggcctggctgcacacacgttcctgccccagaactcagttgggggctcggagcaggagaagctgcacacggtgagtgtgtggggcgcagaagcccgtctgcagaggttccacaccatgcagaaagtggccagtgaaagacaaggaggtgttcccgggagtggaagggctggggcct

SEQ ID NO: 21769 - DNA, 1048 bp, Homo sapiens
cttgggatggaatgcactcacttggtcgtggtgtataattgttttaatacactgttgaatttggtttgctagtatgttgttaaggatttttcatctgtgttcataaggaatattggtttttaattttcttgtaatgtttttatttggccctcgtatcagggaaatgctgtcttcaagaatgagttagaagttgttccctcctctttttttttgttttttgttttttgttttttgagagggagttgcgttcttattgcccaggctggagtgcagtggcgcaatcttggctcaccgcaacctccgcctcacaggccaagcgattatcctgcctcagcctcccgagtagctgagattcaggcatgcgccaccacacccagctaatttttctatttttagtagagacgggtttttccttgttggtcaggctggtctcgaactcccgacctcaggtgatctgcccgcctcggcctcccaaagtgctgggattacaggcctgagccactgtgcctggcccctcctcttctatttttttgtggcgagtttgagaaaaattgatgttagttctttctttaattttttttttctttttttggagacagagtctcgctctgtcgcccaggctggagtgcagtggcatgatctcagctcactgcaacctccacctcccaggttcaagccattctcctgcctcagcctcccgagtagctgggattacaggcgtgcatcaccatgcccagctaatttttgtatttttagtagaggtggggtttcaccatgttggccaggctggtctcagactcctgacctcaaatgatttacccacctcggtgtcccaaagagctgggattacaggcatgagccagcacgctcagccttttaagtattttttaggattcaccagtgaagccacctgtacctgtacttttctctgttaggaagtttttgatgaattcagtctcttgttacagaaatttgaaatttttctatttcttcatgggtatgaatcagttttaggtaattagtgtctttctaggaatttgtccattac

SEQ ID NO: 21770 - DNA, 1007 bp, Homo sapiens
ggactagagcttccaggccctccgcgggtactcaaccctccaggaacctccatgagtccatctatccagaagaccaccaaacccaatcctgttgggtttttgtggtggcttccttatgcaggcatgattgattaaatcatcttaaccttcagcccttctccctgccctggaagttagctgaaagtcccccaccctctaaacttgccttggtgataagcccccatcctgaagctacctaggggctgccaaccaccagtcatctcattagcacacaaaaagacaaaaattaacataactcttaattctagatatttcagggtaatggtttatgcgtgagtcttattttcttgtttctgtgtctattttctaatttttctataaaaacttctatattgcttgaattttcaaaaatttcataatatataggcccaactacaagttaatctgacttgggagattccaagggttttaggagttgtatgtcaggaaatagggatgaagaccaaatgtatatttcagagtatcatacatggcatgtatttttctatttttaaacctttaatccataatgactttatatttaaagttttaataggcagcatgtaattggtcttgctttgttacccaacgtgttagcctatgccttttgagtatctggacccaggggttggcaaactatagcccatgggtcaagttgggcttgctgttattgtaaatacagtttattggcgccaggtgcaatggtaatcccagcactttgggaggctgaagtgggagtattgcttgaggccaggagttttagaccagccgggacaacatagcaagactctgtctttaaaataataaataggccgggggcggtggctcacgcctgtaatcccagcactttgggaggccgaggtgggcggatcacgaggtcaggagatcgagaccattctggctaacatggtgcaaccccatctctactaaaaatacaaaaaattagccaggcttggtggcgggtgcct

SEQ ID NO: 21771 - DNA, 1034 bp, Homo sapiens
ggaagagatttttgctaggtgtggaatgctatttttttcccctttttatattttaaagatttcactcttgtcttctggctggcattttttccaacaatatgttttctgtcatttttgttcctctctgtatttttaatactttgactataatgtgccttggtttggttttctttgtgtgtcttttgcttagagtctggtgagcttcttgattttgtgggtttatagttctcatcagatttggaaaattttgtggcatcatttcttcaactagtttttcttcccctcacccgtttgtccctgatactcaattacacacacagtagttcccccgtatcctcagttttgctctccacagtcaaccacggtttgaaaatattatatggaaaattccagaaataaacaattcatctgttttaagttccatggcattctgagttgtcttcatcttgtcacgtgaggcgccacacaggcatcgtgtcatcgcatgccaccacaagaagggtgagcacaggatgtaagatactttgagagaccacattcacaaaacttttattactgtatattgttacaattgttctagtttattattgttgttaatatcttcgtgtaccaacttcctgtaccaaatctaatttataagttgtattttattgtaggtatgtctgtataggaaaaaacgtagtatatgtagcgtttggcactgtccacagtgtcagcatccactggggtcttggaacatgtcctttgcagataaggggggactcctgtatattaggctccttgatactgtcccatagctcattgatgccgttgttggggttttttcagtttttttttttttttttttttaaccattccctctttcattttgtgtatttctcttgctttatcttcagatttaccagtcttttcttcggcagcatctaatctgctcttaatcccatgcagtatatttttcatgttagtgcatttttcattcatggaagtgcaatttaccatccatctttcactttctttcacttctctcgttgcgt

SEQ ID NO: 21772 - DNA, 1031 bp, Homo sapiens
ccatataatgtggcatttttatcttatatctgataattgttctatcataatatgaagttttcattttttttttttttttgagagggagtctcactctgtcacccaggctggagtgcagtggcatgatcttggctcaccgcagcctccgcctcttgggttcaagcgattctcatgcctcagcctcctgagttgctgggattacaggcgcctaccaccatgcctggctaatttttgtatttttagtagagacaggctttcaccatgttggccaggctggtctcaaactcctgacctcaggtgatccacctacctcagcctcccaaagtgctgggattacaggcatgagccaccatgcccagccagttttcatcttttttaagaggaaaacaataactaaattttcttttacgttaaacattcttctatttctgttatccatttgtaattcaaaaaatagtgtatgttttgttcacgacagaacatcagataccaaacctacgagaataattcggaagagaacagcacccgaggacttcctagggaaaggacccaccaaaaaaattctgatgggaaagtaggtgaatttgtcttcatgtgggatgttcttagttatttttatattttgaagatgttactttaagaactctccatccaaaatatagtatgagattgtgtttggtacacacatagatagccaaagcaaaccgcactgtctatactgcccattgtgtgggttcatgcaccagataaaccttcattttgtctccagcttccaaaatctgtgtctctaggctgtgccattttttccgtttcagacagtagaattgtttagattccagttgttgcaaggtaccataatccttgagttctcttaccttccagttaactattcattgctttatattgtgctggaatatttttagaaaaaactaaagattatatcattatcattagtcatgattaatgattatatgctcatatagagaataattttaggtattttaaataccaaaaattattgagaaaagtaa

SEQ ID NO: 21773 - DNA, 1024 bp, Homo sapiens
taaagaagaactcataatggaaattccaaatttgtaataaatgtatatcaaaattgtaattataggaagaattacatgtcagaagtgtgggttgcaaataaagggagatgcaaagggacagttaaagcttcatatgcattaatggaaaaaatgtcaagaaagagtgacaaattgagcgttcaactcaagaagttagaaaaagtacaaaataaagctcaagaaaatggaagtaataatagcacaacttagtgaaataaaacaaactaaaacatatcagcaaaactgaaagtgtttctttgaaaagaaaatgttataaaaagaaatccagagcttgtgcaaggaaaatgaaaagataccagcaaacaatattaacagtaaaaattgacatagagatatttcaaatgattaagaggatattatgaacaactacgaataaattttgaagcctaataaaatgggaattgtttagaaaattttaatgaccgaaatagactctcaaaaaaaaaaaaaaatagaaaaccaaataaatgaacaaccattaaggaaataccagccagaatgacactttttgaatgacatcaggcccagaggtttttaaggcatatcttatcaacacttcaaagaataaataatttctaccataaatgaaaattttcagaagttagaaaaagagaagccccccagttcattatgtaagattataacttaaaatcccaataaggacagaacaaggaaaaatgtgtatgtatattcatctcacatataaatagaatgttttctatttatagaaataaaaaatgtcttacaaactcacaaattaagtaatttttttaaaaatagagacatacagtttatcctaggaatgtaagtatggttcatcagaaagatgaatataatgccagattaacaaccgattggctgggcgtattggcttacgcctgtaatcccagcactttgggaggccaaggccggaggattgcttgagcccaggagttcaagaccagcctgggcaacacagcaagac

SEQ ID NO: 21774 - DNA, 1055 bp, Homo sapiens
gccaagcaggataaagaaagataaatctactcttcattacatcatgccataactgtgggcattcagagaaaacctaaaagccactaagggataagaaagacaaatatactgggaaggcacagcagtttgactgttagcagatttctaacatatcaaccattaataccagaagacagtagagaaatattaaagtgctgaaagaaaaatgacattcaatctagaattttataccgagttaaatatactcaagactgtcgatgaaagaaagacatttttatttaaagaccaggataacttaccactcagtgaccctcattttgaaaaaaactactcaaggatgttcttcaggaggaaggaaattgaacccataagaatggagtgggatacagaaggcaacggtgagcacaaaaattgaaaaatatgacagtaaatttactattgactataaacacaaaaaagtcatgaatgatttaaaatttttttaattaaaaaattttattaacgtggaacttaactagatgacagtaataatatggaaggggaaagcagagatgtttagtgagtaatttaaaattatggcagtccttgtaatcttcaggagtaggaaaggaatactgaatattccttttcatgtatattaaaagggtaaccaccaaaagaaaaccaacttgttgctctcaaagaacagagatcaaagggaggcagggaggaatctagaccactttataaatccagcgaatggcagaaaaaaggaagagaaaggaggagagaaataggtcagtaataacaagtatagactgatttaatatacctaataagactttatcagattggatttttaaaactccagctatatttgttaatttaaatgaaacaaatatagaaaccttttggttaactaaagaattcaaaagttttattctacttcatgtgtaagaaaatcccaaagctcttcttgcttaacaaagaaccttcccaaggttacctacttttagaatgcagaggtgtcagtttaatattatcagggcaaaaaagttacaaaataaaacaaccag

SEQ ID NO: 21775 - DNA, 1039 bp, Homo sapiens
tagctgtttttaagagttataaattagatgatactcaggcctcaagaaaaaagatggaagaattgaaaacaggaggagaacatgtatattttgcaaaatttttaacaagtgaaaaggtataagtttttctttttcattaagcataataagaaatggtcttgttttatttccgtttagctgacagcctttctaagttaaactgaatagaaatgtttcttattttactttgggttaaagctgattgattaatgttagtttgaaagtcccatttcttcctttcagaagtaggactaatttggtttcaaaggtgaaagtagttctacattaagtctgttttgtaaactaattttggaataaatgcagtttaattactttcatgtctatatattttaaatgtcaagttaggatttaatttgtatatgaaaatatttcataattattatttaggtgcaagtaaggggtttaaaagttccttgttaatcttatttatacattttaaaaagtaaattttattcaaatataatgctacaagattatgtaaagtttctagtcaagatggcacattgagtttatgtttcgactcactccctttgctccaaacacatagcaatgacgggtaaaatataaacgagaaaacaaaagagacaaggctgggcttccagaaacaagataaatatcttcatggaccagaaatgccaagtagtgagcaaaactgcagcctgggcctgctggactctctatccaaggcaggtggtggtgtccaggaatttggctacaagtaacagagactaaatgtgcaccatgtgggacaaggggccagagccagattcacttcttgaagccaaggactagggtggaacttttatccagttttgggaagaaactaagaaaaaatattgccagtcttctgccaagggctatggttttataggaagttgtgagcctagggataacaaagacagctttgtgtccatctgcttgctcagtgaccagatatgtgatatgctcagtatacttatgaaacagctgctccaagaag

SEQ ID NO: 21776 - DNA, 1041 bp, Homo sapiens
agagggagactccatctcaaaaaaaaaaaaaaaaatcatactagccctgaaaaggaccatgaaattggagatcatctagttcagtgtttctcaagcttcttgtgaaatgcagattcttgttcagtaagtgtggaagggagcctgagattttgcatttctaccagcttcctaggtgatgccactgtagctgctgctggtagtaaaaatctacaaaaaccctcttatttaactggtgacgaaaatgaagcacaaagagataaaggaacaggccccaaattactcagcctgttagtggcagagcaaggaatggacacatttaggatagatctaattcctgtgaggtaataagatgactttctaagtgtatgtgagtgttcatagaatgaatgccttttgcaatatttttgtctttaagttatgattactttaaaacaatctacagattgtcagcatggttttattgagtgctacgtgtcagggactgaacaagatacctccaggaggcgagacctgacatgggtgtgggagaatggatagaatttggatgagcaggtaggaagagcaacatgaatgtgtgaatacagtagaatgagtttgatataaagtgatgaaaaatggctagactttagtgcaaagtatgtgttagggagtattgggaattaagtttgggtaaattgggataacattatcaaggaccttgagggatctatgaagcttcaaaactaaaacgggcaaataaggagccatatggagattttttttttttgtaagcacaatactcatgaatgtgatatttaaagagacagaaatatcacctagaatgaaaaagtccagcaaggaagctcttgccagatttaaagtgatgaggatccgtatcatgaagtagcattggaataaggattactgagagaatgactgataggtaatttttcccaggtataagcattttttagttagtaagatacactatcaatgaacgatatatttttcagcaaataataagcaaaatctttacaattatttgccattttaatttttttt

SEQ ID NO: 21777 - DNA, 1034 bp, Homo sapiens
acagagtctcgctctgttgcccaggctggagtgcaatggcgtgatctcggctcactgcaacctccacttcccaggttcaagcaattctcctggttccacctcccaggttcaagcaattctcctgcctcagcctcctaagtagctgaggttacaggcgtgtaccaccacaaccggctaatttttgtatttttagtagagatggggtttcaccatgttggccaggctggtcttgaactcctgagctcaaatgatccacccaccccagcctcccaaagtgttggaattacgggcgtgagccaccatgcccggtctgaagtctttttttttaagctattgatactaagaaggacagtcagacttgatcccaagctgctagaagctgtatctcacataaatcacttttggagaaacatcctcttatttaacattttagaaacgtgtacttgaattcataactgtagagaattactgccttctgaaaatgaataagaactgaagcttttatttagtgtggctgtattagtccgttcccatgctgctgataaagacatacccgagactgggaagaacaagaggtttaactggaattacagttccacatggctggggaggcctcagaatcatggtgggaggcaaaaggcacttcttacacggcagcagcaagagaaagtgagaaagatgaaaaagtggaaacccatcagatctcgtgagacttattcactaccatgagaacagtatgggggaaaccgcccccatgattcaaattatctcccactgggtccttcccacaacacatgtaaattctgggagatataattcaagatgagatttgggcgagaatacagccaaactgtatcattccacccctggcccctgccaaatctcatgtcctcacgtttcaaaacaaatcatgccttcccaacagtcccacaaagttttaactcatttcagcattaaccctaaagtctgcagtccaaagtcccatctgagacaaggcaagtcccttccgcctatgagcctgtaaaatcaaaagc

SEQ ID NO: 21778 - DNA, 1033 bp, Homo sapiens
tgcccacacagtacaggcagtcctggaaaatgacagagtcccgttgggggaattgcgttgtaaaatggacagcatggaggtgcaggccagaatgcatgctctttgcctgtagatgacaccccaaaaaatcattgcatttttaaaggattctgaatgatcacaacacacaaaaaaagaaatgataaatgtctgaggtgatgctcaatactataatttgatcattacacaatgtatacatggatagaaacatcacattgtgctcatgaatatgtacaattattatgtgtcacttaaaacaaaatttaaaaataacatttgcttgaatcagcaaaaaggagaaaagaagcaggcacttactatacactggcccactttgtgccacctatactgtattcactgtaaatgcataatttcatttaatctatacaataatcctataatgtggctgtaatgatgcccatactacacattaagaaaccagggctcggggggattagtgctaataagtggagtgtccagatagaaacttgagcctaaggtaagcagggacttcattcctgttgaatttcattatattgggtttgctccagagttccagcctttcaaagtcgttttcaatcctgttttttcaggtcatgtatttgcgaggttaggaaaacctactctgttgtgatgagatgcagaacacttagaagacactcttcttgcctacaagtaaatttactatataaagtagtaagaccacatatctgtgaagctaattatattcttgattctgggcatgaaaagcagaaagaaaaagggattttttttccatctgtatctgatttatacagggactccctaacttaacacaggaagggtgaattattaggcagattttgataatttaaagacacagtttgccctagaaataatgtttttcactggtaatcagatcatctggccatctgcaatgcctgtttgacccacagtatacctggtatgtgctagtaaaaatactgttccaactccgccatgggtgtgttgcaga

SEQ ID NO: 21779 - DNA, 1022 bp, Homo sapiens
tcaagaagcaagatctcttcccatgcgggaaggtgccactgacacagtatctcttagatggcataatcatagatgacctgaattgtgtgtagaaaagggagtttactggaagatactatttttgttggttaacaaagggctgtaagccaagtaaagcctgaatgtatgtgtcatctgcatagtgtgaagaggctttcatagggagagattccacgtgtgactatctgacctaaaggccatgtaattcccatggtgaagtccctccctccaagcacaggagccagaggagcccttaaacagccatcctcttggacgtggaaagataaacactataaatgatcaaggataactgttcaggtggtactgaccactctaggtaaactgttaagagttgaacatagaattttttcaaaagcctgttgatgtatttatgtgcctcaggacctttaaattctgaagataaatggatagaatgattcaggatgatttagggagaaggcagatggaaaatgggaatgaaatacatgcctttttgtttttaggggtgctcagttataaatatgaaaggctgagaaaatgctaattgtacagtaagatcaactggacttgttttaataagacaataatttgaaattagtaaactattttatacaaatagtgctaaaactttggaaggtcctcaacctcctgggctcgagcaattctcccacctcagcctcccaggtgtgtgctcccatgcctggctacttaaacaaaaaaaaaaaaaaattttttttttttttttacagagatagggtcttgctatgttgcccaggctggtcttgaacttctgggctcaagtaatcctcctgctttggcctcccaaagtgctgggattacaggtatgagacactgcgcctggcccaaagatgatttttatagtaaaaagttaaatatcataacaatctggcagttcctcaaaattgagtataaaattttcatatgacccagcagtttcactcttaggggtgtgtgtttgtgtg

SEQ ID NO: 21780 - DNA, 1051 bp, Homo sapiens
gtagttgtgattttgttacttttagaattttaaaactacataaaaaagaaaaacattaacattgcctgtgaaaaatcacttcgtgtgccttgttagtaaataatttgcttgatctcccaattactcagtatcttaattcccattgccattggaagtcccaacaactgggaagagatagatgactttatgggaaatactttgatttggctacaaatgcatagtcagtacccactggggcaccagcatgaggcttcctttctctaaaacctatcgtgtctcaccagcgctgtagagtgaacctcagactccacagcccagcactcagagccctgacctcttcccacctttgccttccaccttcgcctactgttactcttgttgtagtctactgatattcatttacacgtgtttattaattaatttattcaacaaatattgagggtttgccctgtgccaggcagagtcctaagtccccactgacaaagagaagagcaaaaaccctagaacggtggtaccctcatggactgtaggtctcgggatggagatgaacgttcataaagagtcacatgggtaaatgtcaacttacaagagttgagtgctacatggtgttatggtcatgtgtgaaaggggagagagggtatgttgcccctagtttatgggtagaagagggtatattgcccctgaagaagtgactatttgaactgagatctgttgatgactcagtaacctaaacaaaggggtactacatggggactgtcaaccaagactctcctctctcctggtctagaggtagacacacatgtcccagctgggccagccagattcctcctggcaagtcacatcttgagcagagtgatctgaggactaaaaacaactgcagctgcttcaccctgagcgctgggccctgaagcagctgtccatcggtttcctcctcccagactctagacctgacccgtttctgcctggctctgggcatagacgtccagcttcccctctgactcatgagtcggtatccatccatttcttttagctgagctggtcttggttgctt

SEQ ID NO: 21781 - DNA, 1043 bp, Homo sapiens
cagaggaagtacacttctgtggtcttgcagtaggcgagctcaaacaaaaataagcaaagggactaatagttttacgttttttaattctgcagaactagttaagtaagtttggggttaaggatcctttcttactaacacagatgtacctgagcaaacagttttcccattggtgctctggtgtgtcaatcatgtaatctcccctcctagctcctcaggtaggagggtgtcagggggccattactgaagaaatgttggaacttcagctgagataaatgtaaggatcagtcatttctgatttgtatttttataaaccagttcttacgtgtaaaatattttcataaagtcacagtaagatgtttttatgaggctttggaggcttttttgcataagttaaaatagaaattttgagttcttgacccaggatcactatttatacatgaattaatgctgctttttttttttaatgaagtcatctgtatccaaataacttatgataaaaattgattctgggctggccagatgctgtggctcatgcctgtaatcctagcactttgggatgcctaggtgagtggattgccggagctcaggagtacaagatcagcctggcaacatggaaaaaccccatctgtaccgaaaaatacaagaaaaaaaagtgttagcattatatggctcatgcctataatcctaacactttgggaggctgaagcaggtggatcacttgaggccaggagtttgggaccagcctgggctacatagcaagactctctctctaaaagaaagaagaaaaaaaattaaccaggtgtggtggtgcatgtctgtaatccctcctactttggaagatggggcaagaggatcactgagctcaggagttggaggctgcagtgagctacaataataccactgcactccagcatgggcaacagagtgagatccagcctcttaaaaaaaaaaaatccattctgagcatactgtcctctggttttcatagtgtcctgggagagagctcttatcacttagcacattctgtagagatgtccatttct

SEQ ID NO: 21782 - DNA, 1028 bp, Homo sapiens
taaaaggcacccacgggctaggatccccctggctcatagggatgcataagagaagtttccccttaggccaggctctttctctaaaggcaggatgtgagtcctcattagaattataggccatcagagttgaaagaggcttgggagattgtttatttcgggcactaacctagagtagaaatccagtctttactgtcagtaacagcgttgattcagtttctgcatgaacatctccagaggcagcgagcttaacttggtgaggcactttccattctttgagggctttgagtattaggtgggtcttttcttctcttttttttttttgagatgaagtttcactctcgtcacccagactggagtgcagtggcgcaatctcggctcagtgcaagctccacctcccggattcaagccattctcctgcctcagcctccctagcagctgggattacagacacccgccaccacacctggctaatttttgtatttttaatagagacagggtttcgctatgttgatcaggctggtcctgaactcctgacctcaggtgatccgcctgcctcagcctcccaaagtgctgggattataggcgtgagccactgcacccagccaggtgggtctttaatatcagcaaccctttgcttccatgtaatttccagccagaggtcccagttcccaagagccaggctgttcctcttccacttgagtgccctcctctccctccaggccacctcctttccacactgctcatctgcacttctcccttctgactctcgcctgtgcaggtaaagacctctggccatcctaagaccttctctggatgaacctcgatggttgatgaccctgcatcctgaaacagggcaggatgcagagggaccatcatctcttttgacccagtcactgtgtgtccctcagcacagctcacggtggcactttttgcctgtgacatgtcaccaggcttcctatctgacttgcagccactctggtctctgagcctcctgctactcagtgtgtcctgtggagcaggagctccag

SEQ ID NO: 21783 - DNA, 1539 bp, Homo sapiens
agagagagagaaagaagagaggaaaacacaggtgtttttcctgctattcttaaaactcttcaataggttagcaactgttttttttaaacttaacctttaggtgggtttctattgctaccttttaattcttgagatgtgtccctggacggaagacctaaatatctttctctctctctctttttttttttttttgagacagagtcttgctctgttgcccaggctggagtgtagtggtgcgatcttggctcactgcaacctccgccttctgggttcgagagatcctcttgcctcagcctcctgagtagggactacaggcacaaaccaccacacctggctcatttctctgttttcagtagagacggggtttcaccatgttggccaggctggtcttggtcccaaagtcctgggtttacaggcatgagccatcacacccagccctctttttcatttctaaaaagtgcttttgtactttgcttcctaaccagattggtccagaaaagggcgtggtgcacctggcgacagcggccgtcctaaacgcggtgtgggacttgtgggccaagcaggagggaaaggtaacccctctcacaaacgctcaggaggctcctgggagctgtacgacactgactttccctacgcacagaggaaagacagacacactgcagcccccaaaaggaaatacagataattgctttggtgtttttttctcctctgagaggttttggcagtaggtagggaactgcaggaggaggagaaagaggagacaggatggcggaaggcgcaggcagcagtagaggggggtgtggggacctggtggctgacagccagcattagagctgccaacgcgtttactgtcaggaaaaaatggggactttacacatatgtcttacaaatcctttcttttttacttcaagcctgtctggaagttacttgtggacatggtgagtagcattgttaatgttacaattgtttctgtaaatgaaatggatatcattgatgacatgccttttgatgatcagtaaatatattcaggactatctgttgatcactatagcgatgataaagcaaaaagccaataaaatatgacattccttttctgatatctgacgtaacagatggctgtgctcatgcaggcagggtggcatgaggggaagcagtgagggggtcctgcctcccccactgtgcatgtgtaacacacggtgccagttctctgagcctccattgcctgactatgacaagaggatcatcctaacttctctaggaacctcacaaaattaaagatcaatgagaaaagcacctcataaactctgaaaagccagatgttataatattatgaagatattatccaggccaggcatggtggctcaagcctgtaatcccaatactttggaaggctggaggatggcttgagcccaggagtttcaggctgcagtgagctataattgcaccactgcactcaggtgacagagcaagaccctgtctcaaaaaaagaaaaaagaaaagatactatccagtcactttgacaccaagaataagatcagg

SEQ ID NO: 21784 - DNA, 1067 bp, Homo sapiens
tggtggccgaggcaggtgtatcacttgagctcaggagctcgagaccagcctgggaagcatggtgaaaccctgtctctaccaaaaatacaagaaattagctgggcatggcagctcaagcctgtggtctcagctactcaggaggcggaggtggaaggatcacttgagcccaggacgcagagattgcaatgagcctagatcccgccactgcactccaggctgggtgacagagtgaaaccctgtctctaaaaaataataattaaaggtaccaaaaataaataattgatggtaatgccgacccaaattaaatttaaccttcaaattacttatgaaaaatgtagtatatcataagaaagtcaatagtaagaaatttcatgttaagacagtgttttcatatattttaacattttacatataaatagtatgctaattgcaaattcattttatttaatgtttaatagtttatgttatgaattcaaggcattttctatacttgtcaataatgaaaaggcatttctccttttaaaaattctatgaagtcagccttcttattccttaggaacatgaactagtgtggtttggttttgaatctgattgttcaaacactttacaaagtgaataggaaaataatttgggaacatttatatttaaacttgtcaatctatgattctgtttttcatgtgacagccaatcacaatgtgttctctactcaggaagtttagctcagtatatggattaacacgtgttctacttgtgtgatatttcttatgacaaccacagaaaacatatggggctgggcacagtggcttatgcctgtaatcccagaactttgggaggccaaggcgggtggatcacttgagcgcagtaatttgacaccagcctgggcagcatgtcgaaactgcgtctctacaaaaaataccaaaattaaccaggtgtggcggcacatgcctgtaatcctagcttctcgagaagctgaggtgggaggattacctgagccggggaggtcaaggttgcggtgagccgtgatagtgccactgcactcaagcctgggtgacagagtgagaccctgc

SEQ ID NO: 21785 - DNA, 1216 bp, Homo sapiens
tccagagaattgaagtccctgagcagatagaatcacaagagaaaaccccccgggtttagttgccaagaagctgctttcaagggccttttttttcttttccaagtcaatttcctgccacagccaaaatttctcttgttttttttttttttttttttttttgaggcagagtttcgctcttgtcgcccagactggagtgcgatggcgtgatcttggctggctcactgcaacctctgcctcccaggttcaagcgattctcatacctcagcccccacaagtagctgggattacaggcatgtgccaccacacccagctaatttttgtatttttagtagagacagggtttcaccatgttgatcaggttgatctcatactcctgacctcaggtgatccgcccgcctcagcctcccaaagtgctgggattacaggcatgagccaccgtgcctggcctcacaacccaaatttctattgaatgcgacaaattctagtctcctgttgagcaagaaaaatccatacactgtagatgaatacataagtgctgcttgtgcactctgagagtcataaaaatgagatcatccttagcttttgttaagtgcatttggtattgtgacatgaaccagaggtatgcttcagtcaatgatttatagcaacaatcaaatccttgagacggtggtttggtgtcgataataacgtacctcactgtgagtcactgacttacttcagattttctttaattcaagagcatcaaccttcaagaagtgaggaggactctgtcttctcacaattctagggaatgaatgtctgaaccagaatgattgtgtatcccattaacaaaagccctagagaacctggaatggctggttcagccctaaatgctacatctgacctaaagtgtgcaatcatccgagagctgtttcacccttagccaggcatgtgctaaaagcttggggcatcactttctttctttttcttgagatggagtttcgctcttgttgcccaggctggagtgcaatggcatggtcttggctcactgcaacctccacctcctgggttcaagtgattctcctccctccgcttcccaagtagctgggattacaggcacctgccaccatgcccagctaatttttgtatttttagtagagatggggtttcaccatgttggccaagctggtctcaaactcttgacctcaggcaatccaccggccttggcctcccaaag

SEQ ID NO: 21786 - DNA, 1045 bp, Homo sapiens
gtggcacggcccctgtggcattgtctgtcctcatgtgacatcattctcatggttcttttcgggtttctcacactggcattgtttcggcggggaactcttctcctgcagcacacggaccctgactactcggctgcctatgtcgtcatagaaactgatgcagaagatggaatcaaggggtgtggaattaccttcactctgggaaaaggcactgaagttggtgagttgaagattctctcgaggttccagaatgcttaattttcagatgagattctaatttagattcttagattcattagaatcttgatttagattgagttctgatcttgtttttatctgtatttacactgctcaaagtgagtaaaaagtttcatggtttgttacttgtttcactgggagaaatttaaaagtgacagaatttggcctctctccttgcaatcatctctagcctgttagaaaatccttggctgttagtctgtttctctgtgtcaaatgacagctacaaggatgcttttcacctgcctttcacccggggccactgtcgagctttgacaacctgtagtgggcgagtaaccaagggcaatgagagggaggagacatgagttcccatagcaaaaaaggctcattgtgatgtgcacagcacgtctactcgcttttcaatatatatatgtatatatttttgagacagagtctcactctgtcgcccaggctggagtgcagtggcacaatctcagctcactgcaacctctgcctcctgggttcaagcaattctcctgcctcagcctcccgagaagctaggattacaggctcccaccaccatgcccagccaatttttgtatttttagtagagacagggtttcaccatgttgaccaggctggtctcgaactcctgacctcaaatgatccgcctgtctcagcctcgcaaagtgctgggattacaggtgtgagccatcacacccggccttttcaaaatatttcacaccaaatcggtttccagttcactattttcatggcgaaaagggctttggccccgcccaatctcggaggt

SEQ ID NO: 21787 - DNA, 1051 bp, Homo sapiens
ctgaacgcgacggggttggcgctgagggagaacgggaagcccggggctgggagttttgagtggtgatcccgcttccacaacttgctgtgtgacttggagaagttccagacctctctgggtctcttggacccgtctgtgtaatgaaggtgtcacagtcgggttgagaaaccaagcgcgtgctaactgcgtcacatgagagggcgctctcgtgaaattacccgcaaacacgcttagaaaggactgatgcaaatgtcagttcgtcttaagagatgtaataaagtaagggcaggaactctgactcctacctaaatattgaaggtcttttttgcttactgagggtgttagaatgtcaggccttccctcccctgcccccgtctagagcggtgtttcccaaatacagtgggttctgtgcagggttttcagggagcctgttccccactgggtcctcactgcccctcgtagtccactgatgagattggccgcgctagaaaagcagagttgtatgggtatgtagtgaatgtgtgaaagtatgctgggaagtgaggaacggcaatgttaggaaaatggttaccagtagggagggaaggaaatggggtcacggaggggaccacgaggtctctaattcccattgtaatgttttacttcctaaattgggtggatggcaagctggtgtccattacattatctatactctttttgtacctgaaatgttttataaaaatagatctctcgttaaagttattaaatgcaaaacaatgtcctttttgagattaagttcatcctgcatttttaaatttttattttattctattttatgttttaaatttatttatttatttattttgaggcagggtctcttatctgttgcccaagctggagtgcagtggtactatcatggctcacagcagccttgacctccctgactcaaccaatcctcccacctcagcctcccaagtagctgggactacaggtgtgcaccatgatgcccagctactttctgtattttttgtagagacagggcccaggctgtcatcctctttaaaatcttcat

SEQ ID NO: 21788 - DNA, 1036 bp, Homo sapiens
atggggttttgccatgttggctaagctggtctcgaactcctgacctcaggtgatccacctgcctaggcctcccaaagtgctgggattacaggcgtgagccaccgtgcccatcatggtatatttttttaaatatgtacttgccttgttttcttcagtagattattttgagattcttttcttgttttatttctctaacctatttataaaccagcactttaataaatatatctgccattaataaagaggaaaaatgaaagtgtttccctttcaaaattaagagactttttttttttttttttttttgaaatggagtctcgctctgtcgcccaggctggagtgcagtggcacgatctcagctcactgcagcctccacctcccagcttcacgccattctcctgcctcagcctcccgagtagctaggactataggcacccgccaccacgcccagctaattttttgtatttttagtagagacggggtttcaccgtgttaaccaggatggtctcgatctcctgaccttgtgatctgcccgcctcggcctcccagaatgctgggattacaggcgtgagccaccgtgcctggcctcaaaattaagagatttatatagtttctagggggaaggagaaattttagctcacttgaaattcagcgatcagtattactttagtttgttacttctaaactcttgtactgaagtatcctaatgttgagagtgaaagcatataaaatttaatctttaggaaaaactgttttgctaatcttatgggttttgcatgttatctaacatattcctcttccctacagttccctccagctgtagatctaatgccatcaaattttatcacccactttgtctggttgctgttattcactgataccattcaagttattctcatttaatgactcaccattgtcctctccaacaaaactcctctcctgtcttaactcattgtcatcttaatacacatggtgatgattcttctattaccctggtctcttgtagcttgaactcttctcctgtgtaatcttgtctttc

SEQ ID NO: 21789 - DNA, 1035 bp, Homo sapiens
gggcattgtggcttatgtctgtaatcccatcactttgggaggctgaggcaggcgaattgcttgagctcacgagttccagaacagcctggacaacatagtgaaactctgtccttacaaaaaaatacaaaaatgagccaggcgtggtggtgctcgcctatagtcccagctgctcagaaggctgagataagaggatgtcttgagcctggaaggggaaggtttcagtgacccattatcatgtcactgtactccagccagagtagccagaccttgtctcaaaaaaaattttttttgaatgtaagactattataatatattcaaaaattagcttaaaatggcttgataggcctgacttacagaagagttcagacttacagaagagttcagacttacagatgaacatgtagaaaatcttctggtgaagaattttccggacacataaaacataaaccataaaaataaaaaattttaattgaacttaaaatttaaaagcatgttcaaggatactgttatggaaatgcaaaggcaacctatgaactgggagaaatatcacagtttagtataaacatctgacagagaactagattccagaatatataaagaatataatagtgttagagtagtaaatattcttgtttccagaacataacagaaagaagacagcccaattaaaaatttgatttgaacagacactttagtttaaaaactgatttgaacagtcacgtcaccaaagtagagatgggaagcaaataagcacatgagaacatgctcaaaataaggtgtagtcattagggaaatgtaaaaaccacaaagggatatcactacataccaattagaatgagaaattagaatgttttgattctagaatgaagttgatgattatcttttctatgtttttgtatttatggaagtattcctaactctaatggttgcttcctattagagttgggaatacttccataaatacgaaaacatagaaaagataatcatctttcactaatcatgtagtgctatccctttgcggttttaacttacatt

SEQ ID NO: 21790 - DNA, 1047 bp, Homo sapiens
aatggcaggaactgggagaccagttaggctattagaataattcagtattgttgaattagtgaaaggtgatgtgacctagaccagggtagcagtgggaggtggagagaagttgtcagatactgaatgtattttgagaatagggccggggggttactgaggagtttaagggtgtgaaataggtaataagggtgacttcagagtttgggcctgaaaaactagaagaatggcgttaacatttatcgagttggggaagattgcaggaggagctgctttggggaggaagattaggtttcttggaaatgttaaatttgaaatccttttagacgtccaagtgaaggtattgcgtagacagttaaaagtgagttggagtgagaagtccagaagtccgtaaagatacaaacctggtaatcatcaatttgcaggtggtatttaaagatataagactgggtgatatcaccaaaggaatgaatgtaaatggagaagtcttttcggcaacagtccagtgtgtagatgtcagggagatgaggaacagttagcaaaggagactgagaaggagcagccagtaagacggggggaaaccaagagggtaatgtcttacaaagcagatgggaaggccaggcgccgtggcttaagcccgtaatcccagcactttgggaggccaaggcgggtggatcacaaggtcaggagtttgagaccagcctggccaagatggtgaaaccccgtctctactgaaaaatacaaaaattagccgggcaagatggtgggcgcatgtaattccagctactcgggaggctgaggcaggagaattgctcaaacccaggaggtggaggttgcagtgagccgagatcacaccactgcactctagcctgggcgacagagcaagattccgtctcaaaaaaaaaaagggaaaagtgttttaaggaagagagagagagaacctcagtttttttcttatttttttcttttattagtcagcattggatcagattgtattttaagtgaatgcgagaaacataggaaagttggaacaaagtttgctaaaagaag

SEQ ID NO: 21791 - DNA, 1017 bp, Homo sapiens
aatgtacttaattcatcatacaagcatttaacagcaggctggcagggtgcaatggctcatgcctataatcccagcactctgggaggcccaggtgggaagattgcttgaggccagaaggtaaaaattagccttggcaacatatgaagaacccctttctacaaaaaaattaaaaaattagccaggtgtgtggtggtgtgtgcctatagtcccagctactcaggaggctgggcaggaggatcactgaagcctaggagcttgaggctgcagtgagctatgatcacgccactgcactccagcctgggcaacacagtgggacctggtcacaaacaatcaaacacccagcacgccttctttgtgcccaacatggccttcaggctgagaggaatacaatcctgatcatctggaatttatagtctaattggagagagaagacataacagaaaaattaaataaacttacaggaagtatgtgattgaatgtcagtctgaatggtaatgacaataagtactgtatctcagataagagatatgtacaaaataagcttcctagaagatgtgaaatgataaagactttttggactttctctataggcttcaattccctgtggtgggtttttagtttcatattttgacaagactcaaatcagaagcaagttcccttgttttgttttcacaatctaccttttttagaacattgtttagaaagttatatattgaggggtgagctgacattatttgactagatttccaaaacttaaaatatgtaggttatagttttaaaaatttggattgaattttgtttatcccagtttcttctgatatagtagaaggttgtgcgagctcatagagaaatcttggccgttggtctagaggattgttagtgagtgacagggctcagatccacagagcctttggggaatggctaattattttaacctgggggctctcatgagcttattgacaagtagtcagacactctggccttccctaggcatttccagttgccctttctagttta

SEQ ID NO: 21792 - DNA, 1027 bp, Homo sapiens
taattttccttactgtctctgtgttttccattttattgacttctgtgtttttttttattatttcttttggtttactttgctcttctttttctaacttttttaatttttaattttcttgggtattttcttaaagtggaatgttatgtcggttaacttacatctttttttcttttctaacttaagcacttaaagctgtaagtttccctctaaatcactgctttggttgccttccacgtattttgatattttgtattttcattttgattcaataaaaagttattttctgattttccttattatttcatctttgacctatatgaattatttagaagtgttctatttcatttccaggtaatgagtttatctcagtgtcttcttgttcttgatttctaacttaaatccaatggggtatagaacatacgcttgggatttcagtccttttacatttctagaaccttgttttatggcccagcatacgagttatctttgtgcctgtattatatgcttttgggaagaatatgtattgtctatacatattctttccaaaaattgttagatgcagtgttctatgaatgtcagatgcagtgttagaggcagtgttctatgaatgtcagataaagttagttgatagtgtttttcagaacttctgtgtctttagagatttttgcattaatttctcacttgctgggtagatttttttgggttggtttagaatagtgtttaaggctaattatgcccctatactgatgcaagatcggtctaattacccagtacccctgtcaagaactgtgaagtgtctgaaattttaccctatttggaagctaacaaattagcttgctttagtttcatggatgctagcagaagataggagactcctaggtcagggacaaaggattttactgctcctggcacagcatgtgctttatgctcacaggctccctttgcaccccatgtcacatgaggacagtggcaatcaacatagttagatgctgtgcatgcagtgggtttcctatgcatgcagcaattc

SEQ ID NO: 21793 - DNA, 1036 bp, Homo sapiens
acacagcccttccacagttggcactgcaggtgcaggccaaccctttaaagaataaacaaggaagtcagctctttcactttttacaagttggcaaaaacagacttccggggaatttcgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaatgcatttggctcttttcttcaggggacattgaaaccatctttctagattcttgccagaaattggtaatttccataaattagcatcttgatctttgctgacacttaaatttgtctacagcaggagctcctttttgttgcttattcttaaaacctggcttcagaagtgcagctacacccccaggaactaacctcttgctttgtaccttctgccaggaaatgacccatccatatgtgacttctgctgtggtctcacggctgtccaggaggctgtgtttacctcctctccctaagcacttgaattccctgggagtcctgtccagagcccctggacaccccacctttccttaaacccttccttagggtgggtatgatttagcagtcaatcctgatgttttcatcacagagtcagagtgacctttgatcaaaaccacatcgcatatattacttacatggtgatgttttgtcctctcagattgctgggcccttaccagatgcagcatatgctgaaccctgcatcccaaaggccctccacaggagcgtgtgttcaggatggaa

SEQ ID NO: 21794 - DNA, 1026 bp, Homo sapiens
cctctgggaaagtcttatctcgccctggaaggtgaggtcattttccatttcagggatacatgaaagaagttagtcctcaagaaattaagtctacaaaggcaggcctcaagtaggtcaggaaaggctctctctctctttctcttttctttccttttctttttctttctttccttctttgctttcttttttctttctttttctcttcttttcttctttctttctttctttccctctttcttcttttgttgaggttttcttccctcaattatggataccaatgagtgtagatgtctttgaagtgggcttgtttggtagataataagatggtctcagataatagacctgaaagggtcttaaatactaagccaccaacagaagatgcataagctatatttaccaggctttactaagacagatatttaagtgtcacgggtctctgtaccttcttcccatttgttttcccaaagctttggtaaacatctgccttgtccctgctgggtaaagccactgtgaaccatatgagaatgcctggatgtggtgatgagcatctgccctggtggccaaacgtggataatcttctattgttgaaaagaagtggcgatttcctcataatactttgcaataacaacctagagcctaatgctttatccctctgaaaaaatcccaataattgcctatatatctgtgatccattagtttatccagtccattggtaaagctatttataatttccatttctactgtctctgcctcctaggataacacatccataattttactatttcttaaagcaggactacatttatttgtcctcagtttgctttttcaagcttcaagggatactcccttaccctaggatgacaaaatttagtggataaatatttggtgagttctttttgatctatataaaacaagtgtgtgtacacatatatacataagtatatatgcacatatatatcctcaacataacattttcatattgaattgtacattgttgtggttgtagtttaagctttttaaatatag

SEQ ID NO: 21795 - DNA, 1065 bp, Homo sapiens
atcgaacagtttcttgattgctctctgaagtaatatggaggtacactttctgctgcaaggcgtgcccgctgtaacaatactctggaactgaatcatgtctaggtctctgtcttctcatttggagcacctggagatttgttgtttttaatagaagatcttatcctgtgcaaataaaaagaattaggagtttctggtatgcaagtatggtttaaataataaggaaaaacataaataaaaataaacaaaagttacaagtgcatggtaccatctcctttcctaccttttttgccactgttcccctgagagtctcagctctgccttccccatttcactagccgggtgattgatggggagaggtgctccttgaatctcccaactaaaaacaactgtctttttctaatggaatactttatgaacagtttatagaagaaatcaaaatggcattattagtgctatattatgtatgttactagcgaggtggaaactgtactcttgtggcatgggtaaatccagattgaagtccaggctctgctgccctctgtctctgcggtggttgacaaatgatttcagctctccaggtctgttttagtcatctgtataataggaataaggccgcctttgacggggctgttgtgaaaagcaagatatatgtgaaagcactcttgttacataggtaattatctcaataatcatattgataattactcttttttcacatttttttaaaatttcagtagcttttgagatacaagcagtcggtttttggccacatggctgaattgtatagtagtgaagtctgagattttagtgcacctgtcacctgagtagtgcacattgtacccaatatgtagttttttatccgtcaccaccacccccgccactgtctgccttctgagtctccagtgtccattatattactctgtgcctttgcatacccatagcttagctcccacttatacatgagaacgtatggtatttggcttttcattcctcagttacttcatgtagaataatgaccttcagctccatccaagtcacttcaaaatacatgatttcattcatttt

SEQ ID NO: 21796 - DNA, 1035 bp, Homo sapiens
cacactatgtctgtcttggctgagtcccttagacagtagtgatttttacaaacaccactgcacatgaacatccagagtgaataagaagttgggaaaggcaattgcggttgaagcatttgtgatgtgtttcccacttcccctaatcatcctcaacaaacaagaaatagaggtcaaacatgattgtatctcacatgccatgcatatgacccctcacctcggttctttgccatataaatgatttttgctattgattatagcagtagtacccattgtgtgctctttggggaagcctttactgtttaagatgattgccctctggtggtctgatgtgtaccttcttcagaatgtgaaaacctgtgcatctgcagtaataaagtatattatgcaggaaatgagatgagtatttcacctcgaaaaatcaaatggctgataaggcatcatctgaagtgtacatgctgaaaaatatgaaaatatgttcccccaatctctgatcttacgtatgatatagagagacgttagcatttaacacgataatccatagcggaacacacaaataaaatcagcaatctctgacaccaagttatcaactacctaagaaatacacatatttcctgcccaggtattaggagaaaagtctcatttctaagaatgctgtagactatatttgtaaacattttgttcatttctgtaccttgcagttgaagtcattgtgtcattgagaaaccatgaaaataaaagtttaaaagtgatatcagggcaaattgatttctggaagaaatcaaaaaaaccccttttcgtgtttggttttcagttgtatcataagatacacacttattcagaagacattttactgtatgcataaagtggctatttatacctgcagcattttaaagacacatttttgaaattaacaaatgaatctgtatagcatgaattatgcatatagcaattgatctagtaagtaaatttttaaaattctggtggcatcatgattctgtaatttatttacagggcttctgttatttataattttaa

SEQ ID NO: 21797 - DNA, 1084 bp, Homo sapiens
ggcaacataaaatcaagtagtattcacatattttaatttagtttaattctttaaatttccggaatagttctaactatgtgcgtgatatttatgtaacattgcttagcactttcattgttggggcagatgaagagatgtgagagcaagtgttgagtatgtttgaaacaccatgggcaggaaatgagctggagtggaaagccctgggacccatgggcaggaaatgagctggagtggaaagccctggagtggaaggatcggtttagtgtgctcacaaggttggatattgttctattggtatattggttttctcttgtggcaaaacatcgcgtaaacatagtggcctaaaacagcacccgatacacatagtagcctacaaccgcatgtgtttatcatctcacgttttgcataggccaggagtccagtgtatgtcagttggtccggtgttcagggtctcagaaagcagaaatcatgttgttcactgactgcatcctcatggagacactgggctaggaacagatcagcttcatactccttagggttgtcggcataattcatttccctgtggttgtgcaactgaagtccttactgtcttgctggctgttgtccaggaaccgctctcagctacagagtccactctcgaatccttcccatgaggctcctgtagcacagcaacatagaacctccctcaccatgatttgtcttctcaggaatctctgacctcaccatcggcaaccagctagagaaaagggctcacatgattaggtcaaacccgcatggataatgtcctggtcttaaggtcagctgtgccctccagcatcacctcatcacaggagtaggatctactttattcacagtttcagggatggtgcaggcatatacaccagggaggaaggaaagcttgagccatcttagaattctgcctgtcacaataggggatgagtgcttctgaggagctttatgtaggggagttatttggctcattcatgttttaaaatgttcttctgttggctaaatagcaattggaggctaagagaatagaacagggacactagtcagctctattgtaaagaaccaggcaggagat

SEQ ID NO: 21798 - DNA, 1053 bp, Homo sapiens
agaaaagtagagaggtagggccctactagagggagtaggagagtggaaagtgagaccaacagcaggttgttttggtttctttttgggattttctttttggatggatgatactagggcatttttttttcatgcaaatagaaaaaattcagtagaagggccaaagaatattactgtcttctagtttgctagcaactgatggtttttagcagactggtggatagtactctatagtcacaaatacttatgttaagtaagacccacttctcctataaatttacacttgaaatataaaagaaaaaaaggttgatgttaaaaagtttgtccatttgagtcctatatactcgttagacaggtaaatggtacgaagacgttttcttttatgaaatgctttgttattctgtaggaatcctgtcttacacataaatgacagaaatttatattaagcattttccttcactaaatctttagtttgtgtcttttcataaaatgccactgaatttttatgtcagcaagagaggtagataaatttgaatacagaaactaatttagcagtcatttagttaggagatggagattttagagctgccacttctaaaagtggaaaagatgaggattaactgacttttttttcttgcttctgtggaataaaaaattagagctgaaaaggaacaaagcccaaaatgcatggcaatgaccgtctttttataggtgaattagattggggattgtgaagatgatttcattcacacctgcacatgcatcctttgaagctcattaccatttcttttggtgttcatttaataaatatattcctgagagagggatattgaaatatgatttacgtttctttaaaaaaaaattaaggactcctcttgccatctgcctagcatacttatgaatgtccttaccccaacttttaggatttggagtttccaggaatccaaacctttaaagcctgagcaaaacacaattttaaggtaaatttagtataaggaaaggacagtttcagtcaaaactaagcataaatacattttgtctcactttctgtttggg

SEQ ID NO: 21799 - DNA, 1029 bp, Homo sapiens
gtggaggtgaaggtgtggaaggtaggggtggaggtgaaggtgtggagggaaggggtggaggtgaaggtgtagagggaaggggtggaggtgaaggtgtggagggaaggggtggaggtgaaggtgtggagggaaggggtggaggtgaaggtgtggatggtaggggtggaggtgaaggtgtggagggaaggggtggaggtgaaggagtggagagtaggggtggaggtgaaggtgtggatggtaggggtggaggtgaaggtgtggaccatagaggtggaggtgaaggtgtggagagtaggggtggaggtgaaggtatggtggggagggtaagagctgaaggtgtggagggtaggggtggaggtgaaagtgtggagggtaggggtggagatgaaggtgtggagggcagaggaggagatgtaggtgtggggaggcaggggtttaggtggaggtctggtgaagggggacagaggcgaaagcgtggaggtgatgagatgatcacattctggagatattctgaaggtagagccacaggatttgctgaaggaccatgtggtgcatgaggaaaagttacttcttgatgtttttgttggtttgtattttctttggcgtcagactctgggaggatggattgattgactgttctggaagactcagggatgccctggtttggggagaaacttcaagtgttcacttttggacatcataggtttgatgtagacttttagtcaacagaaaagaaaatcccgcacttgtccttaagactcttaggtctggtggcagaatgacagatgcatggtcatagggatacatatgcctgcactggatggaggagaccgtttcatggggcagagggaacttgggcaagactgctgagtgaaggtggtgttggagcgagctttgaagtatagggttaaggagtgcttggggaaatgggtggactgggggcttctaaacacagaagcagcacagcacgttcaagggcactggagacttagaagctcactcagcacctggagcactgcaggtcattgg

SEQ ID NO: 21800 - DNA, 1057 bp, Homo sapiens
ccacccaaacaaagacactctttcttcaccttgctgtattctttggatatcagatttcactttctcttggaaggaaaccctgatctccccagtcaaggttgagtgcccattctctatgtcttctagcatccagttctctatgtcctgtagcatccaggcctttttaatggcatttctcagctgtcttagaactgtttacttgggtgtgttttctctaaattataaggtttttgaggatgggaatttatatccatgtcttttttgttcatcattatgtccccagcattagcatactgtgctgtgttcattacaggaacaagcagctgggtggtctgatccagtctaattgtcctctgattcttcttccaaatccatacctgttttcttacattgctgaacttgaccagaaagaaaattctaatgctacctgatctccttgtcttattgaaagcgattttgaagtagttattctcaaatattactttactctggaagccttttgaaactgcgaatctgtaccagcttaatttttgtgcattcttaatctccatccaggtggttctctgaattttgttttcatccctgtctctggcacacatctctgtctgtatgcgtctggaaggttgcagtattgaggaactaagcactggggatcacctctctgtctgtatgcgtctggaaggttgcagtattgaggaactaagcactggggatcacctctctgtctgtatgcgtctggaaggttgcagtattgaggaactaagcactggggatcacctctctgaaaattactcttaaattaacattttatatggtaaatgtaaaaaataagagaccctaaaaagcttcagtttggtattgtgaaatatggattcaatatttgaccaaaaatcatgttgattttgttagacttattatgaaaaaaccaatctgggccaaagaagggagaacccaagttttgatcctttgcccttaagggaaaattgggtctacatacaaaaaaaaaaaaaaaaaaaaaaaaaaaaaaaccaaaatacctccacagctattaaagaaa

SEQ ID NO: 21801 - DNA, 1073 bp, Homo sapiens
gtagtgtgactgtaggagatagactcttaccctctaggttttactgtgtctctataataggcgaagaccaatggacagtgtgcacagtttcctggcctagtcacagaggagatgctccatgagtgtgtaaatgagagaaaagtctttccattttctgcactgtcaccttctctttaaccttgctatcctaccctttccttttttctaggtacttcaaatttggcacaaacataactggctttctcttttctctacatagtagatttgtggtcctctccagctcagttgattagcgtaggttaggttacgctgctgtagcaacgctcaaatctctgaggcttcaaagagcaaattcacttcttgcatgagctatgtgtgcactgttgtttggcaagaagcttttactcataggaataatggagggacccaggctgataaggaagtgtgatcctactatgtgcctggaaagaggagaatcagaaaaacttgggagagagaatgacaaacgactgcagctgcattccctaaccacagggatcgaacataccatccaccagatgcccaagcaccctcatgcatgctgttttcctcatcctgctatattctatggattctaatctctgcagaaactgcttactgatgcttctttagtggtggatccagcatttacatataggcagggcttagctaggtaggctgttgggaagtagggaactagaggatttatcctaagtctacgtttgcagagccagccacttgaaattttgacgatgataatgatgattttagggtaccttatggtaggagctggaactaatggagctactggggagggctaaagctccccatcctccctgccttccaaaactcctctccatttctaggatattataattattcaacccctcatcttctttctgctgggtcatcaaaacgcattcctcaatggtcctcctttatttacttttgacctcaggtctgttccctaatccattctccattctctagccagtgtggtgtgtctgaaacaccaatctacctttattgtgctcaccctgaaaatcttgaactcg

SEQ ID NO: 21802 - DNA, 1049 bp, Homo sapiens
ccagtgaactctggggactgagaggtgatttctgtcttggctcagagtgagtgtttaaaaaatgcatgttaattttggtatcaaactttaaaaactttagttggagtaacaaaattaatgtgagagggaataaatactaaattggagaagcgtgacttcaatttgttaatttgcaaggcattgatagctgaatgctgaatactgtctcatttgcattatggttttctggtggtttagaaaagcaaaatatcagatgcacaacttactgcatcaagtttatttagttaatacactttagccaaaataagtttttcaaaacagaacatgttttgtgaataattcatccataacaagaagagtagccactttaatttgtaaaccgcttttagctgaaggattcaggagctgtaggtcaaatgtcagtgtctcaatgaaatatttgcgtttaatttttaagacatttcttctgcatgaatgcgatttaggttaaaagcaattttttatcagttcatgtacactgcttggactttggacaactttgtgttgaaataaaagatcaggattttttttaacttgatcggatgcaattttatttataattgttttttaaaaactggttggtcaaatgtattaaagggccacctaggtagaagagaggcaactatccatgtactgagagatgtgatgctgttatcttgtgaatcttttctggacttatatagtatattagattaagtgtggcaggaacttgctgtaaaagtattttcttccgtgttgtatgatgtgcattcatcttttaagttagtgctttccctaaaattcacaaattagaattcatgtccactccagtaaaatagaactccaagagtagactgaagaataaatgtttcctttctgtgagaatttgagtatatataatgaagagagagactttttttttttttttttttttttttgagatggagtccttctgtgtcacccaggctggagtgcaatggcacggtctccgctcactgcaacctccgactcctgggttcaagcaattcttt

SEQ ID NO: 21803 - DNA, 1036 bp, Homo sapiens
ggatgtttctccttttatttccgattcaaattttaattttcactccaattcaaatgtggaaattgctccttttaatttaaattgctttctatcccgaaaaggacaaaacacaattttactccactgaacagtgatggaaggaaaaagttctagcaagaagaagttgaaataatcaaaggatctctgtgtgtttgtctagatcactgtgccaccagctatgaatctgattaatgtccttgaagcatcagaaagtcactctcctgccaggagtcctcatttaaaacagcagcagaccccaaaaaagtgtgcataaaattatgaggactggcgtaactttttctttttcaaaatattggaataaaaatattggcaaaatttagaatttagaaaattgataattaaagcataggtatgggaagactggggtatatataaacaatggaaaggtttctcttcttttcaaacattttctttttataacagatttggataagactacactgagataaagactcatctaaacacaattaagtgtgcctaatggagcaccatatcttcatatgttttatagccacatgatcaaaaaagatatattaaattacttgctttattgctatatttttccattgtcaggtcataatcaccttgagttaagagataaataactgcatattattataaaacaaataccatccttaatcatcttttacaagagattcaagtagtttagtaattttttaggggtgggggtggtggggagtgttacctggggagtgttgacagagaaagaagtctgatatggtttgctgaatattttcatggtttcctgtaatcattagcatttataagaatacactgtgtaatgagttgacaccataaaattagctttgaattctcctcaatggaaagaggaaattacggtaaactctttttatgtctttagttgtaataaatccccagtatcatgtgcctactcatttaattatttgtgggaacatagtgtgcctacatccctctaagtgcaatgtagtacaag

SEQ ID NO: 21804 - DNA, 1008 bp, Homo sapiens
acagagagagcactcaaacacgtggtggagatgcccatggtgatgagctgctgctgctactgctgtggtttccatggctggtgctactctcctggtcttgagtggtgtgaagagcagcttccagagttggaaaatgaagtcacaccccacttgggggtgtctaggagtaagactgtgtggaagacagtgataccataaattgacaagacagtatccatctttcctaggttatttgacttctgctgttcccttccagaatgaggctgatttgcaggatttgcaaaatcttcctaaattctgaattcactacacttagagaaccatttatagtggttattataacaaaatagaacaaaggtgggttttatattgtatattcatctcttacaaaattcattgtttaatgtataatgaataattgcaaattttcctaaaataaacagtagaatacagttaccatgggattgggagaaaataaaaacccagaaattctgagaaggttttacaaatacattgtaaaacctcagaattttcggatgaatacattgtaatgtaatgcactaatgggatgtagtcagatctcagcaggacactggaggctgctcctaagggagtgtcctgaagccaagtcatatcatagagagatgaatttggatattctgggttagaaaaatctgaggttatgagacagatccagaataagggtcactgatctgagaagcagaatgactaaggagcaaaaaccaaaaggcacttgaggagggtctggtggcatgagggggagattaggaacaaatggtagattgaagctagacccagattgaggtgaggcaagggtgtgaaacaatttggtccaagccagtcttatagactattccttttcttccttttccttcttttcagagatgggggtgtcgcaaagttgcccaggctggctttgaactcctagactcaaagcaatcctcctgcctcagcctcctgagtagctgggatagactatgcttttat

SEQ ID NO: 21805 - DNA, 1015 bp, Homo sapiens
gttcgagaccagcctggccaacatggtgaaaccccttctctactaaaaatacaaaaattatctgggaatagtggtgcacatctgtaatcccagctactcgggtggctgagacacaagaatcacttgaactcggaaggcggaggttgcagtgagccaagattgtgccactgcactccagcccaggtgacagagcaagactctgtcaaaaaaaagagaaagaaatggtttttaataaaatggatttctctctgaataaaaaggtatgacttttaaagacccctgaaattttagtgaaggcttccaactctaaaagcagcaaatggcaaatatttaaatttctgctacttattctgtaaacatttactgagtgcccaaaaaggggacagcaccactgttgctgctatgggatcattaaaaaaaaaagagtaagtcaaataccaaggagatttcaagccattggtgggtaaggacatttaaactattgatcataatacaaagcagaatgaaagaatgattctaatactattacaagcagagtatactagaaaagatgcattacatcaaacttggctgagtggaagttacatgtgtatttatgtgtatgtgtgggcatgtgtatgcatgtatgtatatgtgtatgtctgtgtgtgtgtgcacgtgtgtgtgtgtgtggacacttctggaaggagatatcaaatgagctaagctttgaacttccagagatttgagtttgacccttccaggaaatgttaacttttacttttcttacccaaataatatctcattcaactttttttttaaattttaattttgagacaaggcctcactttgttacccaggctggagtgcagtggcgtgattgatcatagttcactgcagcctcagcctcccacctcagtctcccaagtagctaggactataagcacgtaccaccatgccaggctattttttcctttttatagatatagggtcttactatgttgcccaggctggtctcaaactcctagggtctagt

SEQ ID NO: 21806 - DNA, 1045 bp, Homo sapiens
tcacttagaaaaaataaatactagagaactttatcccaggttagacaccagctgccattctaatggcctctaggcattctaatggcctctaggcttggaggtgctaagattgaaatgattaatttgtttccctgacagatcttctgaaacacctccactcacagctctgctagaagcgtcatcacagcagccaatgaggctttaagtgagaagaagattcttggaactgagtggaggggtctgggtgccctcttagtctcctttctaggatatcaggctttttttttagcttggtttttaatatattctgtattatccttcaaaaaaatccatttgcccttcttttcatacaaaattttttcttatcaaattccagaaatacatgaaaatgagaaagccagttttcttgctggaatacaagactttggtttaaggtttatggattatgatttatggatttttaagaattataaacattattgacaaaatattttgaaattgtaaatgtgaagaaaagttatactgcaagaataagaaagtctgagtaaaaataaacctgctttaatacgtagatacttatttttaggtacaaggcttgagggagtgacaactctgaacaccacattccacagcaacaagtctggtgcatgtgggcagccacgccagaggcttccttggagtattccagaaataaccctctcgaactggagtctgtctctgacacatcctcttctccatactgacactgtctctggttataatagaatgcagcttcacctttccacatcactccagactagatgcgtaatcagtccctctgacactgctgctggaatagtaatctgacacctgccgtcagctgagggtccttggctattgactgtgcagagctgtgggagagtggacagcccagagacaaccggagaagcagatcttattactggaataattgcacctttgtgttccaacactgcacagtatttttctcaggagccaaaactggcttctaagattcttggattccaggctcaccattccaggcaag

SEQ ID NO: 21807 - DNA, 1024 bp, Homo sapiens
aaaacaatttttttcttctcagagagaggttgtgatttatgatgttgttgtatctcccctgcagctatattttcacactaatgtaaattgttttaggttgtcttattctgtggtcgaaacatttactctagaaaaagaaaagcagactgaggccaacaatgtaaaaatattcagtccttcaaactaacgttttttactgatttagtatttacggtttcattacatccaggtatatatttatctcaaatagctttttggttttatttatttgttcttgtttttaacaagtctgggagcgtccagttggaagcttttcagttttaacagaaagtaactttttgctgtgttttttcattgttggacttgttttatagttaatggtccattgtcaaaagttcgcaccgtggctgactcttctttaaatctgataatatattgttcctgttttccccagctgtagaacataacaaatgtttaggaaaaggttgagatttggtttgtgtatgtagatactatgaactgctagttgtcgtgcaaattggattatttgagggctttttgaggtaatttatatttttaccatttttagtaggacaaaggaactaatttccaaattgcttactgtgctagcattataatggggatttttctctatgaaaatagtttagttttttattgaggatgcttataaaacaaaatagatttagtctcttacctcatgtcttagaaatagtaacaaaaaaaatactaaacaaaaaccccacacagaactgtgtatgtacacatagtatatttatatgtgaacagaaaattgtattgaaaaataggtcaggcgtggtggctcatgcccgtaatgctagcactttgggagaccaaggcgggtggatctcttgagcttgggagttcaagaccagccctggcaacatggtgaaaccccatctctaccacaaatacaaaaaaaatagccgggtctggtggtgtgcacctgtagtcccagctacttgtggggctgaggcaagaggat

SEQ ID NO: 21808 - DNA, 1054 bp, Homo sapiens
tttgttgagttaatttccagttttattctactgtggtcttggaagatacttaatatgattttgatatgttaaaatgtatcaagacttgttttgtggcctgttatatggtctatcttggagaatgctccatatgctgatgagaagaatgtatattctgcagttcttcggtagagtgttctataaatatatgttagcttcatttgttctatcatgtagtttaatttcattgcttccttgttgaccttctgtctcgatgagctgtctagtgctgtcagtgcggtgttgaagtcccccagtattattgtgttgctgttctatctcattttttaggtctaatagtaattgttttatgaatctgggagctccagagttaggggcatgtaaatttaggattgtaatatcctcttgttggattgatccttttattattatataatgaccttctttgtctttttttttttttttttttttttttttttttactattgttgtttgaaagtctgttttatctgatataaggatagtaactcctgctagcttttggtttccatttgtgtggaatatcttttttcaccactttaccttgaatttatatgaatctttacatattaagtgggtttctaaaatacagatatttggtttatgatttttctatccattctgccaatctgtatcttttaagtggagcatttacaccatttactttcaacattaatattgagatgtgaggtactgttccagtcatcatgttaattgttacctagatggtttgttttcttattgtgttattgttttataggccctgtgagttttatgctttcaagagattctattctagtgcatactgagcttctgtttgaagatttataactccttttaacctttctcgtagggctggtctggggtactgacaaattccctcggcatttgtttgtctgaaaatgactttatttctccttcattttgaaatttagttttgctggatacagaattcttggctctcagttattctgtttaaagaggctaaaaataaaatcccaattccttctggctt

SEQ ID NO: 21809 - DNA, 1037 bp, Homo sapiens
cattataaattataatggaaaaaattaagaatatttattagtttatttaaaaataacaatataatcattacttaacataaataatattttaatgaaaatagttatattctctgaaacaaaaatatttagtgactagagcggcgttgtttcacatttttgcaagtttttaatgtctggcttaatagaaggcagccaaattcttatatgtgtttctgcattgcagtctgttgcaatgtgttgtgttggttgaagtataagaagaaaatccaggcacgcgtagatacaaggaccaaaaagagaggatgtcgaggaccccttaaaaatatcatagagacccccaggagcccttggaccacagtttgagaatcagttttaagacaatgggtagaggtttagtgatagcctcttttttttttcccagctgttagatgtcgagggagcatggtaataatgagaagtcatctgaacttggagtaaggcttgctgctgttagtggttatgtgaattaagcatgtaataactttgaagctcggtgtctgtttttgcagtgtgattcggagcagcatagtggttaagtgggcatgggagctcctgggttcaaagctgggctccttcactgagtggcttaagttggggcaagtttcttaatctctgtaaacttcaattcgttcctctctaatatgggaatagaaagagtcgtttcttcttggaattactgtgaggcttaaggggttaactcatatgaagtatttgaaagtttggcaaggagtaagccctcagcaagttagctgttagtatttttgttacatctgggtttccaaaagtagcttaatgggtatggtaggtagtaaaaccattttctttatctttgtcacttctgacatcacgctttcagtttgctttttaatacacgtacttgagtggactttccctgtcaactctcataacattgcagtttggaggtggtgggaagtggttgaaaagacacggggcttcctggagggggactagggcacccggggggcctgggagtcggg

SEQ ID NO: 21810 - DNA, 1052 bp, Homo sapiens
gtctatattttatgcactcaatttctgagaatggttagaacaatgattttttttcccctttctcttctaaaactataggttgctgtgattttattcctagaagatatgtgactgtttttgggcaggttcacacatgcaattcagcttagaagaggaactgttaaggttaacagaccaagaactcgaaggagcgtccccacttcagcagttgctgtggtctttgtgttttgtgtgaatcggtgatgcccatctattttactgcagtcgatcattagtaatctttagggccactttattcttttactatgaggacaaggagaatataattgtccgtcttttcagaactggcttgcatctgtgtccaaaacaaacaatgcccatcactgtggagtaaagggcgagagaacaaagaaaggaagctgtgaagggtacagttacacattaatcaccgtgatgcgcaaagtgtgaggttagtaggcactgctttgaaagctttacattgcatttatttccaaacaaattgtctttcaagatcctagaactttcagcccagagtagctgtaggccagctatggcttatgaagaggtttctgatgtcccacatttagcaactttgtaaggcttttttttcgtagttacacatttggattcagcattttttgaattttagggagtttaaaaataatctcatccagggtttctcaatctcggtacagttaacaggaatttgttgtttcgcatgctgccccatgcctggtaggatggtaagcagcagtcagtgttccttgcctcacctcacgagatgtctgtagcacctccccctccttagctgtgacaacgaaaactatctccagacacttcttcctgtcctctggggaggggtggaggggtaaaatcacccgaagtcctgagctgctgatttaacccagcctgttttgcagatgacacatcagaggtccggttgtattatgcaatgtttccaggctcagaagtcactatgtcagaatatgaatcgaaaagcacattctctacaaggagggaactttttatca

SEQ ID NO: 21811 - DNA, 1033 bp, Homo sapiens
tggccttgaaaacatcagaaatgtgtccctgaatgccaccagtgcagcctatgtccattacaacatccagagcctgattgaagaatcggaggaactggccagagatgctcacaggactgtgactgagacgagcctggtaggaaacgacgtggcttctttttctgggctctgtgggagatttttctgtaccgggtttgagcagagattcagtggccccaatttctgcctattaacattcttttctggtggaatctgtttctggcttctgtcatcatatgatctgtgttttaattttttaaggtcataaatacttctttatacagactagaaaccagtgtggagatgagaacaatctcacatttccttgcgctaaaaatgatgatgctacttgatacctactggagacatttttctataaccatggtgaaaatctttattgaatggctggtttccttccttatctacttaaaaatgtctttgttttctcttgcctcagccattttaaattgtccctacctggtacctggctgactttcttgctgggaatgtgtctgggggctactctgatggagtcacttcctctgtccccagcaggactccaccctgccctgctctcaccacgcttaagtggttctgttttccagctctcagaatcccttgtttctaacgggaaagcggccgtgcagcgcagctccagatttctaaaagaaggcaacaacctcagcaggaagcttccaggtcagtatgtggctcggacggtgtagacaggcagagtgagcgtgagcgtctcgctgagcagcctctaagaatgttctccttgcatgcagcaacttgaagcttagcatttctgtgtcccatttatattccaatttcctatcatataaattttcctatcgtataaacttcctatcatataaacttcatataatttggcatttttattctagtgatatctgttcctttattgtgcagtcatctctatctttaacctgtccataatcctccactcattgccttagcttggagccttcac

SEQ ID NO: 21812 - DNA, 1048 bp, Homo sapiens
ggctgattccctgcattgcaaccctggattgtaaatgctggcacaaggcccagggccccatcgtctcattcctctgcagaggcccaaatactgtcctagggagctgcgtgcagcagtggtgtgatgagtaatgtttgtgtggctgtgttcacaacctctttgtccaagaacggtgtggtatggtgacaagacctgaggctttgacaccaggtaaatctgggttcaaatcctgcccaagtcatttgctgtctgtgtggccttgggtaaggtattgttatcaagtcatcatcatcatttaacaccagtgaaataatcttcagaatcatcatcattatttaacaccagtgaaataatcttcaaaactcttaaaatatgagcaaaccagatttttcactcagattccaaactctcactcagagagttagaaatctattctgtgtctatacagttatataaagagaaatgaattctttttttacttggtttgactcatagacaaaaaaaaaaatgtgacttactcaggactatacttcactctatactcccaggcagaattatatgcagaatttctatacctttaatacattgtccaaacccaggcatatgtgtatcttccagtttttccccttattttaacagaaaggcacatttaaaatatgaaagcattcctggttgaagtcatgagaaatcatgaaatcatactctttgaaaagaatggaaagaagagggaatttttcagagtgagtggctttttgggcactgcaagaaagttaaccttaaaaagagacaacctaataatgcctgatccccccgcctccccaccacccgccaaggttgaagctggagtctgcatccaacactggggtctgtggggacctcccagctctctttgcaagggtgattgccaaaatgccacatgggacctgaaaaaggcttcatgtccagattggcagctgtgcatggcattggtggtgacaatgacaataacttaagaggctcttaaaccttgaggtcattaaaatctcctggtgagactgttaaaaatgca

SEQ ID NO: 21813 - DNA, 1051 bp, Homo sapiens
gcctggtaagttgtccttttggtttgctgcaagcaagacagtgctcatttgggattattgtgtttgggagaagatgcaattctcattttcaaaaagaattagagaaaaataagcagtaataagatatgagatgtttaaatgtaactgtgacaagaatctttgtaattgccattgttttatgttggcagggtttgtgtgactgctcttctgctaaaatagcttagtaagtaagacttgccagtttgattcatgcactaccaaaacatagttaacgtttactgaaattgactccttttaataagccggaggcagctccagcaactagatagcatttctcttttcatactaacgcagaataatgtacagtagcagataaacatttttaatctcatgaaagcatattagttttctactttttctcttgaaggactaatgatttaccacagtagaaatttttttccagctttttgattgcagtgtcaaaaaagtatatatttcattgataacgtacagtgcaaatggagaacagccttgtaagaatattgcaattgtgtttctcactttgtccatttccttattttgcctgtagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgaggtaacaaactcagtaaagtgtttaccaaatgagagtagtttgaatcagaagtctttcattggggaatagttgtagctaatcacttttagtttgtatgttctgtttgttgctgattttttagctcttcgttttgcataaagtaattgttttcatcacatcctgtcctcgtgacattagtgtcatatgaaatgcctggaaaagtaaatcccacttctgtctatatgaccatttagtagactcaatgttaatgtagctcactgcagtgaaatagtcttactggaaacaaagc

SEQ ID NO: 21814 - DNA, 1038 bp, Homo sapiens
cttcatcatcagtagcgctgtaatgagagcactattttaatcctatccttttggctacatattggcatctatcatccagtagcctcccggccatgcagtgtggcgtccagctcctccctttgtctccgctgggcctggcccgttggtgcacatattaatcctgaatgaattattctagggaaatatggatttgacctcaaaaatctgaagtaactaaaccacttttgctggatttttccagtttagcttaatgctaactatatgaaaaaaaattattagcacaaatttggaaatatttcatgaatgctaaaacttcattgagttaattcacagtacttggaaggtatcctggagcgtgtttgcttttatctcaggatacaatacctctttagccagatgttctacaagtcattttctccttgaaatacctgtaattaattttctaggcccatagtctctactaaggaactctgaagatattaattataaacttatgtaggcacaaaaagacacttaagattcctccttaagtaggtagtttctggactgtcctctggtgctcttgatacctacgtctcttaggagacaggataattcccattatacagagtcacaaagggcctcaattttcaaaaaaaaatttgtcttgtacaatagcatttcaaagtctgacaattaggaatatcagaattttagcattgaacagcttgattttgtattgactattatactttaccaggaaaaattagaatttagagaatttatactttcgacatttttgaagccatgcatgctgtagttctgtccacaatttaatactgtactagggaaactttgtcttctagtttccttttaaaaaaatcattctaagagttttaagtttggacaaactaacaagtttacatttatcagacaaacagttatttgaccagtcattctccgttcatttttgcagctgagaatattaaaatttaattttaacaccaaggtgagctagtgatcaaggaacttcaaggccctgtaattccatcactttag

SEQ ID NO: 21815 - DNA, 1023 bp, Homo sapiens
aaagatgattgcaggttagaggagaaacaaagtttttttgtactataaaatggagctaatacatgcacagtgcttgaaatggggtcttctagctagtaaactccataaatgtgagctgttaaaatcagtgtcctcatggttgtgtaaaggcagtgtgacattgtggttaggacactggttcaggagccagactgtctgggttcagatcccagcctcttatttcatgtgtgaccatgagcaagttttgtcatctgtagaatggaaacaggagtcagggctcatattcagtcagtagacacgagtacaataggaaataattatgtgctgattggtagaatagccttgacctggcccctgaggtgtccctgtgctgggccctctgggtctctgcagctctagagaataaagagggagtgcctggcacagcaaggcgcatctgttccagttgcacagtggggtgcggtgctcggattttgaacatcacccccagtgatggcacctgcttcttaggatggtcctcaggattgaatgaactaatgcatctgaagggcccagaacaatgcctggtacttagtacatgcccagtaaactttagctcttatccctgtttcacagtagttttaaatttgggaatagggagctaaaatacctaggaaatagaggaagagggaaataatgcatatttattttaaaaaggattacgttttcaaataggtttttcattctgttttttgagtttataattttagagccactgagatattgctgctaaagaaatgcttatttgccaagaattgccaagtgttctcaatgagtgacatttaatcaccaccattattaaagccagtcttttattattgtttattctttaatttataaattttcagtatttctggaaaattcttaaaaagttgaaccgtttagtgaattgaaccttttagtttcactacattcttaggatatttgtttttttgtttttatagcaatacgtttggtttaatattggcagtgtggacacctttg

SEQ ID NO: 21816 - DNA, 1034 bp, Homo sapiens
atagcccttgggagcctccctgattggtaagctttgtatttgtattctttctcatagtgcttcacttagtaactgatcagttgccacagtgtattctgcaatgagtcttttattaaaccgtatacatgaagacattgctgagagagctaaaaccttgccgtgcttctgtgtgtgctctttgtttatgaacagaatcaaagccagctgctaccacacgctcttctggaggaggaggtggtggcggtggaaaacgaggtggcaagaaagatgattctcactggtggtccaggtttcagaaggtttgatgctatacattgtgtgaattttgaggttatgatggtggcccagagaaggttgggaggcattagtgtagtgttggagggatttgtgtctcacagagcatagatcgtattgtggaatttcattcttcacagaagctgtctccctctctgcccagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtaagtattttatgggattggtggctgttgtggttcaaaggtgaaattcatcagattagaccaaagaagtgacagtcagcaggttaacctggctcgtccattgtaaaattgttattttcactcagatttttctaatgctgagaagtactgcaactagagaacccgtgttttgacctggtgtcctcaaatttacccacaaattcttttatttcactacctcccagaactgggttttggaaccactgcttctgaccatggtcttggcagtcctctgcttgcgcccttttctcacgtgccctcagctgcccctgctctgtgctgtcgtgtgccagcctctgcccctgctctgtgctatcatgtgccagcgtctgcccctgctttgtgctgttgtgtgccagcctctttgggccctctgtgggtcttt

SEQ ID NO: 21817 - DNA, 1049 bp, Homo sapiens
tatctatctatatctacatatatttatgtagacatctatagacatctcatatggatggattttcgaaaaacaatagggctaggcgcagtggctcacgcctgtaaacccagcactttgggaggcccaggtgggctgataacttgaggtcagcagttggagaccagcctggccaacatggcgaaaccccgtctctactaaaaatacaaaaattagctgggcgtggtagcaggtgcttgtaatcccagctactcaggaggctgaggcaggagaactgcttgaacctgggaggcagaggttgcagtgaactgagatcccgccactgccctccagcctgggtaacagagtgagactccacctggaaaaaaaaaaaaaaaggccgggcgccgtggctcatgcctgtaatcccagcactttgggaggccaaggcgggcggatcacgaggtcaggagatggagaccatcctggctaaactaaaaatacaaaaaagtagtcaggcgtggtggcgggcgcctgtggttccagctactctggaggctgaggcaggagaatggcgtgaacccgggaggcggagcttgcagtgagccgagactgcgcccctgcactccagcctgggcgacagagcgagactccgtctcaaaaaaaaaaaaaaaagaaagaaaagaagacaatatgacacatgcgtatacacagatgcggtaaagtgaacctctggaatatagaccccctcagaaggatgcccaccaaactgatcctcacggctgcctgcagggagggagacacagtggaacaccagtggggaggggaagagcaggcttcaactcatctgtaatgttcaatttctcttccctgctcctagctgtaaggcaagcctgctttaggcatgactccccatgccccaaagcccgtcctgccctgagaagggcatggccagacattcctggcagctgtcagaatcaaaggtgtgtgcagccttgaaccctgcaggaaatctatttgtgatgggctttgttattgatgattttgtcataggtctgcctgaaacctcaatg

SEQ ID NO: 21818 - DNA, 1023 bp, Homo sapiens
tcttgacaccagacttacacagaagtacagtgtcaatcagctggaaatggagatggggactagagccttccccacccaccaccacccacccttcccatccttcagggcctcctgaaggcctcatagagcaatgtgaaatttcttttccattccaagagggagtggcccactgctgagtcagtactcagctggcactgaactcaccagtggagtccacctgcctctgctgccccttgcatgagcctctttgtccactctctgtaatgaagcccacagaacaattgaaggagacaccagaatttccccttgaagaggaagcagtgacacttccaactgtaaactgaacactttattcactcttgatataggaaatgctgtcacgtgtatgtaaatttcacctgttaacttatcaggactcattctagcaatgtttttggtttttgtggggtttttttggtttgtttgttttacattttaataaatgctttctagccaccataatacctactgtatggtaaactctgtatatatacgtgatcttatttaatctccttttccatagaaactctatattcttttaagagataccttccaccattccacaatatcagctgtgctcccctgcagagttttcatttgatgacatccaccagaaacttcttaccacacattgctgtgtttgggggttaacttaaatgtgggtccaaattatcacacagaacagtttactgcttaaataacccttatttagttctgaatttctttgtaatcagttaatatattattgtagatcaaatactcatgaaattagaatgatgttaattatttacattatcaattacaaactcaactgttttatataaaaagaaaaaactccttaattcttttaagaacaaagacactgacttgctttttaattaacaaaatatgagcaatttccatttgattaaatgtccttttccaacatgatgcctgatagctgtgtggtattccacagtaataacctactgtattttatttact

SEQ ID NO: 21819 - DNA, 1091 bp, Homo sapiens
tctgagagccaaattttcatcctgacataaattattgaaggataaatttactctgaaattttaaagatgttgtatgttccctaaaatcatgttttaaaacatggcttttttaaaaatctatatttaagtcaaacatcttattctgtgattctttaaaatgtttgtatttttatcatgctttcattttttacttgttttctaaaaagttactttttccttttattgttcctccatttgaagtcttagtgatataactgaaactaagactcttgcatggttttaatgtatttcagattttcattcactagcttctgcctgccttagagtctgacatgtagccactaagggtcttcattaatccgttcccttttttgtcctctctgtatattcctaacagctgaattattttctttttattgtttgttttctttttttcagcaatgcggccacttagcatgtcttacagttttgacttgtcaggtaaaaaaaacaaaaacacttttacacctgacgtgggttttgtggtttctgtgaaatacatttcattcatctgcttgttcaaacatgttaaaaaagaaaattgaaaggcttctgctaagccgtggtcagtaaaataaaacattctgcttgtttgaaaacaatatatgtaaaaaagatacaagactacagtaaatctgttttctcctaagcaattttggaagaaccatcacaccacactcatggttctagaagatggtgcccatcttaatggcggctgtcactgtccaggctcttctagagcaatgaggttaaagcctacagcagacctttgccctaagagaatagaaaaaaacttcatagaaacaaaattctgacacatctacttcctgttctctaaagcattcagttatttaagtaactaaacttaaaatggttatctacttcagatgacagcacctcagttgatgggcaagaactcttttgtatctttgtgctcagtggatagagcctagtcatgaatgactttgaatgctgattaagagtataaaaatacaggccgggcgcggtggctcacgcctgtaatcccagcactttgggaagctgaggtgggc

SEQ ID NO: 21820 - DNA, 1042 bp, Homo sapiens
tctgcagtgtgtccgtctccaaccacaaaggccctccccactgggcataatccccaccaggacctcaggcttccagaaatcaaaagccaggaaggcaaggttatctttggtgacaacagagtttcaccaaggggccaactttgtgaaatggggtgacaaaaaaattacaaggaaaaataattaacatctcaaattattctaccctctttatatgaagaggatttaaaagaacagaagaaaggatatggcaaacgatattcagtgaggcattgctttggcttcagcagttttggagaatatgggaagtcctggtagatttagtttttggaatggaaaacgaagactgtgctttgttggagaggaagggaagaatggccaatggatatctgaagtcctgtgcatcagtgtctgatgtgctggtttctgaacaatcctaggaaggctgagcctgtgtcacaggaaagatgttttctctttgatgcaaaggtactggtaagagctttggactgcagtgaaaatagataatcctcgctgtcatgaatacctaaaatcatcacatctctgcaataacctttttaacagctttattgagctttacgccatttatataccataaaattcactcatttaaagtatacaatttagtggttattatatgcataaattgtaaaagcagagtgcttcaacaggaaataaataataatttcatttttaagaaatgataggccaggcacagtagctcacgcctgtaatcctagcactttgggaggccgaggcgggcgggtcacaaggtcaggagttcaagaccatcctggccaacatggtgaaaccctgtctctctaaaaatacaaaaattagctgggcctggtggcaggcacctgtaatcccagctactcgggagattgcttgaacctgggaagcagaggttgtagtgagccgagattgcaccactgcagccactgcactccagcctggcaatagagtgagactccatctcaaaaaaaaaaaaaaaagaaagaaaataaatgataattacggtagt

SEQ ID NO: 21821 - DNA, 1031 bp, Homo sapiens
agttcctcttaacctacattatgagttttatgtaagaattaaataggattatggtaaaaaaatactttataaattgtattgcatatacaaagataacgtattatattttaaaaatatagatgatagatgtacagttttaccttatgtttgtttattatgggtttaaagatacccgtaatattatgtcatgaaagcatgttattaccggatattacttaacttatttctaaacttcctttacagttattattttttattttttagtgtatactacaagcacatattgattttgatttataggaaggccatattataagatgtctgtaaacatttttatttatacgactgtctttcagtttgtaagactaaaaatgcccaaagaatccagagaaactgcctttacgaaaacggtctatagtggtaccttaacaggaaaggatctggttttgtgacccccactctgctagttttctcctctgatctcttcttctgcctttttcagactcttggacttcaaagtttctatcctggcttctgttctccctaagcaaccataccctcttccatggtttttgtttctgactaccttccagctcacagtctacattgcagatctgtaaaaatgcagactcatacgtccagctgtctgctagatagagccttatcatatcctacaagcaagacaaacccaatatttccacaagtgaactcatcctgtctctccccaaaccattgcattttgttttcccaatgtagaaaccttaacataatctttgactcttacccgatggccaacccctgttgattttacttcctctggatctttttaatcttctactcttctcagcccagcagccactatcccagccgaggctgtcatctgtcgcagcagcactgattgtcctcctgcttccagtcttgaattcttccaccattccatattgattttccttgtttaatcctgacccttctgttgtgtgaccttcgtgatgacagggcccatgtctgtcttgttcgttgttgtgtcccta

SEQ ID NO: 21822 - DNA, 1017 bp, Homo sapiens
actgggacacctgtttgtgacatgacttcaacttattttctgcttgaatagccttgcaaagaaaaagccccaagacgtctgtctcattcacagattgaagggtattttaatcagctttctcatattccttgcctattcctcacctcatgccaacacctccaataataaaattctggcatttaagttggctggaagtttctttctagacctaaaataggtttatatccctccaagtggtgaacataccactttttgacagaaaatccaccaccagatgtctttttgtaagtgtgccatgtgttcgttttaatgagatcattcatcatttgtaatgtttagggtccttgctgctgtctgtcttttttctgtttgatttgttatttttgttttgagtgttggtaacatgccgagcactggtgtctcatcagggaggagtaaatctctctctgacctcctgtcattgctcttagcgctgctctccctgttaaaatgtttcacaagaatattttactgaaagctcgtggaagaactctgccacctttcagatcctgcagcttttaaaacttaatttatttttaacaaaaaatttcacgtggttcaaaacccaggagttgtaaaaatattacattaaattgtacccttctatttttgtctactactcacactctccctatatatgggcaacaaatattattaatttcttttttatctttgcagagagattttatgtataactaacaagcgcatatcagtattttcttccttttttcacttttaaactttccttttttatttaattatatgtcttagagatcatttcatatcagtaaatagctttcacatctgtaggcctttataatctattttgtgggtatggtgtaatgagtttaactagtcctatattgacagctactaagtaatttccattctttttctattacaaacagtggtgtcatggataatttttaacctatttttcttgagtgtgaacataagtgtaaggtagattcctagaag

SEQ ID NO: 21823 - DNA, 1065 bp, Homo sapiens
ggatgctgtaggccttttaaaaacacagatttaactttttaaaattggtaagctagctgtaacattcaatactgacattactactatattgatgtcagtataggctaaaaataaaattattttcacaatctactggtagaaaatccttgtacagaataaattcgtaatacagtaacattagtcatcagtgaatgaacagtgaaaataattgtgcattgtatagcatgtgttcatgatattgcagcaagaactttataaggcatgtaaaataggtttttaatgtcctaatctctgttctctagattatgtactcaaagtgatgaaaattttctcttcctcttgcactttcttgtgtcattcatacacataaacatcacccaaattaaggtagaatatttcaaacattttgatctttgagagataagatgtctaatacagttaactcatcttggatttcttcagcagtaggctctacaggtgtgggttgtcatttctgattatctgattataatgatctttgcactcttctcaagtgtggctgtacctgcggtgcttagtttcttgacatattaaacgcttcttataagtgttgtcttccttgaccctttcaagtatgattttttcactcacacccttcatacctcagctgaaaggacatctcctcaggccaccccagacacctttatatattcagcacatactgcccttttttttttttttgagacggagtcttgctctgtcgtctaagctggagtgcagtggcgcaatatcagctcactgcaagttccacctcccgggttcacaccattctcctgcttcagcctccagagtagctgggactacaggcgcccgccaccacgtccggctaattttttgtatttttagtagagacggggtttcaccatgttagccaggatggtcttgatctcctgacctcgtggtccgcccgcctcggcctcccaaagtgctgggattacaggcgtgagccactgtgcccagcctgctgttttcattttaatcgcgttgccctattatctcccttttagcagccatcatggtctgtag

SEQ ID NO: 21824 - DNA, 1060 bp, Homo sapiens
gttttggatttcttcatggtttgatcttggtaggttgtatgtgtctaagaatttatccatttcatctgagttttccaatttattgggatgtagttgttcatagtagacactaataatcctttgactttctggggtatcagttcttttttttttttttttttttgaacagagtcttgctctgttgcccaggctggagtgcagtggtgcaatctcagctcattgcaacctccgcctcccaggtttaagcaattctgtgcgtcagcctcccaagtagctaggattacagacacgtgccatcatgcccagctaatttttgtatttttagtagagacggggtttcaccatcttggctaggctggtcttgaactcctgacctcgtgatccacccaccttggcctcccaaagtgctgggattacaggcatgagccaccgcacccagctggtatcagttctaatgtctccttttacgtctttgattttgtttatttaggtcttttgtctttttttcatagtctggctaaaggtttgtcaattttatttgtcttttcaaaaaatcaacttgttgttttgttgattttttgtattgtgttgtttcacttttatttatttctgttctgatctttattctttgcctttactaatttggagttttctagttttctagaaactagttttctagttctttaggatgcatttttaggttgtttatttgaagtttttttagtttgttttgtttgtttgtttgttttaatgtaggtgccagccaggcccttgtccttcccttcagggcagcaagttcccccaggccccggggtaggtctagagatgctgtctggtcactagggactggagtcagaaaccttagaaatctgcctacttttctgcctggtattctgttctactgtggttgagctagcactcaaaccatgggacacagtccttcccactcttccctcgcctcttccacaggcagaggagcctcaccccatggccaccaccacaggcccatggggattactgccaggctactgctgatgttcattgagggcccaaggccttt

SEQ ID NO: 21825 - DNA, 1961 bp, Homo sapiens
tacaagcatgagctacctggcctggcctttttttatttttaattttttcttcttcttcttcttttttggagacggagtctcactctgtcaccaggctggagtgcagtggcacgatcttggctcactgcaaccttcacctcccaggttcaagcgattctcctgtgtcagcctcccgagtagctgggactacaggcatgtgccaccatgcccagctaatttttgtatttttagtagagatgaggtttcaccatgttggccaggatggtctcaatctcttgacctcatgatccgcctgccttggcctcccaaagtgctgggattacaggcttgcgccaccatacccggcctttttcttctttaaatataaagagatcatccgctgttgcccatgctggtctcgaactcctgggcttaagcaatcctcctgcatctgcctctcaaaagtggtgggattacaggtgtgagtcacctgagcctggcccctgtttacacttattatgatttctgatatctttggactaatttctgtcatctttctttgtgccatctgtcatgtttcatccaatatttttgccccctttttcccttgccttctttaaaaatcacatatgtcagtatcaagcatgcattccttcatggaaatattgaattgaattagtaaagcagatatccacctttaggagttgcactcttcagtttgccacagtccccactgggcggttcactgtatatgtctgatctttgtactaagttccatgatggtagagtccagactgtctatttccttccccagtacacccccagcatcaggcatagtacttgtaggtactcagtgaacatttgggtggtaagtgttcaatgaacatttattgaacgaatgaagggatggatgaatgaacagctgatcattggaatcatctagaaagctataaaaaatactgataacctggctcccatgctctggagattttgatttggtaggtctgatatggagcctggatatacatgtgttaagaaactaacaaaaaattcccccagatactctgattatcagagagatttggaataatttgacctcatgttttatggatttttctaccttgagacacacttgcgactcttgctttagttaataattgtggagcaattattaactgtataattatacagtaatctatttatctacttaatatagggccatggttcccctaaagtagggaaacataccacagtttagctttatttttacatattttttaaagttggagatagctggtcattgccatttgggtgacatcagagcagcaatattaaatttttccttttctcaaataataatttctactttttttcatctgctctacaagagacagttttctgagcatgcctctctgccttttcattaaccatataaataattggaaataaccaaaggggattgaagcatagaatgtgtggttgaactacagaccttgggcttttcctgttttctaagatactgattctcttagttgaaatttaccatggtttatagtttatgaaactgactggcatacaaaggactcaattttgattttggtctgctatgttgtacccatgatgttttgtttgaggtaagtcatctgtggagttaggaaattcatttgcctttaaggagcaaactttatgggaatgtgaaccttttagggttgcagacagttgttaatgaaacctatgattgaaaaagtagttcatcaagtttcttgttgtctgtgttctgaaactaagcattttagaacaacagtctctcataatgattttttttttttaaacagtctcattctgatgcccaggctggagtgcagtggtgtgatcttggctcactgcaacctctgcctcctgggttctagcgattctcatgcctcagcctctcgagtagctgggattacaggtgtgtgccaccatgcccggctaatttttgt

SEQ ID NO: 21826 - DNA, 1049 bp, Homo sapiens
atagaacataaaatgtttaaaaattgttgtttcatattggcaaggaaatgaattcttagtaaatttattctgcattatcaaatgaattggtctgctatttaaattccttaatatgttgccctttattgatagttaagtgataatgttagtaattctcacatctgtatggtcttaaatttttaagtagagacagttaataggttatagtttttaatttatattttaagcctctcttaagcaataattaggcatcaactctgatgagggttttgtaaccatagtttaaaccaatttaaaaccatagcatgaagctaaaagcttttatttttattttgtaacacgaagagtaatctacaacaaagacttagggaccagagaacctaacagtaacattagacagtaaaaccacttagctaggtgtggtggcttgcgcctgtagtcccagccactggggaggctgaggtggaagaattgtttgaggccaggagttggaggccatcctgggcaagatagtgagactctgtctctaaaaaagaaaggaaaacaacgactggattaggcttaggagatagaagttaattatctacagctctctatattgtcactaagtgacatggcacacctaggggtgaggatgggttggttgtcacagtcacctaaggagctttttcagatgctttgtcgtctacctaactctgcagttactgccattgtggcgatattgaatgataatcagttatattaagatagagacaggctttgcaagaatattattaactggaactccttaacctgaaaagccagtagtgacacagagaacagggagtctgcagaccagggctgtagtttaccacgggtgagctgtgtgaattcaagcaggtcacttagcctctcttcaccttcaccttccttcgcttcctttttataaaacaaaggaattggattagatgatctgtaaactcacatttataaatcttctcatttttctgatgcacatacaaaaagaatcttgctcttcaaagaagaaatgaaaaatgtgattataactt

SEQ ID NO: 21827 - DNA, 1070 bp, Homo sapiens
accttatggaacctcagtttctttgtaaacagagggtattagcacctgttccttgggttgttgttgtaaggattagagaataagtagaacaaaagttcctggaatggtggatactattgatattattattgccatcaccttaatgtaaagctttattacaaaggaactcagttaccagaggataatacctgtattttcatatgcaaaggctggagtagagattggagttaactttttagagagcaattgggtaacacatatcacacatctaagagcatgggtttgatctagtaattttacttctgggaccttttccaaagaaaataactaagaatatgtgggaaaatgaagcaagaagatacttgtttgcagtactgtttgtaagagaggaaaggtggaatctacctaaatgtctaactattgtgcaacaaaagactttaccttactagaaacaaacggatagaatgtaattgattatgtggaataatggttcattgtagtataaaataggttacaaaatagtaggtactgaatgatccaattgtattaaaagtgcaaagaatatgatctgaagaacaaaaataagtgattgtattaacaattaatagtgatagcctcagacaaaattaaaaaaaaatttttggggtacatagtaggtggatatatttatggagtaggtgagatttttttttttttttttgagatggagtctcgctctgtcacccaggctggagtgcagtggcgcgatctcggctcactgcaagctccgccacccgagttcacgtcattcccctgcctcagcctcctgagtagctgggactacaggcaccggccatgatgcctggctaattttttgtatttttttagtagagacggggtttcaccgtgttagccaggatggtctcgatctcctgaccttgtgatctgcccgcctcagcctcccaaagtgctgggattacaggcatgagccaccacgcccggccgtaggtgagatattttgatacaggcatgcaatgtgataatcacattagggtatgggggtagccgtcacctcaacacatttctttgtg

SEQ ID NO: 21828 - DNA, 1056 bp, Homo sapiens
acctacagaatgggagaaaatttttgcaatctacccatctgacaaagggctaatatccagaatctacaaagaactcaaacaaatttacaagaaaaaaacaaccccatcaaaaagtgggcaaaggatatgaacagacacttctcaaaagaagacatttatgcagccaacagacacattagaaaatgctcatcatcactggtcatcagagaaatgcaaatcaaaaccacaatgagataccatctcataccagttagaatggcagttgttaaaaattcaggaaacaacagatgctggagatgatgtggagaaataggaacgcttttacactgtttttggaagtgtaaattagttcaaccattatggaagacagtgtggcgattcaaggatcgagaactagaaataccatttgacctagtgatcccattactgggtatatacctaaaggattataaatcatgctactataaagacacatgcacacatatgtttactgtggcactattcacaatagcaggcttggaaccaacccaaatgtccatcgatgatagactggattaagaaaacgtggcacatacacaccatggaatactatgcagccataaaaaaggatgagttcatgtcctttgcagggacatagatgaagctggaaaccatcattttgagcaaactattgcaaggacggaaaaccaaacaccacatgttctcactcataggtgggaattgaacaatgagaacacttggacacagggtggggaacatcacacactggagcctgttgtggggtgggggagggaggagggatagcattaggagaaatacctaatgtaaatgggtgcaacaaaccaacatggcacatgtatacctctgtaataaacctgcacattgtgcgcatgtaccctagaacttaaagtataataacaaaaaaattttacaattagaagagtgtttctctgtccacctctgaagcaaaagaatatttagtttgaattaagaggcattaattactctcagtcaaaaaattttgttttgtttatgtaaataacaaaagagttcaga

SEQ ID NO: 21829 - DNA, 1082 bp, Homo sapiens
tttatgttcaaacattatgttgataatatttttagcagtattacacagtggaggtccaaattggattagacttttgcattgaattccaaagtattggtaagtctagcacatagtataaagtcttgctaaattcttgtgggtacattatttttaaaacctgtctgtctgtcggtatcacacagaggtcacttcttgagtaaaataagatgaccttaagaattcacataattcttgaagaagaatataagtcacgatgcttccacatgaggccgcgtcacaccaccatcgtttggaaatccagcaccccagccgttttaccctaagataacagtgcagcacttagtgtggttgaatgtgtcatgtgggaatgatttttggtcaccttttcagttcattgttagtccttttatgtttgtgtgcatctatgttcgtctgtgtgtttggtaaatatgaattgaatagatgacttcttattttatgttttaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaatagtcttttgttggtttgtgtgcattatcttaggacagctctgcttcaaataatgaatattttcctgtgagtttataatttctgtaacaagcaattgacatactgccgaggcgggtggatcacttgagatgaggagttcgagaccagcctggccaacatggtgaaactccatctctactaaaaatacaaaaaaattagccaggcctggtagtaggcacctgtaatcccagctac

SEQ ID NO: 21830 - DNA, 2080 bp, Homo sapiens
aatgtttcttttattttcaggagtttttaattcatatctagttcatttccactcatatctatttctgctaatagattgacagcaacctttggtttaatgctgtgttctctagctacaccaacaagttatatattcctttccaatattaaccaagtatttattttatgttagcctatgactgagttttatctatgcttgcacatatatagaatgtaaaaatataattctccatgtttaatgtatccatataaaaatgaaaatacccattttctgcattcttaaagggttaagaaaagtaacatgtaataagcacatggaggactttagaccatttcttgtgttagaggagactttatacatttgtgaggttttctgtcttttggtccttttatgttcttagtccatttcattattgttttaatatttctaccaaggaatgaccaagaaaagagaaaggaagaaaaaaaatgtgttaatcattttcttttaatggtatgtcagcagaaggggttctgactgtaagctaatgtgcacttgtgcctgtcctctttgtcttaaactaaagttggtggtatgaatcgaaaaatgtgtattggtttaaaaagcagtttatgatatgaaacagtcttccagtttttatatcaactcctttgctttcaacagtcagttcaaagcaccatttattgatggtttactgtatgccagacactgtattttttctttacgtattaccctacttaatcctcaacacaattttatgaagtagttattgttagcctgaaactggcatttctccatccttttatggtgctgtctttgaaaagtctcagatgtgtaacatgtcctagaagtagataattatcaaaggaagactgcaactgcaactcacttccctctgagaaaaaatatccctgactagattacatatctagttccagaccagaacctggtggtattaaaagtgttttggttgactattgtataccataatgagtacctacattcccaaattgcctgcctggttgttgtacagacttaaaaatctagcctgccttgatttttacttttcagatacacatgtttaaagagatctttgctggtcacagtagctcacacctgtattcccagaactttgggaggccaaggtgggaggattgcttgagcccaggagtttgttcaagatcagcctgggtctctacttaaaaaaaaaagaaaaatttagctgggtatgttggcacgtgcctgtagtcccagctactcaagaggctgaggcaggaggatcacataagcacagaagtttgaggctgcagtgaactatgatggagccattgcactccagcctgggcagtagaggagacttgtctctctctgtatatttgtctctctctccctctctctctctgtctctcataatacatatatacatacatatatatatacacacacacacacacacatacagagagatatataaaatagatataaaaataaagatattttaaagattatttataaatatatgttttttaaaaatgtagtctattataagccaaatgtcattaggcatgtagtccatttctttctgtgttcaggcaggagttccagttctataaacattggtttatctgtttttctagcaggtgcacacatgggttctcagtgatgtgtagccggggcatagattgctctcagtctgttgcaccctgcaggggagatgtctgaggtcctccctcgcctggctgtgctggacgcacagtgcatagcagaactaactgcacagcagaaatgcctgttctgcgttcccattgatacaccaacagctaatgaagtctcttttacttttaagaaacccttatttggctttggcatatttacatggtagaggcctagaattttataaataaaattttgaagaatagaaatgtattttttcacgatttaaaaaccacctgtatggtttactctggagttgacctgttccactcatccttctccccagttcatttgtttcgtttcaattccactttcccttatagctatcttcaaagcagtgtctatgggacagcattgccaagagccc

SEQ ID NO: 21831 - DNA, 1082 bp, Homo sapiens
ggagtcttgctctgtcacccagactggagtgcagtggaatgatcttggctcactgcaacctccacctcctgggttcaagcgattctcctgcctcactctcacaagtagctgggattacaggcgcccgccatcgcgcctagctagtttttgtatttttagtagagacagggtttcaccatattagccaggttggtctcgaactcctgatctcaggtgatcctcccgcctcagcctcccaaattgttgggattacaggcgtgagtcaccgcgcccggctataaaatttcaatcttactaaaatacattaagcgtagaatatagtagtgacttcttagttttgggtacttgaaaaaatatagcatgtatatatctggtttgttttcattttttaactttatggtttcatgatgtctataaactaaaaaaaaatcatatacatatttctaaatttaggttaaatgtgcacagtactggccaacagatgaccaagagatgctgtttaaagaaacaggattcagtgtgaagctcttgtcagaagatgtgaagtcgtattatacagtacatctactacaattagaaaatatcaatgtaagacctttcttgcccgaaattgtggactttatatgatggtttaaagaattattctttattattagatttgaagtttgataagcacatgcatttggataattcctatagtatctagccataatcacgtgtttttagattgtgtgtctgcatctagtagctttctgaggactctgaagaaacagtagaaactaagaatttcaaagttcagtttgatatttggggattaaaaattaattaatagaaatacatgaggattaatagagagggctttagaatcaggcaaacctggattcagatccagctctgctgcttagtagagctgtactttagacttgttccccaccctcactgatcccttcctcatctgtaaaatggaggttaccacgccttccctccggggctgtcctgaaggtcaaatgaggatgtgtatgcagagcacctgaccttagtaaatgcccagcaagcaatagctcccaggacctgtgactgcc

SEQ ID NO: 21832 - DNA, 1074 bp, Homo sapiens
cagacgggtgtcacaaatgaatcccctcttgcaagccccctcaaatcaaaatagcctttccttgccctgagaaagtgccctcatcccctccccgggggcacggtgttccgatgcctatcgccctaatcgtgcctgttcagctcacatagatgcaatatgtagtataaacacctgtgattcgctttttttatgtcaactagactaccttttaattcaaacaaaactttatctcttttaaaatgatgtaactgctttccccttcgtttaatccttgtcgtattattcccaagattgaatttggtgacggttaagttaatgctgcttctgatgtttggttctctctgtgtaaagtaaaagacgggctttcctgtaaatggatgatcctgggtttttcccctttccatttaattagatggcagtgaaaaatgtgttcagaaagtaacgttttcttcttgaacacattagtgggaagtataaatattctgattcccatgatacagagtatgttagaatagggatctaagttttaaagaatgctggtaaggactcttccaattatagacaatctgaaacgcaaattctggtaggaatcttcatgtgagagagcctgccagctgcatcttctccagttacatttgttttagcagaggctgctgtctctctaagggataggttatatatcgaaatagatttgaaaagagaaaagtgaatataacttaattcagcttaacattttggtttaagaaatttaattttctttggtatcattaatatccttgaaaattcaatgagaattgtgattcctctttccagaaaaatgaacttaactcgcatccactggagatttcacatgcattttcaaaaagataaggaaatccttctatagattcttaccgaggaatcctgtagtttccttggttggtcaatgctcatattattttttcctagttgaaaacaagaccattagtttggtcagtagaaaccatggcatgcacactggtgttacagtaaaagtaggtcacaaaccaagaaagttagtaatggaaagcaagtcaggaagtttgagctatgtgt

SEQ ID NO: 21833 - DNA, 1025 bp, Homo sapiens
cccagctactcaggaggctgaggcaggagaatcgcttgaacccaggaggcggaggttgcagtgagccgagattgcaccactgcactccaacctgagtgacagagtgagactgtctcaaaaaaaaaaaaaagaaaggaaagaaaaggggagcttaaggcttcaaattcccgattgaagctccacataagtgacctgaaaagtttctgtgtctgccctaaagaaacccgtatctcttgtagctacagagctgaggttggtgaaaaccaaatccagagtcttatcctgtaggtggctgaattacagtgctaactgaattcccttctcaccttggtctgctattaaaatgagggcattgattgggaaggaatgggatctgcacatttggaatagggccatatgggaacatcctgatgaagctggggatgttaaactcctaaatttgactcactcttttttgccagtagaagcagttcttccacctctgaggaggttaactctgctttgcctgaagaacctgtaatgacctcccttgaggtagttaccttgcaagacattgccggttttcctcaggaatccgtgaagagctctggggttgcttttctcttcaggtcagagattgcagtgggagctgttgccactgactgggggtccttagctgcagcagggatggttggatctaggatggcaggggctatgtgatcaccaaagagtaagtaggtgtgttgccatcatgggggacagcggagtcaaagcaacaatctgaacagcctgacttgggggtcctaattgggtaggtggtcatggtgtccctagaagagaactcgttgggcagtctactgaattctgacttgatctctataagcagaagagttctaggtcaagtgaatggaagctttactttaattaccaaagaaagagtcatggtccctcaatcagttcccagatttgagtcattttacagactcagaaccccctgactgaggggaggctggatccttttgaggaaggaccccattgcgctgcta

SEQ ID NO: 21834 - DNA, 1048 bp, Homo sapiens
tcatttctgcattccataaatttcatttggcatctgtggaattaaggcatcttcattgtatttggatctctgaatcataagtgatatttgcctataaattaagcaatgatatttaaataagagattaccacaatcatattttataaatatacaaccatttttaaaaacctgacaaaatctacaaaaaaaagaaaatgaaatatatgtggagttttagaaaagactgactaggtccaaggttgaggcacatagtggttaagcacattgtcagctccggactctgcctcttacaaggaaggagggggctttagatgttatttagctgttatttagcctttctacacctaagttcccctcacctgtaaaaaaaaaaataataataaattgcttactttgtagaatcattgtaaatgttctatgtaaaatatgaatatagtactcacagtaaatatgtgtgtgtgtggtgtgtggtgtgtggtgtgtagttcagcaatagaaaatggaatttaataagaacgttatgagttgaaaacaatggtctgtggacaatattgaatttcagttgccaaaataaaatagacctcatgtttcccttcaggatcctctaactctgaatatgaatagaagtatcagtcactggaaaagaacaaatgtcctctagggatgtggcaataggaataatcttatctcagaccataattgggttcctgatgaaaatattttttctttagcattgtatttctctttatttcaccaaatgcacattaaggtctacagatctgattctcaaacacctggctgtagccacctcctttgtgatactttataaaggagccccacagagaatgcctgcttttgggttgaaacattttctcaatcataattaggtacaaacttgttttctatgttcacaaagtgggcagggctgtgtgcattggcaccacttgccttttgaatatcttctaggccatcacagtcagccccatgtactcctgctgggcagacctgaaactacaagctcccaaatagaatgggtgctccaacatcc

SEQ ID NO: 21835 - DNA, 1043 bp, Homo sapiens
gagctcacaccttactcaacatcagagaattcatactggagagaaacctttcaaatgtaaagaatgtggcaaagcttttaacagacgctcaacccttactcaacatcaaataattcataccaggtagaaaccctgcaagtgtaaagaatgtgctaaaaccctaaactggtgctcacaccttactcaacattagaaaatcaatactggatagaaatcccatatgtgtaatgatttttgaaacatcaaaatgaagattaaataaaaattagaagtgtcactttagaaagaactaaggtgctagcacttccgtaaattactctgaatcagtgtgtttattataacaaataattcaaactcaattagataattaaattgtatgtttaaaaagagggacgacattgatggagaggcataattatattcaatgttcacttatttttgtaatcacagtattcatgattgagaaagtattattgatgtaattaaattcaaattaaccttttttttccccactgtggttgattattgctgtctctgacatgagagtcccttctacgttaggtaggcatcattcacatgtctcattcacatgtcatcattcacatgtctcatgacgtcattcacaagtttcccatggaagactaagagcattggcatataggatgtatgatgaaatctaaatggagttgctctttttgtttgacttacaacactgaatataagtcatatatgagttaggtgttcagaatattattgttctgcattaaagtgtgagacagaaacactctgagttttagatatgaatagttttaccaactacccattaaaaggtcttgctagtccattaatattctaatgtatcttcatagcagcaagttagaagtcctgaatgttactgtgataacaataaagaaatcacaaatatcagagagtggtgcaaataacttctctctggtagaacatagattattaattcaatcctctaaatacttaggctcagtttaagaaaagagagaacacatttttttaacataggtcatggt

SEQ ID NO: 21836 - DNA, 1146 bp, Homo sapiens
tgataaccagattatgtaaggcacacaaacaactctataggataaaatttaataatctgattaaaaatgagcaaaaaatgtgaatagacatttctctaaagagggcatacgaataacagtgcatgtgacaaggtgctcaacatgtggtcatcagagaaatgcaaatcaaaatgacagtgagatgttatctcatcccagttacaatggctgttctccaaaagtcaggcaataacaaatgctggtgagtatgtggagaaaagggaactctagtactctcttggtggggatgtaaattattacagctactatggagaacagtttagagttcctcaaaaaaaaaaaaaaatagagctactatactacctagcaaccccaatcctaggtatgtacacaagggaaatcaggacatcagagagagatttgcacctccatttttattgtagctgtgaacacaaaatatctgagacaggtctcatccaatttaagtagtttattttaccaaagtgaaggatgcacacctatgacacagcctcaagaggtcagggcacagcttggttttatacattttagggagacatgagacttcagtatgtgtaagttgtacgttggttcagtctggaaaggtgggacaactcaaagcagggagggagtttccaggtcatgggtaggtgggagacaaacggttgcattcttttgagtttctgactagcctttccaaaggaggcaatcaggtatgcatttatctcagtgagcagagggatgactgaatagaatgggaggcagatttgccctaagcggttcccagcttgacttgtccctttagcttagtgatttgggggttcaaagatttattttcctttcacacagcattgtttacattagccaagatttggaagtaaccaaagtgtctatcaaaaacagatgaatggataaagccaatgtacatatacacaaaggagtacttttcacttataaataataagatcctgttgttggcaacaacatggatggaactggaggtcatatgttaagaaaaataagccagccacataaaggcaaaattttttcttgcaagacctttggctcttctgagtcttttttggttctgtccactttataggattgtttttcctatttctgtgaaga

SEQ ID NO: 21837 - DNA, 1071 bp, Homo sapiens
cttttcctcttttagggccaccgttttcgcaaaagtgtgttttatattttttttctccaaaaatactctcgctcagcattcagtggagattggtgtagactttctgtcagccacatgccttttgagatactgagaatacaaagctattactgtctaatatgaaagtctagccgctagattttcaagcctagctgctaggctttcatattatacagtaaataattattgaaaatctgtgtctttgggttacattgggtttccatcttttggactctgctcctatgtgagttgtgtttatgtatgtattatatacatgcagttgtctatctgcgttcctccttgtttgtcagtttgttgttcttgctttcccttcttacctgatggttcatttccaccagcccctttcttgtgcttaattggccataatatctagtatgcagtactgaattattacttattaaatatagtactatgatatgtagcactgaattattattaaatttttcatgcccccctctttttttatttactgtacaagacattttcttccctatgactgcttttctctgtaaaaatttaccaaaaatatggtatcaattttattttttcattttggatagatccacaattaatattctccaaaaagtgatcatcagtagaaaagggttctcactacttttgcatagcgtcattttataaggagcaagatagaaccggtgtggcctgaccaagttaattagtaaaataatgaataatgaagtatgtttttaaaaaataaagattgttttagtaaacttttttatattagcaactttaacaaactaagaaaaaatgaagtctagtataagtaggagcgtttgttcacttgtttttcttttcatctgaagacagtatagaggaaatgaaggacagatgcgggagctacaagatcagcttgaagctgagcaatatttctcggtaagtgagaatcatttttaacatacacactgtttcaaaacctgacttaaaacaaggtatttagattcttttatgtgaactgtaattctttttcaaatgactcttcatcttcta

SEQ ID NO: 21838 - DNA, 1026 bp, Homo sapiens
atgcctgtaatactagccactccagaggctaaggctggaggatagcttgagcccaggagttcaaggctgcagtgagctgagaaggtgccactgcactccagcctgggtgacagagtgagacctcatctctttaaaaaaaaaagaaaagaaaaaaaaagatggtatcagaaatttttaaataaactgaaaatttgtcttattcatttccgatcttagcaatgaactgtcctgaacataaccaccagcacagccttgttctgccctccgccatgattaatgattcaaatgggaagggagggggtaaagaaaagattatcttttgcttttaattatatgtgtttattgtgatttttaaaataaggcatcatatctcttccagaatattaaatgtaagatttactaacatgcatgccttctgcacagtttattacatgactcctactcccattttacaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtggtaagtgtcagttttaatatttttacaaaattgactttaaatagtgactagaaaaaatttggttttggtcaaaattttgtactctttaactcgtagaaagtataatataaattataggcctggcacagtggctcatgcctgtaatcccatcactttgggaggctgaagccaatgggtcacttgaggccgggagtttgagaccagcctggccaatgtggtgaaaccccgtctctactaaaaataaaaaaattagccaggtgtgtgtcgcacgcctgtaatcccagctactggggaggctgaggcaggagaatcgcttgaacccaggaggcagaggttgcagtgagccgagatggtgtcactgttctccagcctgggcaacagagtgagactgtgtctcagagaaagaaattataaattata

SEQ ID NO: 21839 - DNA, 1035 bp, Homo sapiens
tagttccttatagtattaagttaggttatttttattgattttaaaagctttttttctttttaaaatgtaagcatttatagctataaatttcctcctttgcactgatttttcagcatcctactaggtttggtacattgtattttcattttcatttgtctcaaagtattttctaatttcccaatgattttttctttgacccatagttttaagagttcattgtctaatttccacgtttgtaattttccagttttcccctattattgtttagtagtttcattccattgtgattggaaaagatactttgtgtcattttggtcttttaaaagttattaaaacttgttttgtggcataacataataagtctattcttgagaatgttccatgtgtacttgagaaaaatgtgtattttgttactggatagagtgctctctctctctttataatctgttaggtccagttggtttatagtgtcgttcatgtcctctgtttttttattaatcttctgtctggttctattcattactgaaaatggattattgaaatctccaactatttgtagaactatgtatttctttcttaaattctttcaatgtttgcttcacatatcatggggcttgtatatttatataccaaatgtacatatttgacgcatataaatttatgataatatatttttggtgaattaactcttttatcaatatgtaatgtcttttttgtctgttaaccatttttttaacttaaggtctgttttgtctgatattagcctacccacctcagtgctttttttatttactatttgcatggagtattttttcccatctttcacttttaaccatttgtctttggacttgaagtgagttccttatgggcagcatatagttggatcatggtgtttttgtttgttttttaaaatccattttgtcagtctctgtagtttgattggagagtttagtccatttatacttaaagtgttagtttttagctccagaatttgtttggtttcttaatatagtttctttctctttgttgacattc

SEQ ID NO: 21840 - DNA, 1125 bp, Homo sapiens
gataacgtgaatagagggtggagacatgactggctatgacatgtttggggaaacaaggaagataaggttggaaggaaatattagcgttagattgtggaggatttgattggtaggctaaggattttggattgcctttacactgttgtggctattaaatatttataaataagaccgtgctaggatgaatgaagaagatgaatctggtgtgtggaagatgggttagcatgggaaaagattggagagacagtgagattggacagttttttaaaattgttattattgtaatagtccagaaatgattgaagcccaaaattggggcatgagaatgagaaaagaagaattaatggaactttattggcagggaaaagatggggaaccaaagagagaggcaatagtcagatgactctaaagaggttgagcctggattatagggagaatggtaaaaatagcaaagtcaggtttggaaattgcttgtgaagaataggcctacagataaattcaattttagattcgttgtgtttgaggggatagtggagcaatcatgagaaaatgacctgtagactgttggagatacagaactgagctcataattacagataatgatttagaagtcatttgcacaaaggtgcaagttgatataatggtaaagggagaaacaatggagggaaaaatgagggtgaaagatgaaggttgaacaaagaggaagagtggaggaggtaagccatcaaggcctccagagttaggacagccaggtatcatggagcccaacacttctaaaacaacattttgttaaagagaatagtcaacagacagatttggttgttttttccccttcaaatcttataatcttgtcctctttttctgtttagttccacagctgtttattgatagctgttactgaaattttattaccccgtcaatctgaacttggtaaagactgaattttcctttttttttttctgagatggaatctcactctgttgcccaggctggagtgcagtggcgcgatcttggctcactgcaacctccgactcctgggttcgagtgattctcctgcctcagcccccacgagtagttgggattacacgcgtgcactaccacgcctggctaatttttgtagtttta

SEQ ID NO: 21841 - DNA, 1048 bp, Homo sapiens
caaaaaaaattagccaggcgtgatggtgtgcacctgtaatcccagctactcaggagacggaggcaggagaatcgcttgaaccctggaggtggaggttgcactgagccgaggttgcactgagccgagattgcaccattgcactccagccagggtgacaagagtgaaactccatctcaaaaaaaaaaaaaagacagtgcatgaatttaaatttttggttctatctggcttctgtgaacagatgataactgcaaaaattacggagaagtaagtaagatagttgggagttaaaacagtggaatggctaaatgcatgagccagtctgcttgggttcaaatactggttcctccatttagtagccatggaacaatgaacagtctccttcatttcactatacctcagtttcctcatctgtagagataacaatagtacttgtttcataggatgttttctgaattaaataacttagtattcagtaaatgttagctgttgttaagtattgagattgtgttaatacgtagagccctggactctaggataggggaattggaatatctgggtcagacatgtaaattacatacatcttttacagtacttacataaatactgtaaaagatgttattagatctcgtgggtgtgggtttgttttgttttttttgagatggggtctctgtcacttaggctgtaatgcagtggcacaaatcagatcactgcaaccttgaactcctggggtcacgtgatcttcccacctcagccttttgaatagctgggactacaggcgtgcgccatcacacctggctaattatttttattttttgtagtgacagggtgttaccatgttgtccaggctggtctcgaactcctggcctcaagtgatcctcccacctcagcctcccaaaatgctgggttataggcacgagcttctatgcctggcctttatatctgatggtttttaaggttccttctacttctaaaattctataattcattacccaatctacagtgtagattactgaaacataaaaatgggaatgtaaaatgtttacactgt

SEQ ID NO: 21842 - DNA, 1039 bp, Homo sapiens
tgggacaacaaagttgttattctcaaaagttggtaaaattttttaagaagatataattcatactacaataacagcatcttcatactacatagttctagcaactttgagacactctcaaaaagtttgagaagttttaactggagattaacaataacaaacaccttgtattagttttagcaacccaaagttgttctgtttccagaaggacatcaaagtgagtgtagttgcaatctgtcaaataaaagattggtatctactatgtatgttttcaacacctctttaatcttggttgtccaacctataatgtgactgacttccagcctttttaggacattgccagagtcagggagcttgttttcttaacaaacatgccagaaaactataaagaaaaaataactttttggagggggtgggagataactttaatacattaagcaaattaaatcaaaggacaaaaatataacagtagacacaagacaattttgaatcattaacaaaatgtgaggtagactagtgaaattcaccaaattttggttaagaacattttacagtaataacacgggtgccccattttctaaaaatcacaaaaagcaattgcataaattacagccaaaaaaaattataacaattgtcttctagtttttcgtttacattcagtattaacctgtgtgaactgtcatacatgctgaggttcagcaggtctacaggtgagttactgtgtgggcctagcgaatccattcatcccacatcagtgtcctaagggattgcaaagcttaaagctgaacacactaggatatatatatatatacacacaaatcatggtgtcctgtgcttgtgcaattttatccttaaagaaggacctaacatactcaagaattatactgatgataagatgattttaaaagatccaaacattagtaagataggctttgaaaagaataggcagatcaatttctccattataggggtgatggtcttttggctttattctggcatatctcttccagagttaaatagtatttaagagctcataataata

SEQ ID NO: 21843 - DNA, 1035 bp, Homo sapiens
tctttatttgtattaattacaaattttgcatgaggttatcagtgtattggatctgtaagtactttttatgagaatgtaatgtgaggaggaagaaagcactataggctaaacactattaatattaagctgtttcgacttacttatttgtaactatgatgttaggccaaaataacctgcctatttcaagttgtgcttcattttgaagaattttaaatataaccaaagaaatgtggaaagttccttgggagttcagcttttagagaaatttatcttaattcaagaatattatttgtaaactatcaaaatctcttattagtttttcttttatcacttgactgtcagagatatcaaagggacactcagaaaaattgttttgttttttgtcctataaagtacctctgataaagattaatgaaggaggttaaaattaattattcaaaagaggtttttaggtcagccaatttttttttttttttttttttttgagatggagtctcattctgttgttccgggctggagtgcagtggcgtgatctctgctcactgcaacctctgcctcccaggttcaaacgattctcccacctcagcctcccaagtagttgggattacaggcacccaccacctctcgaactcctggtctcaagtgatccactcgcctctgcctcccaaagtgctgggattacaggcgtgagccactgcatctggccaatttttctattttttgtagagatggggttttgccatgttccccaggctggtctcgaactcctgggctcaagcagttcaccaccctggcctcccaaagtgctgggattacaggtgtgagccatcgcgtctggccctaggtctttaatgtcttactgcagtgtttaatagttttcagtgtacaagtcttaatgcttcttttgttacatttattcccaagtattttttttcttttttggagacagcatctcactttgtcacccaggctggagtgcagtggtgcaaacacagctcacttcatcctcaacatcctgggctcaggaaatcctcc

SEQ ID NO: 21844 - DNA, 1048 bp, Homo sapiens
ctttgcttatattattttgccttttcttgtaggttcctgcttcagtttgatagctgtttttttgagaattaagaaatatattaaatatacatattggtagactgattttggattcagaaacattgaagtataataaataaagcttattttagaatcaaggaaaatttcctttcaagcatatactttattgcaccttgtattaaagacatttgtatactatatgtttctcctattagatttataagattcttgaggtcagtgtggcatagtagaaaagaaagtgagcttaactatagagatgtggtttcctaatgagccactttctagttgtatgaccctagcaaattaactctttttctctttagtttttttttttttttcaaatctgtaagcaatgacagtaatctcttatgtgataattttttcgtaggcttatttatttcttaaacatttattaactgtcgaccttgtttttaaaaattattataaagatcttttatgtaagttcacagatcagtgcgagggacgatggataaacatttaaatagtgtggaaaatgctacagtagtattttaggatatacagggtattatatagagcatagagcaaggacatatgacaaagattggaaaagtcgggttagcacttaataaattcagaaaggataagtaggagtcccttgagctcagaagggtatagagcaaaggcatatcaggccaagagagcagtatgtgaaaggccaggcaaataaaagtattccattatgacttgtgactgtgttgtattggaaaagctgcaagagataaggctgaaagaggtaaatgggggaccggatcatgaatgaccttgtaaggcaggaaggcattgaaggtttaaaaacctaaaccagccaggcacggtggctcacacctttaatcccagcactttgggaggccagggcgggaggatcacttgagctcaggagtttgagaccagcctggggaacatggcaaaaccctgtctctacaaaaaatagaaaaatcacctgggtgttgggctgcatgcctgt

SEQ ID NO: 21845 - DNA, 1049 bp, Homo sapiens
ttctatacattttcagtgtcttttaaaaaaacatgctttttgttttctttttttttttttttttgagacagagttttgctcttgcagcccaggctggagtgcagtggcgtgatctcggctcactgcaagctctacctcccgggttcatgccattctcctgcctcagcctcccaagtagctgggactacaggctcctgccaccatgcccggctaattttttgtatttttagtagaggcggggtttcaccatgttagccaggatggtcttgatttcctgacctcgtgatccgcccatctcggcctccgaaagtactgggattacaggcgtgagccaccacgcccggccaacacgtgctttttcatttattgggtgttttcttattacaacagttacagtgatcttttgtgacctcctttatcctaaatgggagcagaactcccagagatgtacattgtgataacatttttcagtaatagacttgttggctttgtttaattttggctgtagaggtggagtggaatttggaccatgagtcttttaaagtcataagcaataccgatgaactcaatgtgtttgctaagtccaaatgacctttgagatgagatttacatcaaataaagtatttcttacatactgggatattgttgctacctattgaaaagtgcttaaaatgtgaatcctaataaagagatttttaggattctttaatatttgaagacagaagagaaaaaagtatcataattcttcccatttgactttttattgggtctgacccaggcatatcttatgagaaatattcatatagtcgtaaggtttagatgttatagtagaagttcacttaatcaacgtaattgggaaaattggatcagttaactaaataataactgaatatctaaaaagttgatgactgttggttattaactgacccagttctcccaattacgttaagttgatgagactcttcttgttctctgttgcaggcttgcttgttcactcatgcttccagacataatcaacatcttagggttaaaaatggctactggtctct

SEQ ID NO: 21846 - DNA, 1029 bp, Homo sapiens
tccgcctcccgggttcaagtgatttctcctgccttagcctcgtgagtaactgggaccgccaccacacccagctaagtgcaatggcatgatctcgatcactgcaacctctgcctcttgggttcaagtgattctcttgcctctgcctcccaagtagctgggattacaggtgcctgccaccacacccagctaatttttgttttttagtagagacggggtttcaccatcttggtgaggctggcctggaactcctgacctcaggtgatcggcctgcttgggcctcccaaagtgctgggattacaggcgtgagccaccatgcccggcctcacgcccagctaatttttttgtatttttggtagagacagggtttcactgtgttggccaggatggtcttgatcccttgacctcatgatccacccgcctcagcctcccaaaagttctgggattacaggcgtgagccaccacgccccgcctgaagtattttcttttgttatttactaattgagtatctgctttggcaaggttctgaattagaggctattaggaataaaaaggtaaatataatatggttgttgcttttaagctttataggtaagtcagacacaaataactgattgaaaataaaaagtgataagcacacgaaagagatttagacaaagtagatgaagaacagctagagaagattgggaaaggctttatggaagaggagcaatgagtggaatttatatagggggaaaggtattctggatcagcactatccagtaggaatataagtgagccacatatgtgatttaaaattacctggtagccacattaatggagtaaagagaaatagataaaattaattttaatatcttttatttaacctgtctttttttttttttttgagatggagtctagctttgtcacctaggctggagtgcagtggcactatcctggctcactgcaacctccgcctcccaggtttaagtgattctcctgcctcagcctcccgagtagctgggattacaggtgcttgccatcacgcccagc

SEQ ID NO: 21847 - DNA, 1122 bp, Homo sapiens
tttgaaatttactgttgtgttttgttcaactagtgtttgaaagtttgttgttatcacaagacactggattaaatttttcttcaaaaatagataattttcagaagataaatttagtctttttttttttgagatggagtctcgctcagttgcacaggctggagttcagtggtgcgatctcagctcactgcaagctccgcctcctgggttcacaccattctcctgcctcagcctcccgagtagctgggactacaggcgcccaccaccacgcctggctaatttttgtatttttagtagagatggggtttcgccatgttggccaggctggtctcgaactcctgacctcaagtgatctattaggcattttagaatgtgagaaatacttgggttaccttaaataatagtagttcattgggaggatatgtagaaataagagaagactgtttacagagctacatcttgtagaagaaaacaggaatcaccaaacactaggctttgctgaagaacaattcaccagctcttacagaaacctgaatatatttcaggactcagaaggtggctgagaatagtacagctctagcagtaggcttgccttgttttaattcctcaagcagcaggtatcctgtaattcctaatttagttctttgctgttatagtagtaggtctcaacccagggtgattttgcctctgaggagacattttgtagtgtctagagatattttgattgtgaggactaggggaagggttgctactggcatctagtggatggaggtcggggctgctgctgctcttgctaaacaggctgctgctcctccatgcacgggacagcccacccataacaaagactctatgtggttcaaaatgttaatagtggtgagttggaaaaccctgctttatagtgactagatattggcacctcttgggtcacaaacccacacttgatctagttagctatgggaagcgtagcagggtcaggactttcaggatataactgaattgtctaaggttttttttttttttttaaaggaggtgcctgtggccatggcaggtttttcagaaaggagttatgaatttgacaagccactagactcagatttgtagtcagtacttctctcttgttccttt

SEQ ID NO: 21848 - DNA, 1037 bp, Homo sapiens
ttagaacatcttgaacatgaatcacttgaaaatgaatagcatttttctatagccagtggctgtgaaaaagaaaaaaaattttaatttttttaaaaagataatgaacagcatttacaaatgatagactctaaaaaacaggcctttaaccacagctttttagattctgataaacataaaactaagaagaaaagaatacatttcttccattagcatggaaggtctgacttgacctactaaaggaagaaatctcaatcaatggagaaaacccacgcagactctctgaattgtgcttaatggacggagtttagcgtcactttcctttcccccataatgtgaaccttaaaggactgggtgagagctgaacttttcccttaatcatataaacgcatggcttttctaaaggccggagcttacatacacaggttcagattctctattcaatgctcctgggaaatgtctattcgtgccgcattgaagcctcagtgcctgaaggcagaacttgaccattagcctttacagctggttgaacattaatgtcttgtgaactgttagacggaagcaccccttctagttgcctagcactgtgacacgatcccaagtgggcttaccacttggggatgtgttttatatcttgacacattttttcttatggagatgcaacacgcaaaaacagtccatggacgatccttatgcccagtgccccatggactggggtaatccctgtgatagagcctatgatgcccctggggccaagtgccagcaactcatggatcatctcgtttcatcagtgtcaccccctcccctctctctcccaactctgattattgtgtaccaaatctcagacatcacttataaatagttggtatctctaaaaggtgggccaggtgtggtgacttacgcctgtaatcccagcactttgagaggctgaggcaggcagacaacctgaggtcaggagtccgagaccagcctggctaacatggtgaaaccccccatctctattaaaaatgcagaaattagccgggcatgatggtgcatgc

SEQ ID NO: 21849 - DNA, 1025 bp, Homo sapiens
agataaagctttttagggccaggcacagtggctcatgcctgtaatcccagcactttgggaggctgaggcaggcacataacttgagcccaggagttcaagaccagcctggccaacatggcgaaaccccatctctattaaattaaaaaataataaaaaataaaaataggccaggcgcggtggctcaagcctgtaattccagcactttgggaggctgaggtgcgtggatcatgaggtcaggagtttgagaccagtctggccaacttggcgaaattctgtctctactaaaaatacaaaatagccgggcatggtggcacatgcctataatcccagctactcgggaggctgaggcaggaaaatcatttgaatccaggaggcaaaggttgcagtgagcccagatcgtgccactgcactccagcctgggcgacagagcgagactccgtctcaaaaaaatttaattaaaattaaaattaaaaaaagttttttataacccaaggcataactactactgtattaactcgttagatcattagggtataagaagtatacatttaattaattagtttacttccttgaatttcttttttaaagtacttgttctaaatggacataattacctttggttattctacatccttattactcttttttgagttggatcaaaaaatgagatgctaatatcgattattagagctaacgttgatatttagatcccttgataatcctgcttctttctgtcttcaagctaagaacaattactgtttcatactagaggaactctgatgtttatttatacctcaccttgttccagaaataatttaatgtagcttagacccagagtaagcgagactttagggtaggcataaaaaagaacaaaagatgaatcagcagagatcaaacaggaaggaactgtctctaacagaaattagctcacaagaactagcaaagctgaaatgaaatttagggtaagcagttctcctaggagtggcaatgttagagatatacttagaatttatagagattactat

SEQ ID NO: 21850 - DNA, 1106 bp, Homo sapiens
tgccgagggagactttaggacaagaggcgttgtttttgtgagaatgaatttttatactttaccccgaccccaccccctaccccccgcccaggtaaatccaagtaaatgattttctgaaggtcggtctcctagaaagcgtttaggctctggttttttgttttgtttctattttcgtgttttcccagttagggaaggaagaggagcctgtgcagagttgaactggggtggagaggtgccttgtaaagtatggtttccagagatggtgagacctcgtagctaagcgttgtttcctctgcacgtaactgtgagttgtgaacttgtggctcctgggggagcgggacagggcctggcagtgcgggggagggggcaaggaattcaggaagttggcgagaattcttcgtttttcattcttcgttgtaaattgcttctaaacacttctgaattttaaattgctaccgagaaggtccagaaaccgttctcatccaatttagtcacttttattacgttccactttgcctcccccaatcactgcggcggctcccagtttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttcgtgagttccgaccaaatgtttaagtggactgggttttgcagaagctcatttgtaagcactgacggaaatgggttgtgggcatttgatttcctttgattccaacgttttgaaataatgtttctcggatttgctattcgaagcaattttctaaaaactcatatcttatttgctaaaaataaactctttggctcagtttgtgtccaggctgtgtacggcctccaaccctgagccccgaggagatcgagccctggcgcgagcctgatctctgtcctgtgtgtttctttgtatttgcaagtacaaggatgtctgcgtggatatccctggacactcgataccccccggggacctgcttttcccgcagc

SEQ ID NO: 21851 - DNA, 1043 bp, Homo sapiens
cttcttgtatttttatagctttgggtcttatgtttaagtcttaaatccatttcgagttgatttttatatatagtatgtataaatttttgaatagattttgtatggtgaaagatggggtccagtttcattcttctgcatgtgggtttgtggcagcacttactgaagagggtatcctttccccagtgtaaattcttgttggctttgtcaaagatcagttggctgtaaatatgtagttttacttctgggttctctattctgttccattggcctatgcatctacttttataaccagaccatgctgttttggttactctagtcttatatttgaagtcaggtagtgtgatgcctccagatttgttctgtttgctcaggattgatttggataatcagttcttttggctaatcagttcttttctagttccacatacatttaggattttttttttctaattccatgaagaaggacattggtattttgatagggactgcattgaatctttagattgctttgggcaatatggtctttttaacactgttaattctttcgatctatgagcatgggaggttttttcatttgtttgtgtcttcttcgacttccttcatttatgttttgtagttttccttgtagatatctttcacctcttggttaaatttattcctaggtattttattcatttgtagctattgtaaataggatttccttcttgatttcttttttggctagatcattattggtgtatagaaatgctactgatgtgtgtgtgtgtgtgtgtgtgtgtgtgtgtgtgtttgagacggagtctcactctgtcacccaggctggagtgcagtggtgcgatcttggctcactgcaacttctgcctctggggttcaagtgattctcttgcctcagcctcccaagtagctggaactacagacgcccgccaccacacctagctaattttttatttttagtagagacagggtttaaccttgttggccaggctggtcttgaactcctgacctcaggtgatccgcccaccttggcctcccaaagtgctggg

SEQ ID NO: 21852 - DNA, 1077 bp, Homo sapiens
gtcatgggaggaacccagtgggaggtgattgaattatgggtgtgggtcttttgtgcactgttctcatgatagtgaatgagtctcgagatctgatgattttaaaaaaagagtttccctgcacaagctctctctttgcctgttgccatccatgtaagatgtgacttgctcctccttgcttttcaccttctgccatgattgtgaggcctccccaacctcgtggaactgtaagtccaataaacctccttcttgggtatgtctttatcagcagcatgaaaatggactaattcatatagtaactcatttaattctcacaaagcattgaggtaagtattatttagagatgaagaaatagttacagaggttggcagcctagttctagaagtcatgtgttttaaccattacattatactgccttagagatgaactagattttgtccttacattgatattatattattttagctacttttgtaacaagtataaacttgttattgttgaagtaattaccttttaagttccctccaataatgtaccttctcttctctgccactcagtgggaagaaagggtcttatagtcaactccccttaaaaaaaagtctcccccaactgctcagaagtcatttattctgtattagtattttccaaatgtatttgacctcaaaacattcttttttatagcatacttattaacccctacctaatagtgagtgaagtattctatgtgacactagtttggaaaaatgaggcagtacttttattcactgtattgttgtggtataaatgtcccccctggaatagcagcccagattaaaacttctaataactgtctggttttgctatttatttatgatgtcctttgatatgtatattatataaatcctagttaaaattattttaatcacaaatgaaactaacatgagctactttaaccaacaacaagaaagggagatttattttgaggctataaagttatcccaagaggaatatagggatgtgggtatttcaaaagcagggagtcagtctggccaaatgaggaattagaaccagaaaatagccttataactctcattctctctc

SEQ ID NO: 21853 - DNA, 1114 bp, Homo sapiens
tttaaatgttctgtagtttaaatgaaatgaaaactgagattgtcaccttaattttaagagtgtggatacctgtgtgatttcctatccatcagcccaatttgccaacagcaccagaggcctctatgggatctctcctgccagaagtctgtgtttctgccagagagcactaacccagtgcatcatcctcacctggtcaggatgtgtgggacgcttcaccttcttccccaagggaaggtatcgagcccgcctccctgccttctcacctcccatgtgtacctgaggtctgccctgagggataggagcgattcctgggcttgacctggaagcatggcagttcgggctggtgatgagtctcagttgcaggatgaggggaagcaccccttgccctgcgtatgtgggcgccaggcagctcaggggtcccgggggagtggagagctgaccttctgctgttgtttgcagcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgccatcaccctcacccaagtgaatgtggtggtggctgatgaggccgaggccctggtgcttcaaggagcaccctttctgggggtctgcaggtcactgcagaggagcggtctgttacatcttcccatttggagaacctctctcaaccgtgctgtagctggttctgcagaaacaggaagtacaggatttcatgggctggctctgctcgcctcgactgagcttcacacctctggatgccacatgctctctcccaaacactgctttcagtgcaaggtagtgggcctaaggggtttggttgtcttttttttttttcatttttaaaattttaaatttttatttattattattttttagagacaaggcctcactctatcgcctaggctgaagcacagtggtgcgatcacagctcgctacagccttgacctcctaggatcaagccatcctcctgcctcagcatc

SEQ ID NO: 21854 - DNA, 1040 bp, Homo sapiens
agagaactctcacatgttaacgtgtatgcatatcacctgggcatttgtgccagtgcagatgctgtttagtaggtcaggggtggaacctgagattctgcatttcgcgcaagctcccaggtgttgctgatgctgcttgtctgtgaccacactttgcatggcagatagaagaaagtacctgttgttctgcctgccagcacttcccataccttcctccaataaaatgttccttccttcttccaaccatgaagttcctgagtgagcttccttattcttatatgactctgcctcccaggccccagtcagttggtccaggagccaattagaatcgtccctggcattttgggactagaatccagagagatctaggcttagatccgctctgtgaggctctttctaactctgtggagggaactggtcaaggataaggggtagagagaatgtcccagtggttctcaagtccttggttccagttttcccaaatatatgaaaaaggattaaacaacaaaacaaaacagcattgtgaccttaaaggttatattaccagctctgattatctggtgcagaaactgttatcaggcccttatcacatgcaagtctctattgctagcccctgaacgttcaaagatgaatagcacatgccctgattgggagaagaccacatattgcaaatagggtttggcatgtgcgatggcaaggggttgtgggagccttgagaggaagtgcttgatccagttgggtgtgcggacgggggccaagttcagtaaaagttttctcaagatggatttttgaatggtgagtaggaattatgtcggctatatcggcagacctatgaaatgtttccaggcagagagaacttgctgagcaaaagcaagatgatggtaggaaactgtgtttgaaaaattgcaacccctttaaaagggaggtacatggctgtaactgggctgaagaagcaggcaagggagagtcttgtatgcatcacttttttcttaagagtcatatgcatttaaaaaccaatagaacaataaacctaagtctctgat

SEQ ID NO: 21855 - DNA, 1079 bp, Homo sapiens
ggaactttatatctcttataagcttgaaccttttatggccattgtttcatcttctcaagcaggatggtgatgctcccttctggtaaccaaggctgggtgggtcggcttggactaagtagaggccaactgggaagaaatctgcagtggacaccccatgagcatattcattctactatgagcatatcctactatgagcatattctattatgagcatattgtactctaatgtggcagagagcatgtaatttctctgccacattaattttcttttgaattagtgaagttttttttttgtctaaagtagaggatgctctcttctagttttttgaagcctccatttcagtttatttccattttttttagtgtaattttctccttcagcagttctcctatttattcgtagaaagaaaattcttttgaaaaagatcttatatagctcattctgacccccttctattgtttgaaagaatggtcgatatttgttagaagtttgaagcagcaagtgtgctgtcaaaggaagctgccctaggtagggagggaggagaaagcaccacacccttgagctctggcttggtggcctgggctggccctggctgatgacgtgttcctccatcctttgggaggttccagctgtaatcaggccctaggcagccagctgtccttcttcccctcatagcaattgagccttcagctcagaggcaaagttcatttctgttctggacaagtggttggcatctgtaaaatacaaagaatttattaaattaataaatactaaaacctcagtgaaaataaatgggtaaacagcagaagtagacaattcactgaaaaaagagatacaaggccaggcacagtggctcatgcctgtaatcccagcactttgagagaccaagacaggtggatcatctgaggtcaggagttcgagagtagccaaaaattagctgggcatggtggtgcgtgcctgtagtcatggctacttgggaggctgaggcaggaacaccacttgaactgggaggcaaaggttgcagtgagccaagattgcatcattacattccagcctgggtgacagagcaagactccat

SEQ ID NO: 21856 - DNA, 1044 bp, Homo sapiens
taacctctgcattcaggggcacatcaaaggtgtagctcctagtccttcattccaaacggggacttccctagacctagcccctcttttaacgtttaaaatagaaaaagatgtcaacacgtggcatcaacttcagtcctgtgctttggtttctcctacaacagctcattagtttaaaaggtaactccagaggctctcaatggaacatcataactcatccattcatcgacccataaatgtactgatcacccacactgccagcatctggtgtggcctttcccaattgggatgccacaggagaatgaagtgccacataaaaaatcatctgggtgacccccttttcagttggcccaaggcaggtacagagcagctgtacaggaaaacaccagcgagatgcacaggagagaaatgacttcattacatacatacagtggatgtcacatgaggctatgggttacagacaaggcacaacaatgcattacatacagtggatgcctacagcatcagggctaattctctcctcaagagttcttaggaattccagaggaaaggcaggaaaatacacagaggattaaagagtaacataggagattctctaataaccagcctggcgaggtattagagacacaggggcaacatggcaagaccctgtctctacaaaaaaaaaattataggccggctgtggtggctcacacctgtaatcccagcactttgggaggctgaggtgggcagatcacgaggtcaggagatcgagaccatcctggccaacatggtgaaaccccgtatctactaaaaatacaaaaattagctgggtgtggtggcgcatgcctgtaatcccagctactggggaggctgaggcaggagaatcgcttaaacccaggagttggaggttgcagtgagccgagatggcaccactgcactccagcctggtgacaaagcgagattccgtctcaaaataattattattattattataataaattaactgggcgtggtgatgtgcgcctgtaggcccagctacttgggaggctgaagcaggaggatcgc

SEQ ID NO: 21857 - DNA, 1248 bp, Homo sapiens
ggctaaacaggaaccatctgattcatgggctgccagtttgcagtttccaagtcttaccctcatgcctttgatcctcactcgattgtagattacctcttaactaaactgggaggctagtagtgttgatgtaataaatggaaaatactgtccatttcttacagtgaagcacagaaagtactataagaaatggcctgtattagtggttctcaaattttaatgtgtgtgaatttgctgtgaacctgagtatagtagaattggggttgaattcctgtcataactaggatggggcttcccaaatggtctggtgctgagtgtgctttgaaaagcactggcttatcacctcctgtcccacttctggtgtaatgtccagccgcagcatgccttctcatgcgtttggcctgtgctggctccttgtatctgtacatgcacatgaacataagacctgcagagagcccccggctgtaaacagaagtgacgcagagcccttctctccccgacaggagcattgtccgtgatgccagccgtgcacaccttctctctctttgcgggattggcagtcttcattgactttcttctgcagattacctgtttcgtgagtctcttggggttagacattaaacgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtggtatgcgcttatctgtggtttttctctttcctctcactgaaacagattatcacatgccttctaagaagccagacagcctgggaaggagattcttaaagctgttaaaatgtatctaaaaaaaaagcaaaagcaaatgtggaacagtagataaaatgtttttcctgtgagcttttatcagtccatataaacaagagttttaagttttttattttgaaatagtttcagattcacagaaagttgcaaagaaacttttatttttcctcttaataatgaggaaatagaagccaagagaggtgaagtggtttgccccaagtcactcagcccgtaagtggcagagtcaggatttgcacccaggaatttggactcctggtgctgtggtctc

SEQ ID NO: 21858 - DNA, 1031 bp, Homo sapiens
tagaatgttagattcattttgcccaaaggtgccactaaaaaggcaaaaggtcaacacgtgtcccgctgctgtagaaggtggtctcagtcgtcctgtagacccgacgtgggcggagactcagtgcacgtgagagtgatgttcactggtccagtcccctgccgcctgtgttccgagtgttttcctgataatgtggctggctcagctttccctttagtttctcacttggtacctagctctgtagtgcagaaatactctgagaacattggagtcccccaccgaagtttatatgcttagaagacactgctaatcgtctactaatcatttatttttacccttgagttaacacaaggcagcaagaaatggcgttgttattgagaaattttaatgtcgcataattttttttttttttttttaagagagatgaacgtcttcaaggggaaaccctggatcagcagctgggcagggtcctaggagaagtggctcccagtatgttcctgtcatccttttctgagactgtagcatttttcttaggtaattatgctttcaatcctaccagtcctgtagtctgctgagcctggagaaagaaggagctggctacctgaacatgtccctttgtgttgcttcctttttttttttttcttttttttttttttctctgagacggagtctcactctgccacccaggctggagtgcagtggtgcaatctcggctcactgcagcctccgcctcccgggttcaagcgattttcctgcctcagcctcccaaatagctgggattaaaggcacgtaccaccatgcccagttaattttttgcatttttaatagagatggggtttcaccatgttggccaggctggtctcgaactcctgacctcaggtgatgtacctgcctcggcctcccaaagtgctgagattacaggcgtgagcccccgtgcccagcccgtgttgtctcctttttttaagctttgttctgcactgggaaagtatcactggaccacagaaaaattggcagcagtaacttaggtgtgattt

SEQ ID NO: 21859 - DNA, 1051 bp, Homo sapiens
caaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcacacttgtagtcccagcactttgggaggcccagacgagaggctcacttgaggccgggagttcaagaccagcctaggcaatgtttgcatgtctctaaaaaaaagaaaaaagagaatttaaaaagaaaaaaaagcgtacaattcagtagctttactatattcacgtgtatgtgcagccatcaccacagtcaattttaggaacattttcattactccacaataaaactctgtaccctttaactaacaccctccatcttttcatcctcctatccacagccctaggcaaccactaaaatactgtctctggagattttcctattctggacttttatgtgcatagaataatatgtggacttttttgtctggctatcattgaacataatattctcaaggttcattcatgttgtggcatgtatcagtactccattccttttcattccattgtatggatataccacattgtgtgcatttatcaactgacaaacacttgggctgtttccattttggctattatgaataatgctgctatgaacacttgagtacaagttcttgtggatgtgagttttcatttcttttgggtacatacctagtagtagaattgctgagtcatagggtaagtccaccttgaatagtttgaagaactgccagactgttttccaaagtggctatagcgctttacgtcaccaccagcagtccatgaaacttccaattcgttcgcatcctcgtcagcactttttattatctgactttgtgattctagctatcttcatgggtgtgaagtggtatctcattgtggttttgatttagtagactgaatgcatttctttttttttttttttttttttttttttttgagacagagtcttgctgt

SEQ ID NO: 21860 - DNA, 1031 bp, Homo sapiens
gtgtgtgtgtgtgtgtgtgtgtgtgtgtgtgtgttttgatgggcagggccctcaaacgcaggtcttagggactgtactgctcattgaggcccacatgaggccattggcatggagggctcccctggccacacactgcccgaggtcaccctgacaacatgcacttacaggctgctggaactttggatctgtggaaccatttgcccagatccctgaagcagtctagtcaataagggagagaagccaagagcaaaatatcagacataggagatagcctgcagtcccccaactgagaaagacagccaagcacagtcctgtatgtccctattactgggaagaaaaaacaagaatttcaaggaattgatgacactatgtttatgagttatacttgaggccctgcagctgaggatgtggggaggggtgagcaaagtcagagcactctttgtggggctagttctgtctcaagaacctcacacagtccgttgtgcagacagggaaatttaattgttgaacaattaaggcaaggaccactgcaaccgcccagcaccccacaataggcaggggaggggtggcgtggatagagggataactctaccatgtaatacacaccagatatgtgcaaaattggatttaaccaggtaccaaaacagttacattagcatcatcatcatgaagggacattttaaaatatttgcccgtggtgagggatacaaaaagagcctccaaatcctgaaggaagagaacacgtggactagtaatacttgtggcagctgtagttggcattgacacctgccccggattcacattgcaagggagagttaaggctgtgttttctccactcgataaaaatgtcaggttataaaggcagatagtgatatctaagaagtcatggtgcaaattacctacaaaaggaaggaaaatctagattcctaacactccaggacaccatatacttgacactgtgagattctcagcaccttcctgcaaaactaatgcagtcttcagtgcacttgacttcagccaaataggattta

SEQ ID NO: 21861 - DNA, 1045 bp, Homo sapiens
gttcattagtttcatgtatcgggcatcaaatccttggcatgagtcattgtggtacagtgcacctgctgtgcatttattagtaactggtgtttaggaagttggagacagtaaccccaggaagttagagtataccccaacttattatctcaaattgtttttaaatatctaaatctccaggtcaagaaatcaaaatgcttaaaacgcgcgtgtgttaaggcctaaatattatggtaggaaagtgtacctaccagttttcagtttctgctttgcgacgtttgtgagcagtagtcacggttacctccccagcaataccgtaacttccaaagggagcacatttgtcaccagatcctgaactttttttagctacatcttctactgggaaagcaacagaaaggaaaacagggctttttggcctggggacatcttgtccacttggaggattagcattctggggacttagggtatgtttctggtatttctcatctgcaggaacagcaatgggcacttgcattgcaacatatctcaagacatctgactgtgaaacgacagcatgtccaggaagaggtttccatccctgtgcttcctgaacatttgagcctactaagataaaaggtggggcactggtcttcttggtgtcgcccatcacataagttggaaaagtgacttttggtggatgctgctgaaactgtggatccttaggattaggtaaatagagggttgcttggggaaaaggcccaggtgcaggtggcggtgatgggtgaccttgttgattcttatcagttagacaataaagggtccacatgttagaacatggtggtggttgtcctcgttcacttgttgccattgctataaaaaaaaattttgcaggaattaaagttttggtctctgtatcaggcactatgcatagtaatgtctttgtaagtctcttttacatataaaacagctgtagtgatatgtaccgtagagcatgctatagagagggctgcataatcgtgtttgacaggtgaaagagattctctacagttgaaaaaggagaacagtgttg

SEQ ID NO: 21862 - DNA, 1094 bp, Homo sapiens
ttattattatcattttgagacagtcctactctatcatccagcctggagggcagtggtgtaatcttggctcactgcaacctctgcctcctgggttcaagcagtagaacttctgagtagctgggattgctgggattacaggcctgcgccaccacacctggctaattttttatatttttagtagagacaggatttcactatgttgcccaggctggtctcgaactcctgagctcaagtgatccgcctgcctcggcctcccaaagtgctaggattacaggcgtgagccactgtgcctggccacatcaaattattaaacttaaaataggaaaccaagtcattggattttttttaaagattcataactaaaaaaggtatatgactagccttagagctcttgtctgagacttgtactgacctgcttctaagacgctacgctaattttagttggagaggtctaacagcaggttaaatacccagctgttgagtcaccctcgtctctgactaagttgtaagatatggtgctcatttatactaggcttcagaatggcattctggatatacagagagaactttgtgatgactgtatttgtctgaattcgaacctgaaactaggtacagggtacattataataacagtcatgcaggaagagttttaagtgattggcttctttaagaccagcctaaattctgcttctgttgaaatggggatgggcaaatttcaggaatttaattgtatcggtaaattttagacactttgtgttgatttctgtatattaaacttgccaagtatttcatatataactttgaagatcttgaatcttcatgtacattacaactaaagttttaattaatagtacacaactgagaaaaatagtatttttatgaccgtggaatacatcttatcacctttggagggcaaacattttcccttgtttgagggcatcattttcattgtgataaaatcaaattatatcaacttaaggtgagattctgtgagttgtgtgactaaaaaccagtatttactctcagatttaaatgttaagagaatatgaaaaatcatatcgaacttttaggcagtcaggtgaactactaaagat

SEQ ID NO: 21863 - DNA, 1049 bp, Homo sapiens
accccactgctctccagcctgggtgacggagcgagactccatctcaaaaaaaacaaaacaaaaaccatgttgtacagtagattacttgaactgatttctacaaaaaatatgggacacttcatgaatttgcatgtcatccttgttcaggggtcatgctaatcttcgtatcatttcaatgtttagtatatgtgttgccaaagcaggcactcatttcatcttttaaataactcagtatgtatctctaaaacagtgggagtcttttttgcttctaaaccacagtactattatcatgtataataataatttcttaattatcatcaagtatttagttagtattcacattttcttgattgtcttgtaaatgtcatttagtaattggatccaaaatggtatttagtaataggatcccaaagttctacatactgcctttggtttctatgtctcttaagtcattttactccaggtttcctcttccctcccccattttttcttgccatttatttttcaagaaacctggtcgtttgttctgtagagtattctaccatctggatattgctggttgtattcctggggtatcattccacatgttcttttactcctgaatttcctgtggactgatggttatttacaaaggtgtggccagatttatgtttcagttttttagcacaaaattcataggtacacaaaccataggtacttcctatgacatcaatcagagagcatttgctctctgattctcttctttctgtaatggtgagattgattcttgggtttagtcattgacaatctgacacatccatgataaagttgcctgacagtctttcacctaatgatttagtggttgatcattgtcttcatctttatttctttaggtgctgcaaaacagtagtctttcaattctgtcactccttctacatttattagctgaaaatctataaagaagagcttctgacagggtgcagaggttcacacctgtaatcccagcactttgggaggcagaggcaagtgtatcacttgaggccaggagttcaagaccagttggccaacat

SEQ ID NO: 21864 - DNA, 1050 bp, Homo sapiens
ctggctgttatttttttgttttgaaactttttgtagagatgaggtcttgctgtcttgcccaggctggtcttgaactcctgtcctcaatcagtcctcccatcccagcctcccatagtactgggattacaggtgtgagccactgacccgacctttttaaagtatttttaaattactttacttttatgtctacagtattggatgtaatttaaacttctcataaggacagctagctactacagctttttcattatacatgagttttaaaaattaaaatttttttggaagttatacttaagatgctttgtgagggaagaaagaggtggaaattttgggggcaaccactgaatatgatttcgtaaagaactgagtaatctttggagatgtcttttactatgtgagatctgtttacttgtaagcttatgtaagtgtacctctgtttgataaatccacttcagccttatattaggtgcaggttctgtgaaatccctgaggaggtagttaacagatggattgttgagggacaaagtaggctgcttaggtttcaaagcctgaggcatgaagggagggatccattgttacggaagcctcacacccaagttcaattcattaactatgaacctgctctgccacagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacaggtaggatcgcctctgacagttgtcactgctgcgtttttacgataaagtacatttggattcataaagaaatatatgtcttgtcttcatttttccccgtgtaggggatttatattgctatatcacctcaaagaaagcatttaacttaagcactttttcctctgtccatttaagagaatcatctataattgtaggaacagagcacatgggcttagcaatcatgttcttagaggggcacataaatcctttagttggtgatttaga

SEQ ID NO: 21865 - DNA, 1056 bp, Homo sapiens
agagtgagaccctgtctcaaaaataaaaaataaacaacaaaaaaaggaagcttgacataagaggaagccagattgcagcatgcaaaggagtgagtgtgagggaggtgaggaaacaaatgatgaagatagactttgtagacattcataatctgtggatgattgtaattttattcctttttttcaattcttacacatttcatttctttttgtaattcttcatttactggctagggccttcaggacaatgttgcatagaagctgagatggtaggattcatgttcatccctgatttaaaaaaaaaaaaaaaggcatacctctaacttctaatgattcactgttaagaatggtatttaacaaataccatttaccagatttaaagagtttcctttcatatattgttgaaaattttttttatcattaaagggtgttgagttttatcagatgttctttggtgtctattaaaagggttgtatggtttttttaaatctgctaagctggtaaatgatatatttggactgtttccagtgccaagccagccatctttgtgtacttggaataaacctaatttggttatgatgtattatctttaacattgttctcaatttggtttcctttggattttagtatctattttagtatgtatgtttataagtaagattgacttgtaattttctttttttgttctgtcctcatcagggtttaatatcaaggttatactgacctcataaagtgagtttaggagtattccctcctttgctgttttgtataaaattgaaatggtctgttccttgaaaatttagaactttcttataaaaccaccttatctttgtaaagttttttttttaactagtaactacatatatttaatgtttctaggattattttagttttctatttctttttgggtcagttttgacaagttatatatttttaggaattcttttaagttttgaaatgtattataaaggtattcataattttctttcttttttttttttaacttaggttggatctgtaattatatatctttcctaaactttttccattttctttttt

SEQ ID NO: 21866 - DNA, 1033 bp, Homo sapiens
cctcagcctcctgagtagctgggattacaggtgcacctgccaccatgcctggctaattttttaaattttattttaatttattttaattttttattttttagtagagacagggtttcaccacattggccaggctggtctcgaactcctgacctcaggtgatccacctgcctcagtctcccaaagtgctggaattacaggcaatctctcgtttttttttttccctgtcccccaagtccccttttgttactgcaaagatttttcactttgtttttggtattctgcagttttattctgtctctgggtttggattttgttgttctatagcttgcttgaaactctgttctttaattcaaggactcatttattatctttctttaagttagaaaagttcttagctattatctcttccaattttacttcatcattctttatattctctcctgccagaactcttaatagacatatgttgagccttctcgttctatcctcctacctcatttcttattccatttctttctgttgcattctgagtacttttcttagttctattttctagctttagtttctttctcaatttagtcagtttttctgcttaatcttttgactttctactttctaatcttagtgactgtattttataattctagaaattttagttggtggttttaaaaatttgttatttttccccatagtgacatgttcttttatattacatgcatttctaattttatctctaataacttcagacatatgaatttaaagcatttttttcagaatgtttttatacctcaagttgttgcacagctaagtcttttgtttcttctgctgaatgtccatcacaatggattgtaactttatggacagctcatcttcagtagagcttgtgggtttttttgtttgttgtgttttattttgtttttgtttttcctgcttcttgggtttggaggtgtccatatagagtagttttgtgtgtgtcgctgttgaggctgtaaaggtttctctgcttctgggctactagttttaaatttggatt

SEQ ID NO: 21867 - DNA, 1128 bp, Homo sapiens
tcatttttttttactgttcagtgctactgtctaaagactcaaatatgactgtcctcacttaattactttttatcagtcaagcatttgaatctagatgtgtcagcttgggaaatctttgttatttttcccttagagttcaagattttttggctggagattattctgggtagtgttagagcatggagtcctttcatggtataggaaacagtaagtattatgatctttacacttatcaaatttcactgtataaattttgaaatacgaatttttttcacttgtctcttttccttttgtcttgataatttcatttttattttgaaggcctgatgcagttcataatatttatcgccagggatgcaaacacctgactcaagcagtatgcacggtaggatgaaacatggatcatttgctcctctaactgtgaaatcagttcttcaagtgattgacccaaatcatttatacagccttgtaaaatcttggggttctgtggaatgctgtagaaaacacttgtatatattttaatttgataacaagtaaagtcgtggcatctccattttgaacaaaattttaaaatatagttaacttttatttatctccatgtattattatggaatgagagatggattgtccaaaaatatttgtcaaatttacccaggcttatttgatgatgaaatatcctagtacatgcaattgaaaagaatgtgtattttgctattattgttggttgttttgctattgttgttggttgtagggacctatcaatattaattcagtcatggtggttgatagcattcagatcttttgtgtcttggttttggctagtggttgtatcagttgctgaaagaggaatgtgaaagtgtcctactgtgcttgtggaatgttgcatttccttctctgttattgataacatacttatgattgttgtcttcttgattaattgatccttttattgttttgtggccctctttatctcttgtaatacattttgttttaaaatttattttgtctgatatgaacataaccactttggccttcttatgtttactgttcgcatggtgtctttttcctatccatttgcttttagcctatatgtatctttatatttattttctgtctcttggagatagc

SEQ ID NO: 21868 - DNA, 1060 bp, Homo sapiens
tgtcaaagactaatttgcatttaagaaaacatgagtctacaataactcaggactttctctaaagcaatttaaaacaaaaaccattttgatgcttgcatttgggcaccctcatacaataggatctttctttgaatggccagggctttcctataattattttttagtagtatttctaatgttgagaagagaagatctttaattttctacttaatgagtaaaggtactgaattagagttgcaatttcacacatagcctttctttcctttggaattcagagaaaggcaatataattttgtacttaaaggatgttgatttcttaatttaaattttcaatatttttatttatgtaaaaaccaagatcctgctgtttattaccccgattagtcttgagagctaaaatcttctcactcattctatagtttaaaaaacaacacaaagtctacttgtcagacttcttaaggtcagtgtcttgtttctgcactcaaaatgaaccctctgcttatcaatgaacaagcaaattaacacataacatcttctatcagacactgtgttatatgaatttagtaacgtggagaacatattagctgtggttcctgccctttaataatttgtgactgaatagggaggatgaggtactgtctttaattatgtcctgtcattttaattataacaagaagagaacccagaactgaggttttcctgacagactggaatgttaggttagtctgacaagttgacatttaataagggcaattgtaaagacatgctctaagacatttccaaactcaaactgcacaagaaaaagggcttagttgactttacaggtaatatgatttgtcagctgatgtggtcttagcttgggaaacagaagtagagactgaattgagtgattctgctctaatgagagcaccttacccacatataataacatttgtggatagagtgttaaatggatcattggcaaattactggaagtaccttgagtaacccactataagtagaccataagaccataaatagatcagaaaccatgtcataggggctgggcgcagtggctcat

SEQ ID NO: 21869 - DNA, 1081 bp, Homo sapiens
tcaaatactcagatttcttctgtcttaatgttctacaatgtgtggctttgaccatatcatcccaattgggagcatcccaatcccaggaagcaggctaggggaagcaaaaaagggacaaagaatatatacagactgccccttctagaagattcccagaggctgttatatgagacttctgcttaatcccattgactcgaatattcatggccacactagctaaaggggccacactagctaaaggggagcgaggaaatgtagtctttattcttggtggccatatgccgagctaaaaaatgttcggggtcagatgggatcttcccttcacccttggtgtcctagaattttactgtttacctttagacttttaaacctgcgaattaggtttctattgctgcataacaaattaccataaatttagaggcttaaatcaacacccatttattatttcacaattctgaaggtcagaattccaagcacacagcctagctgaattctctgctcagggaccgtgaagactgaaattaaggtgtcagctgaactgtgttctcatctgtggttgggggctttttgcaagtacacgcaggttgttggcagagttcactgttgttgtttttttttttttcttttttcttttgcaagggatcactctcagctcttacaggccaccctcaaatcatggccacacagccatatctggacttactcacacttctcatcttctttgccaggaagaggctagccccttttgagggctcacttcaataggtcgtgtctgcctgggatatttttcttaaggttgactgtgccatgtaacaaaacctaaccagggagatgtcttcaagtccgtcttctagtctttctattgcatattttatttctgctgttatttttaatggttaagaattttaactttttgaccggatgttcattttttaatagcatccaatcttggttaatgaagaaatttctcacttctctgaggatattatagttcttttaaaggttttcttccacattttcatgtctttcaaactttttttttcttgtctgtctagatctttctcctttgtgctagtcatat

SEQ ID NO: 21870 - DNA, 1046 bp, Homo sapiens
gtgaacaaatagtaagttaaggagatgaaatacaaaatataagaaagaatgcttgagcccatttagttgtcataacgtgtcagtggatccaaattaaagttactatcttaccttgtatcgcttctaaaaatgctattctgtcacatgtgttcatgaattgaatatagaagatgggccaagttagactattgtttaaaaatacatcttattaaaataatctaaatttctgtttgaaaaaaatactacatttttattgcataggtatcaaagcataagtcattttgattttgtgaatctataaaggatatggccaaaacacctagtgatactgttaattagtatgtaaactgtgaggcagaattaagtaatcgtttaaaatcaaagctgtagagtttctttagagactgattcctacctagtgttcttgaaaacaaaaatgtttgcaacaaacttccacttttgtactgtattagtagattcttacctggtggtaccatcaatgtctttcattaaaagaactcagcactgtggcagcggtggcctctgacccattgtagagcagacaaaattaagcaattaatcacatccttcaagattccaggtttcctttatgatgatgtattttcaggttttattctatgtggaacatatagtattcactcttttctacgattagtatagaccaatcacagactccttgatctcaggatgcctttacattcttagaaattattgaggaccacaaaaggctttggtttatgtgagttactatcattttccatcttaaaaatcaaaactgagaaatctattaaatacaagaatacaagcacatattctattagctgtcagagagatgatgtcatcacatatcaggtagcgtctagaaaacttcactgtaccctcttgagataatgagagtataaagggcaaataatgtctaatattattgtgaaaatagtttgaccttacagacctctcataagtgtttaggagaccacagaagtccctgggccaccctttgagaaccacaggcatagaaattttag

SEQ ID NO: 21871 - DNA, 1072 bp, Homo sapiens
ctaaaatacaagcattttctaaattgcttttgagaaaaacaagagagacagagaggtctatggcactaacaagggatactgaaacaaagcaaaggattcagttagcatcattcttgtaattataaaccaaccaaaaggttgtttcatgtaccagtgaaaatatttactagcttattggtataactgattgtatcacttagtaagaggacaaattgaacaattgcctcataaaatatttctgttgcttctagtcttgtgaaatttgatggctgaatttattatggatagttatcgcaactttctgtctctacaggcccttctaattggggaaaacacgttgtttcttttttaaatttttaaataatagaaatgtataaaataatagaaatttgtatttttgttacttagcatctttgctacaaggtatctgaagaaagcttcatgaagatagttacaaatactatatatgtcatatcacttttaattttaaaatgatggtgaactttaaactgaaggctagcagtttattctaaacaaaaccatccttgcccagaacaagaccttttgatggtcctcagagccagtttacaagatacacaagaaaatctatctcatttacttacacacttcatatttccttaatttttcatctctttactcctgaaagcaaacatctacatgaaaaacaggactctaactattggtagttatatccccgtctcttaccagcttgacatgataataaatttctgtttaggcattcacagttattagggaaactcctgtgatgtcacaaagcatagataagatatttgctataaaactagctttagagaaaatccactctttgatactatgttcaaaatgctaaaaaaaagagtataaatgtagaaaatatgataaaaagtacatgctgacactagatgtgttatttcaaagttttgcggagcatcagatgcttattaagtcctctagttatggtagtctgtgtcaagggaaggtcaatgccaagtatatctgcatatctgttgataacaacatgaacatctctagcaggtgtgattttgtttat

SEQ ID NO: 21872 - DNA, 1049 bp, Homo sapiens
tttatttctgtaggttttagggaaacaggtggtgtttggttacgtgagtaagttctttaggggtgatatgtgggatttgggtgcacccatcaccgaagcagtatacactgtactcaatttgtagtcttttatccctcacccacttcccagccttaccccctgagtccccaaagtccattgtatcattcttatgcctttgcatccttatagcttagttcccacttatgagtgagaacatacaatgtttggttttccattcctgagttactgcactgagaataactggatggtctccagttccatccaagttgctgtgaatgccattaacttgtttctttttattaacctgtactcatttagttattatctaatataagccagggactttcattaattgtgggtacaaagatatactgagcatatctcagggagctcatgatccataggcagaaagaccaaaaacaagaatagttattgctctctgttataaaaaagttttgatggaggtgtctgtagaggggtggttctcagaattttttctgctcagagcatatctgatatctgtgactgacatcatcagctatcattgctcacccaggtggcagagtctcatgagcaccattgtctcatctttcattatggactctatgagcacccattatgaactactacaagatatgaacacccagaagtgaggcatagcttcactttagctgtggcccccagcttcttaagaatcagtgaagtaaaggttgcaacagaaatgtcatacaaaatttatagcattctcaatgagagtgctgcctgtgggaatgcagttaaccatctatagatagaacatcggggtgcaacaagagatgagaccagctcttccatgtaactcagccttgagtctggtttaaacatgagccaatataaaggtctctattagccataaaatatgggcttcctttaataaaatcattgcctgcacagatatctatgatagttatgacatcatagataattataagaatatcaaccttatatattggccccacatcttctgg

SEQ ID NO: 21873 - DNA, 1033 bp, Homo sapiens
cacggttttgtgacataaaactgaattacccatgtgttgcctctgtgatttaccttgcaatgtctctctatccctgcagcacagcagataggcagcaaatgcccctctgagacccagctctggtacagtagcctgggatgccctagtagaaccaatggcgaaactactagaaagggagaaatgagcacatagaaaaaaaaaaaatcactacaaatgggctttcaaccaagattccaaagtatgtgaatgaatcaaacactagtaaagcagaaaaaaaagaagaaaataattattttgaacagtctgacaaagactttgaaataagcatgtttagaagctcagaaagataaatgaagatatgatttccactgaaaagagtgacaaattatgaagcaaatccaagcagaagtaaaacaaaagcacttgaacgtttaaaactagaaatgttggaaatgaaaaatagtcattttaaataaaagctttgctagataggataaactctagactggtcagctgtgaagagagaatcagtgttttgtaagagtacagagaagatgatctagattagaacataagaagacaaatagattcttaaaatatgaatgaaagggcagttaaaatacatggaggatagactgagaggctccaatctgtgtctaataaggattctgatagaagtgaatggagagtgtcttagatagacttaataactgagtgattttaatcactgaaaattttaagaattgagtacataagtgagatctcaaattgaaattattatttttgtattgagcaagacaaatacacgtaaaggtacagtttgaaacatggccaaaaaaaaaaagaaaactgcagaacactgaggacaaagggaaaatcttgaaatagactaaaggaattaagagccaattctatcctatgaatcttagtcaagagtctgggactgggagcctaaggctaacgtggctaccgacagttccttcgctctcgtaagttacttttcctaccattcctggcattgtcaaagaccaaa

SEQ ID NO: 21874 - DNA, 1042 bp, Homo sapiens
tggatggctgaaactgtgtcttattcattctcgcattatctaagcctagcacaatacctggcctatagtaggtactcattaaggctggcaagttattctgctatgcagttccttggaagagtcagatttaaagtaacatgttgcatagcatgtttgatgtaatggctaaataaaactgggactcagtttaccaaatatctaccccacttaaaatatatcctacaagaatgcatctctgagcctgggtagggcattttagatagaactctgtaagatacacatcattctgctctttctgtttgaagctgatgccactcctatgtgtgtgtatgtgtgtgtctctctttctctgcctcttattttcccaacacaaatctttcttccattaagcgagtatgggaaatgtgtttactggacaagtggttctctgactgttttccacagcatattcatatttttataagattttaaagtgtgttctattttaacaaggttttctgaatggattattgtggaatgttggattaaatccattaaataggcttctttattaaaagtgccttgtggctcttctcttcaaagagggattacagtgaacaagtttattaggccccagaatcatcttcctttcagaaaacccataaacattttctggaactgaagtttgagaattgatgttgcttatataaatattggccatacatatatattttacagtttatatatgcttctagggagcaacttttattttgatacaattccaaacatacagaaaacttgaaaaaataatataaggaacttccatatcatttacctgattcatcagttgcttacatttttctccatttactttattattctcttcttccctctcctatagcatctctttcttaatcatttgagagaaagttggagacatcatcacacctctatacatatatcctttgtatttctgaagaacaaatctattctcttacatatctatagtatacttactgaaactgagaaagttagcctttaggccaggcgcggtggctcacac

SEQ ID NO: 21875 - DNA, 1041 bp, Homo sapiens
ggtgatgggaggaaaagtgacttttccaaccctctcagactttttctgaaagcaaaaattacaggctcactgctctgagagcatcaccttccttattctagtctgagcagtggaatgtctcagtgctttggtcctgtgtgcacaatcggcatgtcacaatgagtagacacaagggacccgctgcctggtggacctgtgtttgaatcctgcacactattaacaagctacatgttattgaaccttactaaacctcagttttcttaccagtaaaatgttaggaatagaccttgcaggactgtcatattaacaaacaaacataaggtgcttaatggatgtctggctcttagcaaatcactaactggtaatagctttctattctggatgaagttctctgggaagctggggaggcctgcatgttttatcctctttatgtttacctcgtttgcaaagtctctaggggtggcactcagtattgcggctgctttgcctttttgtgtagagaagaaaatatttccccttctggagaaagcctaagaggaattgtgtgaacttttatattcaactcttagtaaccattatctacaataaaaggtgggtaatggagctggaggagagttgagttcactatttttgacaaataccttatgtgtgggcacctgtttaacgtttcaaaagacactgtgtcttcctttggctttaaatgtatcctttgtcagttatcattgctctcattttataggtgagaaaactgagtcacatacactgggcccatccagttagtatggctgaagcagaaaaagaacttgaaagtgggcatctttcatcccatacttttcaaatgaagaagccaagactcgtcataaaccaaatcaagatgtagaaataattaatccactggccaccagatctctcctctgatgttccttttgacttcaggcatttagatctgagttccctctccttttctactcttctgcctctaagagaaagttacttctccaagaaaaatatggtagcattaaaagcagtggaatcctgaca

SEQ ID NO: 21876 - DNA, 1368 bp, Homo sapiens
acctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaaga

SEQ ID NO: 21877 - DNA, 1249 bp, Homo sapiens
tatcagatgtatttgtcatgcctagccctgtgtgtgctgggaaaactgatgattgggtaattattgaccatatgtatataatctgcttagcaaatttattttgaaaaactagtggccaatacagttttttttaagacatactgattttttttttttttgagtacaaatgagatctattcagaatgcataaagaaaatgtttttgtcattccctaaatagcaatatacgtatccatcgggatgaattattgcagctgtgtatcatacagaatttgggggaagtgtagcaatattttcctattatatactcacttataatacctgctacctggatatctgactttaacttcttagatagggagtggggaatgacgaggacctgatatttcagtcttaactctcaggctactataaccactttagatacaactctgttgaaagaaaagtagctgcttatgaatactgactccttctcttcctaacagggtctctttcacgtcggtaatatcttattatttttattcattgacttaagctctgccattgctgtggacatctttgtctacctgtgatagcaaatcttagaactcaggtcagactgaaattctcttgccccctcagcatacgtgttgaaactcagtcagatattgggagtcaggtatttttctaaaaatgtcaagttctgatttccagattctagatgtgactttagaaatattccatggattttttttctttcataaaggaactttcttgcccttcccaaatggccttttcattttgtgactacttagtatttatactttgaataaatacaatattctggttttattgcctttggatgaaaacagatgtaatgcagctaaatcaggtaaattcattgacttaagataaataccttcaatggtaagagagggtgaaagaaagcttaatttttgttgaagtattatagttaaatgctgttttgttagacatcaggaatcctaagagaaatttctattttgtttatccataggcttgtgttgtccaaaaaaaactttatttccactagaaataaagttttaataattgaatatataataaataataggctgatataatttatttaagcttgaaaacttgttctcttttgacacttttctctgaaatcagtgtttttatggcaggttttgaatggctacgatagaaaacatttaagtgtcaaagcttttcagcttatgctttttttttttttttggacggagtttcac

SEQ ID NO: 21878 - DNA, 1035 bp, Homo sapiens
ttataatacagtgtagaagaaaaaataattcagaaatacattacaaaatgatgtgggttgttagggtttgccaaaagccttattcatgtatatgatcctttgatgtaaatataaattactgaacagagaaactaagaaacttaaagctaaagtattagcagccattgactagcagcccatgtaagctagcaagaagatacaatttaggatatttgaaaaaacatctcacctgtcattttttgttaatacataaaacataaaggtacatttgtacttaaggacattggtttttgttttgttttttcttttcatatgtaaacatggtattaagatttttttaaattaaaaactttagtaagattgttgtagactctacgtattttaaagacgtgaaatctactttgttaaattatatgtattaagaagtctgctgaaaataaatgattgtttctattttttaatttttaattacattttaaagaattaaatttgacattgttgttttgatcctgggtatctcttgaaatgtgacatgtgtattgttataacctttctgttcaaaatatattggtttgttattttgtaaatatcaaaacattaaggttactttaattcattttattagtggattttaatttgaagggtatcatttttgcataggtgtatattactttatatctgacatttacatagagtattctatttatgtcgacaattaatatttgtaaacaacattggctcttttctctcatgtccggatatttatgttagtaaatatatagattaggaattggcaaactttttctgtaaagggccagataataaatactttagtctttgtgggccatatggttttggtctcagctactgaactcttattgtagcatgaaagcagctatggacaatactgaaatgaataggcatgactgtattccaataaaattttatttacaaaaacttgccactggccatattaagactgcaggccatagtttgccaacccttcatgtaggtatttatgaggtggcttgggaa

SEQ ID NO: 21879 - DNA, 1016 bp, Homo sapiens
tagtagctatgctactttagagcctttcgtagcagtacagctttgggtaaggtccttgatgtttgtgagccttaaaatgttgttgtctgtgaagaagtcgataataatactacccgtttcatagggctttggggaagagaaataatacaggtaaagctattagcttagtgcctggctaataataagtgttcattaaatgttagctgtcattttaaacaatattatttaaaataatttgtagattaatgatacaatttttataaaattttagtgtattggtttgtatctgaggatgtgaaatacatgtgtatatgtatgaatgttctatatatatagaatatttgtaaaattacattattcagaattgacagattaaaacaatgttttccttatagttaagtatttaaaaattatttttttcagtctacctaattgtgtgtcactatagacagtgacagtgctcatcacatctctatattaccatggctcctagcctggggtgttgtacctaataagtactcaataaatttgatccttgacttactcttcaaaagaaaattctttttttttttttttgaccactgacttaagataaaattaagtattaaccatctcattggagaaaagaatgccaataatataaaatatggtaatttgggaggtttttacatgtgtttaaaataaaggatgttattttcatagaatatctattagaatataaaactcaaaatgggaagaaataatgtgctaatgataagtgtttgttatatgcccttgcaaaacacttgcaaaaatatattctaggtaattaagacatcagtagggtctttgcatatgtattatcacgctttgtagtgcgtcttaacatcaaaattgtttatgtaaaagatgaagaataaccttaaagtctgtagtaatgtatgataccattgtttgcagaaaatggttgtagaagatgcattttataatgctatttcactctgcagtacaaatttttagaacatattttggggtaa

SEQ ID NO: 21880 - DNA, 1030 bp, Homo sapiens
atagtgttatttttcaactttccttcttgtaaatatgcattttaaagctataaatggtcctgtaagcatagcttaaactgcatctcacaaattttgatattacattttcattaccaattaaaaatattttaaaatttccattgtgatttcttcttttatgaataattttgttactgatttcttattattattatttttttctttttggagatggagtctcgctctgtcgcccaggctgaagtgcagtggcatggtcggctcactgccagctccacctcccgggttcacaccattgtcctgcctcagcctcctgagtagctgggactacaggcgcccgccaccacgcctggctaattttttgtatttttagtagaggcagggtttcaccttgttagccaggatggtctcgatctcctgacctcgtgatccacccgccttggcctcccaaagtgctgggattacaggcatgaaccaccgcacccggcctactgatttctaatttaattccactgtgcccggcctactgatttctaatttaattccactgtgctcagaaaatatattttatatgatttcaatcttttgatatttattgacttgctttatggcccagtatgtgattcagttcagtcaacattccttgagtacttgagaacaatgtgtattgaacagttattggattctgtaaatacaaattaggtcaaacaaattggttactagtaatgtcaaaatttttttatattcatagggttttttttcttctatacattactgagagaagtatcttaaaatctccaactgttattttggattattctgtttttccttttagttctgtcaacttttactttataaatttttgaagcagtgttgtgagatgtatacacatttatgattgttaaacattcctgttgaacttttatcgtaataaagcatctctgtttatccctaataatttaagccagctattcagtattaacgtagcaacatcatcatacttttaattagtatttgcatgatatctttttcc

SEQ ID NO: 21881 - DNA, 1027 bp, Homo sapiens
aaaaaacatgaaagttggcagaatgatactgcctcctgatttaattctcaaagtgttcatactgcacaatcatttttcattcaacaaatatttatcgagtacctctatttgctactagatgattgggggctccagtaataagcaaatataatcatgggcgcagtccttaaagaacttaaacctgtaatggggaagacataccttaaatcattacacaaacacatttgaaattacagccgtagtaagtgttatgaaggaagaatatctgaaaatgttggagcagacagtggggaccttataattctggtgctcagggaaaaagtgacatgaggtgtaattcacatgcaatagaattcattcattttaagtatatagatagattagttttgacaaatccacgtaatcaccactataatcaagataacaatgtttatccccaagaggttttccaaatatcccttttctgcccatttttaaattaagttctgtgtatgtagactgaaaaaaagggcttaaaattttaaaatgatcatatatatatatatatatatatatggatttgtaggcattctttatatattctggaacaagtcttttgttggctatatatattgcagatatcttctcccagtttgaaaattgtctttttattctctgtggtgtctgatgaacagtttctaatttaaatgaagtccaacttgccaatattttgaagggataattctgtatcctgttaaagaaatattttcctgtgtcatagtcatgataatatgaagatacatgtatattttcttgtataagttagtttattcatgatccattgcaaattaaatttgtatataatctgagataggactcaagtttcttcttttcgccatgtgatagttagttgatccagcaccatttattggaaagatcattctttaacgattagatgtaagttgtttcgttgtgacagtatatgtgggttgtttcttaattctctgttctgttggtctgtttgtctgtcgttgtattaattatgtct

SEQ ID NO: 21882 - DNA, 1035 bp, Homo sapiens
cctagctgacagtgagattctgtctcaaaagaaaaaagaatatacttatttgatgaatgctataaaataatgcaattttacagaaaataaacatactgaagttagaaaaggccaattaaaattttttttttttttttttttttttttgagacggagtctcgctctgtcgcccaggccggactgcggactgaaaatttttcatttttacctacctccttatacgagggaaaatgatttggaggtattagggcaattggagaaatttgaatgagttctgtggattaaatagtaatgatatatcaatgttaatttccccatgatggttgtcctgttatatgagggaatagccttgttttggaaagccagtactgaagtattaggagtaatgtattactgactcacaaatggttttggaaaaaagtgagtgcatatgtatgtctgtgtgtgttggtgtgtgtatttagagatgataggaaaaatgtggtaaaatactaatcattagagaatctgggagaaaaaatatacaagactttgctattgaaacttttctgtaagtttaaaattatttcacaattaaaaattgaaaagatttgacagttgagagaaggttgggcaaatgtcttaaaatgaaactacttcataaaagatcctgggtttatagattttaaaactgcaggcaacttcagtgtcctgctttaactccattattttacatatgagaccttaagagtgtggcagattagatgtaatagtagtttcacactggctttgtcaagtactaatcaacatgatactaaaattttttcttaaagggtcatgaataaaccacatctgttagtatggtttggtcagtggtcctcagaaaatctcatgtcgtgcaaccatactaatactcaagcaaaggaaaacttgaaggcctagactgaaacaggttatgtgttctaattaaaaatggctggttggttttttaaaaaatggcaagatatggaacactatattttaagttccttcctagatctctacagaataatgaaa

SEQ ID NO: 21883 - DNA, 1105 bp, Homo sapiens
gtatagagtttgaggagcgggcaaggaaggtccccatggactctggggttgtccccagagcctcttcttcccttctgcatcgccgcctattcatttattctgcagcaaatatttattgagcgcctattttaggcgctgaggctactgtggtgagtcatggtccttgccttcctggagcttacagtctaatggtggagactgtcgtgaccagttaatgtaagtcgtgataaatacacagggagctgcctcctttttaaaggatagagctgctgcagtcgctgctgtgttactgccagtcggaacacaaaggttctttattgtcctctaccccttgttgcctgcaagcaaggcagcattctaaattttactgacctagactttcagaagttgctgctgtatttagcagtttactttaaatatttttgttttgttttatgctgtgtagcaaagatcaaaatagaaaaaaaggtcaagttttagtaccactcagaccacgtagattatgctaatcggtttctgtttactgtcaggttcttcgtagtgtggcttttgacatttgcccaactgttgctttattttatgaacaaacgggcttggcagtgcctggaaatgcagtgctttcatatagtgctctgagttaagtctgcagcctggcaaacagctccaagtacgcactcacgcaaaactgcgtttctggagggctcaccttttttatttttgtacacaggaaaagtccagagtttttcttttttttttatagtttctgttacataagtctgaagatatttatcatggataatgattaattcggaggatgctgatcaattattttccattctcagctgaacagaaaaatgggctctaaattaattgccttattctacaatgggagagattgatattagatgtgagacagatattttaatggtgaagttcaatagtttgaggaatatactggagataataagttgtgaaatcattaggttgaggactggattcgtgctttttaaggactttttttggtcatccaatggttctatttaagaaataactgcatttattagcagatcatgttagtggttttttttttcccccagtaagtgaa

SEQ ID NO: 21884 - DNA, 1028 bp, Homo sapiens
ttcctaattcactgggcattgacgagggttacaggatttaaatcatgtaaagcacttagaagaggcctgaccagccctaatctactcagctccttttatcttcactgaatgaatgaatgaatgaatgaatgcaaattgagcctctacaaacatgtcgtaagtgaaaaacgcacatgcagatttgattagtgacataacaagaagtggaaaaaaatcacctcttagatgtggacatgtttagtactttatgtttgcagtttgcactgtgaaataccttttttttttccaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtatagcattgttacgcactgtgtggcatcaaatgccactcttactgttgtcacttaaccttgccctcacatggtgcctttcctccaaagagcttagaaactcactcagtgacacttctgttgggtaggtgaattatcaccctctatagcagtcattccgtaagtcttgtgattgtgccaggtgctgggatgagcactggagatacagaagagacagatatagaacacgacagctgggcacggtggcacacgcctatagtcccagccactccagaggctaaggcaggaggatcacttgagcccaggagttcaggttcagcctgggcaacatagtgagacagacagacacagaacacgatggacagctctgtgttcatggaactgcattatgggagtggagtgggaggcaaacagtcaacataaatatattgcc

SEQ ID NO: 21885 - DNA, 1017 bp, Homo sapiens
tatatagcctggacttcatcaggagaaggtttggttagtacaatatgaaaatcacctcatgtttaggtgattgcatttccaaatgccgacccagaatccctgcctggatagttcattcgctctttaaactttagatgcccaaaaatgagctcactctgtctgcctccccctctgccaccaccaccaccaagaacaaaatctgctcctcttcctttgtatcctatctcagtaaaagatgccagaatccacctacttgctcaaggcaggaacctgcagtccttctggactttttcctcttcttcgcctcccacgtgtgatctgtcagcgcatccgtcatcttaacctcctggacgcatcgcgaatcaatccactaccctcatcccacctccctagcccaaggcccagcagctctctggactccttggagtggcttcacaattggtctaccccctcccactcttacccctttttgacttgttctctgcattgaaactatgagacacttttaaaaaattcaacttttaattttgacatcattatagatttgcatacagttgtaagacataatagagatgctgtgttacccagttccccccagtaataacatcttgcaaaatactgggatcacaaccaggatattgacactgatacagtcaaggttctgaacagttccatcaccacaaggatccctcctgtagtcatttgacagttatgcccacccctctctctccctgccaccatcctaccccatccctgaccatgtgacactttttaaaaactgtatcatgagttgctcctgcttgaaattctgcagggactttctcttgttcctgaaactgtcaaatgaagaagataaaccaagcttttcaagaattaaagttagttttactcggaagtcttactgaggtcccacacaggatttcagcccacagcttgttatataggcggtggaggttcagtacatggaaaatcacatcacacttgctcagacgctacaagcagaatacatcgagcttt

SEQ ID NO: 21886 - DNA, 1083 bp, Homo sapiens
tgtttgaagtgtttgattgtcattttatttggaatgaatagacttttcatatcatactagttgccatgtgtcaattgttaaatgcaagaatttcttagtataataagccttcatagtcctcagagttatttgaagtgaacattagttcagctccttatttctgagcatgtgaagatttccttttctttgctacagaattggtttttctgatattcattataacaaaagcaagagcttgccggtttttcaggttttattactgaatgagtatcgttaatcactcgtttattctttatgctatatgtatttcctatctttctactgtaaagagaaaaagtatctaaacttgcttatctctctgtaggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccaggtaatctgaaaaactgaaaaatcagactccgacgtgcatgtatttggtaacctgtttttcctttgaccagcatagcagtgtagcctcgtggaggcagggggcaggatgtgaaagtgctgtgtgagccaccctgctgcctaggctggatgtcttggacaatggctggacatcttcgaatcaggattggacccgcagcttagttgagtccatgtaaaaatgtcacaggagaatggaatactgtgatattttgctctacaatgatattcataattctcaatgtagtacaaaaaaagatggtgatttctccccaacacctttgttccttccttctttaaaaacatgctttcttataggttctgataattttataggagatcagttggttcatcaacttgtgaactagaaaaaaaagagattctcagcagtgaggcattatatttagatctgtatgcaaaagtccaagaagccaaaatagtatagtttacaaaaaatgaagggccatggaacttacgaacttaaggtagataaataaatatacaa

SEQ ID NO: 21887 - DNA, 1044 bp, Homo sapiens
taatgcattttggaatttttttccaagggatcctaaattagatcccttggggaaaaaaaaagggatcattttggatgggaaacatttggatgggaaacctactttaattggtcgacttttaccccgagttaagaaaatcacaagtctttcaaaccctgcttaaatgcttttcctgaacatcttcctcttcctaagctatcatttttttcttatcagtaaatattcagtaatggctttcaaagaacagtaggtattaatagttgaatgttaatagaccaagatagttgcagtcatacttatttcattttgattttctatttcatggctgagtattcatgaattgcttcgctccttacacacacctgccgtgtcccatctgtgtctcctaaggagtaagtaaactgcaatgggctgagagatcaaaagtattaaaccttctaatccaaccttttactacttttccatgccattaactcttgcctctagaccatacacttaagctgtgctctcagtttttaagacgttttactctggagtaatctaaattacataatttaaaattttgctgcaccatgtagagtagattcctagtaatttagggaaattgaaattatctttttatggagagagaaaataaaaaatattccagaagcctgaaattttattcctaagaaacacaaaacttgctttatatgaaatccactataaagaataaaggcaatttcctcaaaagtattcctaaaactatataaggaacagacaaagaactttcaatagctttagaaggaaaaaaatggaaacaacagtcctacctctcttattggcatttgtaatgcattgggcagggtggaatgcatacctatataaatgtttggctttgatggtggagaggagggatgagtggaagaaaatgatacccagtgttctctacggaaagctgtattgtaccttttgctgtatatgttcctttcctgaccctttccaacgagcccgtgtcaccatgggtcattcttttcctaaatgggctctatgatgccaagtgac

SEQ ID NO: 21888 - DNA, 1034 bp, Homo sapiens
ggaaaaaggggaagatgagagactatttatactaattcattgtgaagatgtctataattgatgcagtcttggaatcatgaaaatagggatcccccccaaggccctttgttattatattaatgcctgctcattatttgtatgtcctctagcaataatgtcacttttatatgaataatgcacagttcattttgtcctggcagctaatttctcaacaatgtatttatgaggataatacagatattttagtgatttctccaaaagaaacaacaaagtttttgaattgagaaaaaaagtctaatatttaccacttagaggaatgcaacaatatatttattgagcaccttctttgagtgaaatattttcttaggataaatctcacattataagtgtgattgctcatttatgctagagtgtgtccctgtgctcaaggacagcagatatatttacataagtcattatctaatgagttagaacattttaaatatcacaagagaactataagcaaactgttagggaatttcaaatattaagtctagatcatttccagttttatagttcagggctggggaagaagccaaggaaacctttataacaaggtggattaaacttgtgccctgaagagtgaatgaaatactgatgtgtatcaatgatggaaggctagataaagaggaagactatttcagaagatcaggatccagttagagaaagagaaactactctggttacaaaggtgctagagagctgaggagcctaacagtggatggcgaggtaccccaagaagaacaagaccaagaggccaccagggtggaaggatagtggaaggaaatcattctcagagcccagaaactagcgccagttggcagaggctggccacagggaggtggagccatgaaaggagagggagactcatgggaactaggcccacggagaggccacaggaccctgtggggtactggggggtcagcaacagaggagagtctggctagtcccctccttttatcctccaaaggttcatcaatacccagcactgacca

SEQ ID NO: 21889 - DNA, 1048 bp, Homo sapiens
gggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctggtgactggtttgaactttttcttttctacttgagctgctttgaatgttgcaaaaatcccaagtactgggaacaacagtacaaaaagtatgtatttgttcttgcactattcaccattgaaacgcgtagcatggcaaccatgtacggtgtgcagcagagagaatcattttggaccttcccatcatcatagaagaaaaacatcaagtgattcaggaatagaccctactggtggtgatagaaaaatcacatcctttaccttcagtgaacttcggtgttaattcttaatataactcatgttttaatttgtttctgctcaagttaattgttctgttgactgacaggcctttcccattagagccaccaccataagggaaacttcagtaaagtgggttataggactgaacctggaaactgcagtggacacctggaattcttgtgcaattcattgaagccatcgttttatgtacttagtgaaacacacttagatttgactggcctttatccattgacttgatcatttgcttcagtttgatatagtaatggttgcagagggcaacaaaaggaaacagtcttgctaaattttgtaaaattgtttatgtatcttactatgattcattctgaattttaagaggcaaaggaattctccacttgtatttatctgtttgtttcttaatcatcacaccatatagtcttatactgtacacattgaaaacacttatataatatacctcctctaactatattttttgcttaacataaaggttattttatattagaccgtgaaatttacttttctattgattcactttgtaggcaatactttcttgttacttttctaatcattaaatgccagagcttgcctctgggaat

SEQ ID NO: 21890 - DNA, 1031 bp, Homo sapiens
aattattaaaacataaggcaatgtgccgtgctctagcatagcacagtggtctctctctaatggattttatggccttaacctctttaaaaaaaaaaaaaaaaaaacagaaataaagaaaacagagatttgtaaactaccaggatgatcagaaagccagggcaggagctaaaaaataaagaaaataatattttttagactctcaatagtggatatgggagttgattatcacaagcattatatttattttaaggaattgaattaggtggcttagtcatttgatgaagagtcctggggtccgtgaacacaccagggaagaccagaccccttcttgtgtttattccctggacatagtaaacacaggccatcccttttttctcctccaaattcagacacacttgaggccttgccattgaccctttcgggctaatttgagtctttttttttttttttaacttgtcattctctttttctttctttttcttttttttttttttttactattatactttaaattctgagatacatgtgcggaatgtgcaggtttattacataggtatacacgtgccatggtggtttgctgcatccatcaacccatcatctacattaggtatttctcctaatgctatccctaatttgagtcttgacctctccatatttccagtttggtgttgacatcataaggattgggccagggctctgtgtgtattttcgcttaataattaaattgtggtaaagcagatgacctgaacaaagtgatcttagccattgtctctgttgtctgtattataaagcaattgtcataatgaaaatttaatatttgttttcagggacccattctccttatcaggaatttccctgatttttcttgttttttcttcagatccttcttgggcctacttgtatgaccccaagtcagacaatgctgaactaaggcaatccgctgttggttaaatttgcagttgctagatcttgtagggaagaggagtgtaggctaatatgtgaatattaactccacgagggcagccattgga

SEQ ID NO: 21891 - DNA, 1052 bp, Homo sapiens
tgtcagtatttctttctcccactcagtatgtgagttatctccaggacaagcgctatttcttgttcatgtttttataacttaaacatctagtatgttacctagctcttagatttttgtcattttcaggcattcaagtatgcaccctggcaaatgtgtagggcatgatgctattgggcaccacccactttacatctgattgagattcaatggatactgagtctagagcctttcatcctacttgtcagattacattcaaattctgagtttatgtttgagtgtgtgtttgtttgtgtgtgtgtgtctatgtctatggtcattgattttttttttgttctttttttaacaatgactatctcttcttcagtagacatctagtcaataagtttcacttacccaacccttctcggccacagtaggagttacagtaggaatttccatttggaattttctttctcctaaacagtgctcaggtatacagtttattatggctggagaccattaacaaacaggtatgattacttatatgaaaaaccgtcttccaaacaactgactgcaaattgacttccagaatacaatctcttcctaatttgaagattatctgcatatgtgaaaaatgtctcattgtgaaaccatcttgagctcaatgtaagatcatccattcagcaaatcactattgaacatccatgtgtgtaacataactgtgcaagtaatatatagataaaagcataaattagacatcgattctctttgtgtgtataccctactttgttgctagcacgatatttgtgcaatgcaaatgtgccagtatccgaagccttatttgccaggcataggaggccatttgtgtctggttcttatttggctttccaacttcatctcaaggccctcaccacccagcatcttgcaggctatctacagagaactctacttgtcatttacaatctcagcttacaatttcatgctggtgcccatctacaagatgttcttcctgtctagaattcctttcccatttttctagcgttgggtgaaattcattaagtatttaccaaccc

SEQ ID NO: 21892 - DNA, 1023 bp, Homo sapiens
aggtcacactgggcccagagatcatagttttctgacctctgctctagagtttagaagggagagagagaaggaagaagggtggcttgaaaccttcatgaactaatgccttcctttagggaaaaggaagaataaccaccctcgttttaaaaaaatattaaagacatgaagttagcacctttgcttgtatggtacaactatattgtctagtcggttttttagttgttttatagtgagacctcatcacactgctgtttttcattggaaactgatgaggaacattgtaaagcagatggagcacagactgtagaaatgaaaagcacagaagaaagagctgtgtgaaagaaatatttaatcataacatgaaaaactcatagtggcaacttttccattatgttaaattttcctcatttctatgtgttctgagtatgtgcttaaaaagcgaggttgtaattttctatctttgtgcccatctcccatcggtttttgattttgtctttttgcaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgaggtacagagagacactcgttttctctataagagttttcatttcatgctaatggttagatctctgtaggccacaaattgcttggaatacagctatatagttcactaaaacatacttgtgtttctgaagttcatcttgtgtgaaagcaaatgtggcttcattaacaacaaatgtaattgctttgatcaaccaaaaagagatctatcaattaagattctgcatttgtaaaatgacatacatcatatattatcagaattagtcacactgtctccgagaaggattttttttcctagattacaagtaataaatagactaacaatattatagtgcattctaatttcatttattagcattaata

SEQ ID NO: 21893 - DNA, 1028 bp, Homo sapiens
ctatattcttatatttgtcaccctgagctattatgtaatatatccaggagtatcaaagaatatgtcaccaggtaaaagacagtgcttaaacataagattcaattacctttttgtgtgtaatttagacttctaataaaacatttttcacccttagggtaaaaacatttattcactgtcatcaatatacttgccatctattttcccccattttaaggacagctttggtaattgaataagaatgcatacttattcatagttcaccccactctgttgtgcttggtagttatacaattaaacatggcctggaaaaaacatattttattttttagtgtgaaagcattaaaatttctctgaataaatcttttttttttttttttttttttttttccttttagacagagtctttctgtcgcccgggctggagtacagtgatgcgatcttgtctcactgcaactttcacctcccgagttcaagcgattctcctgcctcagcctcccaaataaatatctgggactacaggcgcccaccaccacatccggctgatttttgtattttttagtagagatggggtttcaccatattggccaggctggtcttgaactcctgaccttatgatctacccgccttggcctcccaaagtgcaggggactaaatccctctttttgtcgtgtatagcattttaacagttcaaggactttcacatctgttgcatcattgagggccttttctgagatattccgtaaataactcaaattctataaaattgaaaatggagcacatttgtgcaagatcaaggtgttttttctcaagttttgtatggatgatttgaaatactccatcttgacaagagaaagcagcattctgatgcctttgctcctgctgtggactctcccaaaatggcgctttgtcgccagcccatagatggttcagagctaaagctgatttccccctgaacattttatagtttgtgatacaccaaatgtacatcccactctggcgggttcgaagtctctatacctacctcgctt

SEQ ID NO: 21894 - DNA, 1031 bp, Homo sapiens
gcagttctcattctagacagttgtgacaaaattatataatggggtttttatgcatctaatttttaacctcataacagaataaaatatgtgatgtaggagtgccacaccaaggctctttctcctctatctctaaactggttcatgaaatccattcacttatcctcatttccaaggcctctaccttcacttacctccatcctacaacagattcctaaacggtgtcttgtctgtgctttaacatcccaatccaccttttggaacttcttccttagcatgacagctcttcagcgctgcacccaacctttggtttaccccctcatacactaggtaaaggcccatgagaaagcgtcagtggtgggtgcagactccctgaggatgtgaattcatccagcctgttgactcacggtgacttaagtttccttcaaagtttgggtgatttatccttacggtttttaaaggcagagttctgtcttcctcctctcactcttccttcagggataaaagcagctgtggatcttctcctagaaagggcttgtctgattctatattttcattcagttaggctttattttgttctctgctatcttatggtttcaaaaagctttgattgggaacttagctggtttgttcttggcattagagtttgaataatggtctcatgactttatcccaaccagaagcagatgctttctgtagggttaagagtgtaactacaactcacaccaacaaagaacatttccagcaccctagaagcttcccttatacccacaaacaggtggtttgccctctgtccaaagtaaccactcttttttatttctgtcaccatagattagcaccccctgtttttgacttttatgtaaatggatatcaaacagtcggcactctgtgcatctggcttctattactcaacattgtacctgtgagattcatgtgtagaagtcgttcatttttgtcactgctgaatagtattctgttggaagaattaactacattttatgtatccatcctacttcacttgggcacttgaggtt

SEQ ID NO: 21895 - DNA, 1084 bp, Homo sapiens
aagcactttgagtgctactgagtatgcaaagcatatatattattgacttttcacccaagttccttctttagagaaagctgggacagctatagatgtttttactgaacagattgctaaatgacaagtgatggattgttactagctgaaaacactagatagaaaatgcatctaagacaaccaaaagggaaagatttttccaaacagaagtgctgttttacccccttaaagtttattcttacgttgtattttgttttgcaaacagacaaaaggaccagtagagctcaggaaggttttgtgttgtgcccaaggttgggggcaagaatttgaaagggatcagtgaatcagatgtaataagggctctgtttgagccacccaatctctgttttgctgacggtcagtattccagttataaaaagctgcatcggcatttccgtcagctcaaaagaactttatccctgctttcattctgacatacctattatgactttgttcactaagcagaaggaattatgggaaatggaaacttgatggcatgtttttattaaggcgttatgtgtgtatcttcactgagaaattaaagaaccaagcagaattgtatgttttcctttcaggtaacaaaaattgccttattcattccataacatggtgatttagttaacttggaaaacaaagtaacataaaatgagaagacttatgtacaaagtacattttatattttaaacaaggaatttaatgcttatgtgaatttctgttaacctaaaatcaaactaaaacataatcacagaaaactgcaaatgtattttatgggggtgggatggtgatgatttaaaaaaatgaatgttacaaaagctgtatttcactcttgtcttctctagagttgtaggcttagagagttgtacatctgtatttcaaaacaagagatacattttcaaatctagctgataatacttaacaacaaactgtatttgcaccttttattatagcagacattcttctgcaaactgcaggcaaattaacatttacaagccaaatattttttgtggtaaagtttatactttctgtgatactctatttaattatgtta

SEQ ID NO: 21896 - DNA, 1061 bp, Homo sapiens
tctttatgaaatatttgcattttgaagtttatatgtaattaattttgaaggtacaattattttatatttagtaagtgtctgctttggctagtttttttcttcttcctgtgtgcaattgaaatattgtttattattgtttagttcagtccattgtaatttcagatgcatgttttgtacttaccaacaacttttcaaatggttattatcagagagcattgtgacacaaatgaacacgcaagtcgtagaatgtggccagctcttgaatatttgatgcacaaatagggagaatgacagaatgcagccagaaacctgtcatccccctagctccacctccactagaaagctccaggatgctttctttgtcagaattggtacatatctgggtggataatcctcaaagcccagggagagtgcaatttaatgttgtggtcttcttagaacccctagcatttaagtttggtgttgccaataagaaataaagggtgctgtatcacctcatacctaagggactactgagatcttcgtatacttctcagatatcattggttatgttctcctgcagaatttaatattggagaattagacaggatgataatgatgataaagatgacaatgagagaggaaaaaagggatgatgtaacatttcttacaaagtcaggactctgggcaaacaagaaaccaattctacggctagttaccatggatttccttgaaggttgacaatgactggattatcagtgtagcattcctggcacttgagttagtgtctgggaatgtagaggagtaatccctcttccatattaggagatggaagcatatattgttgaaaaagcagtccttttgaaaaatctttttattacagttgctatagaagggattcttgttaacatgtagtgaaccaagtgccgtttttgttaattacttctttggtaattaaaattctgttttggatactcgtccatcaccctaccacttgtatcctgatatacgagtgttatgttgtataggttatcagctgtgatgcctgatagagttgggaccctagcttagatcttggctta

SEQ ID NO: 21897 - DNA, 1034 bp, Homo sapiens
gagttggtactttgtcctgaagtcagaaatagcgtcattgccctccatcgcctcagtatcctaatgagtcaccaactatggtctctgctgtcttaatctatctttagttaagttcctccccaacactctacctttcccattgctgaagttcagataccctattatttttatcaagacattgaggttaatgaatctccattttcgtttatatgtgtacatcactactttgcttatatatattaaatcatatagtgtttgcacagttccaggaggtcaacagctgattggggttctctcagcgctggaggatcctgtcagttaacctagagagttctgaggcacagaatgtatcttgagaagcatactctaaaattttaactttgaacttcattttcatgacaagcagaaatgcaaaaggaatgtaatctgtcctgcatgaaggacattttacaaatagtcagaatatattctgtgggagggatatcttttgatacaaagtttatgtccaactttgatgttgataaagctgtggtaaaaacacgtccttgcaatagccacagattcgatttggtatccagattttgcaaagcttaaatgttaatgatgttcacttttccttttctttcctttttttttttttttttttttttttttgagacagggtctcactctgttgcccaggctggagtgcagtgacgcaatctcagctcagtgcaacctccaactcccgggttcaagcaattctcctgcctcagcctcctgagtagctgggaatgtaggcacacgctgccacacccgcctaatttttgtatttttggcagagacggggtttcaccatgttggccaggctggtctcaaaatcctgacctcaagtgttccgcctgcctcagcctcccaaactggtgggattacaggcgtgagccactgtgcctggccctcactatttctttttctttgggaataggatacgtgttttgcagtttgttttcattttttctgcttagtcctctattttggaggacttttagagttaa

SEQ ID NO: 21898 - DNA, 1025 bp, Homo sapiens
gcacaccaccatgccctgctaatttttgtatttttaggaaagacaggtttttgccatgttggccaggctggtcttgaactcctgacctcagatgatccaccagccttgggctccccaagtgctgggattataggtgtaagccactgcacccggccagatataacactttcttatcccacatttgctaatggtgactgactactggcaggatattaaaattttcaagaatctcacattaactgcctgagcagagaacttgtgaataagcactgtgagttaagtaacatcttgaggatattaaagagaatgaattctactcaattcgtatctattacaacttctggttattgcttttacaataaatcctcaattaactaatctgcatagtagagaggtttttgtctggtaaattaagtcatgtagtttaccagaaacccattttaatgtgaagctttaatttcaaacatctttgtaagacgtattaggatactttggttattaagattctattaatgaatgtaattatattttaaattaagaactatacattgatgtgggtggatatttttctgaatttgaatttttatttttgagtttaaggtccatgacccagaaattagaggtgtgtgagaaaggtttactgaatgactgatataaatttgttgtcagtttgaactttccttctaggtttggagaaaaaataataataattttttaatttatgtataattgatatgttctgtttaattgagactgtattttttttctcatgaaaagcttattttgaaaatgatagcaggaatttggaagtattccagaactctgtaaaattcatagttaataatttgtttcattcagatttattttgattggcatgtgatccctatgttgtgttctgaattatctgaaatcacaacatcttgatagagtttgctctatttctgaattgttttaaatagtaactttaaaatttgcattaattgaaaggtaccttgtcacaacatttgctttgtgtcatggaaggt

SEQ ID NO: 21899 - DNA, 1053 bp, Homo sapiens
tgcctttttgtgtgccatggcatcccctttttgtggcagcaattttaatttaaagagaatattaaatagcagcataaaaatcagtaagataaagcaagccacttctcaaacttcaaaaattagaagatttatctcaaatacattgtaatttgtgagggaggaagagtacaaaaatcagatcgtgggcacatctgtaggagatgaggctgcttagtgaaccctactccgcctacaaaatttgagtaatctagttttttaaaagataaaatactgattcttctcccttcattactgagacaggtacttattatataaaacaagcagctattcctttagagtatgccagtgttaattctttcaggtagcaccggtatctttagtaaagctgggtcagttctctaagtcaggagttcacactttgaggcactcagaccttgagcattcattgtattacactgattctgtgctcaagatcaaagacaaacagggaaatgacaatcattagctggttttgtataaaaaccttgaatgtcagtgacctttggtatcatctggcttagtctacccttttgggagttgtttctaaaataggcacatccatggtcattcactctccactgaaaatcttgcagtgataactgacttcctattgaaatagtgatttcctcaagaaactttgctttgttctaagctaaaattcatgtggcttgactcaacatagtttataaaaggacactcaaaataatacctagagtctgaggagaaaatgtgctaaaacagtaaaatttaaaacatgattcaaaaatgtcacattattattttcgttgttacagatgcttgggcttcaaagcccagaaactgtttgattattaaactatcttgcctagtggcctctccctaacaagttgccttttttatatgccaggccatatggattgaaaagtaaaatttcaaaaaaaatacacctaccgaagacattaagccagggtttttcaacctcagcactgttggcattttgaaccagataattctttgatgtatagggtcgtcgtt

SEQ ID NO: 21900 - DNA, 1048 bp, Homo sapiens
tagtagatcagagtacttaagtccttgaatgtgaaagactaggtggaaagccttttgggagatgttccagtggccaatatttagaaaaaacaactaggctttctttttgtttgttttaaaattgagaacgctttgaatgtgtaaaaatgggtgctaacagaaattgggaaacacatgcttggcctgtgttctgaaaaccaggataaaggggtgtggttttcctttttctgagataaaagcctgctgtaaattttggcagcaatattttattataataagatcaattcgcagcacattcaggcttattttgaatgagaattgagtttgactaaagaaaataatgtccttccaaatgaaaatgaaaatgagcagatgtacaaaatgaaccttaaaattaatcttggatttacccctccctgtatgcatcatttagcagtcagtgaaagtgatgagggtggggaagaaactgctgtgtagccttaaaaaaaaaatcactacaggcatattttcggggtttgaaggaaacaactgtgttagagactgagttgcttttctgcttagaaacatgcaaataaaatattcctcttttaaagatagttttacctttcacttgttactacatcattcttaaaattgagaaatctttgaatttaacataagttttatctcccccacctcccgccatcctgtaactgaatgctgtctattattttaatcatgttcatctactacttagtgtaaattgctgctctgtggctgcctgagaacaaaagtgctttcagttcttccttcttcagtgaaccagggcttcacatcatgcatggtcttgcaaacagttaggggtttagtctgagctgatcaataaattcagaaccctttatttagtgagatcgatacagtggaatgaagcctgtgcttcaattcccttccaagcatcactgccagggtaggaaggtgtctgtttttctttctaaagcacgatcaaaattatgtttgaggttttttcttatgagccaggatggagcaatgcatttgaaccccctccaaa

SEQ ID NO: 21901 - DNA, 1928 bp, Homo sapiens
agtacaggaaaaaaatcaagggctttttctaggtcagatcttaatataaaatcaccactgcagtgattgatgttctgtgtgaagattctgtcaaatgttctgtaacttgcccagatgtgagggaaggtggtgtcaattaaaacccatgatgagcttgcactgagatctcgctacctctttactcctgtggcctctttttcccacaaagttggggtataacaattactcagagtgttagattattgaaaactgacagaatatttactatctgataatttttttttagttcctagcagttgtatgttttagtatttttgaaaaaaaatcaagatgatataattctaaatttgtgaatagaccagatgaaacttctaagggaattataactttcaaatactgaagaacttaaaatatcttttttgtcctttttggtgtaagttattttacgaacaaattatgtggtatttattggtcctacatggcatttgctctcttggatttttggaactgtttattggttatgtctggttagccgaggaaatggtgtaaggagctgtttttattaataaaaataaagattccattgaatggattagcgtgcgtgtccatgcatgtggtgtctgattctaaatttttaattaacttttgctttttcaagggtacctcatcaaaacttgggattgccaaaacttaataagtctcaccctcctatggaaatttagtcattttactactctagaccactttgaaagaggggttattgctctgacagtctaattccacttcagaaagtcttggcagcattacagccctctgtgcccctaaggaggtaacagaattttcaacttcagtcactggggacagagcccaaatcctctcccgcagggctccctggaagaggcctgctcagcagccatgcgcacatctggatgcgctccattttctcaggacttgtgccagtgaattctgtcttctgcatctcagctaggcttggtgccatggtttcacaggtgtctctgatttggagtggatatatacctatgtctttcagagcagtagttgtcagaatgttatgtcggaaatacattttacatcacgatactgcacttacatgtgtatttcacaagatgtgagacttacttttgactgtgatatactccattttccattccattcctttctaaattatagcaataatgcgttgctgtctgcactttgaaaagcatttcctcctccttgctttcttgggtggagggagtacttagcccctgagtctctcagaagtgtttctgtctttcctgcagcagtgtggacctctgatgaccagccaggacttgctcatgcccacagtccttcagttagtcctgagccaactacaaaatgatcacgatgcttctgactaatatttattgaaacctgtatcctagacatgaaaatgttttacgtgaattagtttctttatgctctacaatcatctgtgaggtacaggcatggtgattgtgtatctgttttacaaatggaaacggaagacaagagaggttcattattctgctaaggaagcagcagagcagggacactgtgcttaatgtcacattattgcaacagttctgctttggtggcctaataacgcttttcttatgtagttctagatgtcctaaaaatgaataataagaaagatctataaattatgtttactgggacatagacagtagagtcatttagttttttaaaatttaattaattaattaattgatttttggagataaatgtacgatcccagctcactgcagctgcagcctcctgagctcaagtgatcttcctgcctcagcctcctgagtagctgagactacagacatgcaaccaccacacccaactaattttttaattttttgtagagacagaagctcactatgttgtccaggctgttc

SEQ ID NO: 21902 - DNA, 1026 bp, Homo sapiens
tgacctaatcacctcccacaaattccacctcctaatactatcacattgttgatgaggatttcaacatgtgaaatttagggggatacaaccattcagaccatagtacttgtctcttcactttcttggtaatttcctttgatgcacaaatgtttttaattttaatgaagttcaacctacctgttttttgtctggttactcttgcttttgatattgtatctaaaaatccattgcaaaatccaaggtcatgaagatttacccctatatttttttctaagagttgtatggttttaaaacactcatatttaggtaattgatctatttttaaaattgttgtgtatagtgttaggaagaggcctaatttcattctctgaatatgtttgaagatagagttgacaggatatgatggactgaatgtgtatgtgggagagaggaagggttcagggatgactacatgtggtgtttgagcactgtgaaggatgtgactgactgtgatagagaagatcgggagcttggtttgaatctgttgagatgaagatcagagatgtcaagaagacatttggatatgagtctggggttctgtggaaagggcttggctacagagttgggagtactcagtatacaaacagtaagtaaaaccttgacacagggtaataaaatcactgtggagctgaatgtgaggacgagaagcctaagaaagaaaaaacagtttaaatatcaagcctttgagaactgtagtgttaggaagttagagttaaggggagaaatggagactgagtaagagtgatcagtgaggtaggagaggaatcagtaggctgtgatgtcttagaaggtaagtgagggagtgtttcaaaggaaaggagtgatcatctgtgccaaatgctatggaagagtccactcagatgaggactgagaagtcaccattggatttagcaacatggaggcaactggtgttttagataaaaactcttcaggacaaggatcagaagcttgatttgagtgtgttcaacagtcaggtggagtctggaa

SEQ ID NO: 21903 - DNA, 1066 bp, Homo sapiens
tattttcctgcctcagcctcccaagtagctgggactacaggtgtgtgccaacatgcccagctaatttttgtattttttggtagagatggggtttcactgtgttggccaggctggtctcgaactcctgaccttaggtgatatgcccgccttggcctaccaaagtgctgggattacaggcgtgaccactgtgcccggccagctttactttttaaagagttcccaaaccaaatgatgaccacagcaacagtcttaacagttttcaaagttagaaagcaaaccaggctctgctctggaagagtcatccaggtgaaattgtttctcagtgttccaaagaacacagtagagagcttgtggtatgtgagggatggactgatagtgggcagagaaaacattcttcattttaacctttcctggatgctggtcagtctaagcctcttgtctataatctgcaagctttgaactaaacaaagttgaaagggggaagtggaaacataaagatactgaatatgctagatgagaaaaaaggcacctcaagaaggacaaggatcattggacatttctgaaccttgtgctaggtgacagtatctcagatgccagctttctgaaagaaaacccggtatgcatgaggtaccccaaatggtaaataggaagtgctaaacaacctcccactgggagcctctccccagttgggttttggtttgcagccagcctgttcaaacctgctttccctttgagactttcccttcgtctcccttggatctgacagcccagtgttatcaccatgttgggtttggtctggtggttgactggtggaacaggtgttttcagtctcgggccccactggctctttctctgccatttactatggagttgctttggccaaagacggctgcctcaagggaagatttcttgttcacttgtaaaggccatccagaccacttggtggaggctgacccttgagccagtggtcgagctgtcagaatccatgctgtccccaccttgcccaagtgagacccttgctagtgttcttgaactcagtgttattaaaaaataacaaacattgctc

SEQ ID NO: 21904 - DNA, 1035 bp, Homo sapiens
gtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccccccttttttttttgagacggagtctcgctctgacgcacaggctggagtgcagtggctccgatctctgctcactgaaagctccgcctcccgggttcacgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtatccagaagccagttttatctaacggctactgaaacacccactgtgttttgctcactccctcactcaccgatcaaaac

SEQ ID NO: 21905 - DNA, 1030 bp, Homo sapiens
ttcacattataaactcttattcttctgaattttttcaaccattttaaaatacaaagtcttagctcataggccatacaaaaatatgtagtgctctgggtttggggattttgccaatgcactatagggtcttttagactggaagaattgttgttgttcttcttagtttaattatcatgtattttcaatctcccacaattatgatttagaataagaattcttaataggcaagatacaaagtagtttcaataaagataaatcttttctaggaaagcagtctgtttttctcatgtttttatgtacacaattctttttttacatttcatgtaggaaaattatttttaggggaatcagtaaattttttcaaagtctttgtcttaaatgtcagtgattttttttctttatgtactgcttaactcataattctaagtactttattttgatgggcagaattcaattagtgagatataatgaaaaaatacagatgattgcttctgattctaaaacctaagctatctggtgacatgttaacttagaacagccaagataattcatgggaaaccatgcttagtggatttattttccactttgatccttaggtcgtaagaaataaatgatgattattttattctatgtatgctaaagtaagttattttatttttatttttaaattcagctgtattgctaactttagtatgtggagtttttggtgcaactaaagggaaacgttttcctgaagatttagcacagcaaaacttaattatatcaaacacagaagcacctggagacgatagagtggtaagtaatttttaaataaatatgtatttgtatctccgataatttaattcatcctcataaactcatttcaaaatttaggagttaatttatatttttaattgaatcagatttcataggcatagatattgtctgtcaatattcatatgtttatatagtggtaatttattaaacttcttaatccagatgtattattttagttatcttttttccactctagtgtcatagtttaaacttg

SEQ ID NO: 21906 - DNA, 1050 bp, Homo sapiens
tgtgtatccactgtgaatgtttcattggataaattatagacaatgccaaagtataattctcaagttttcaaaaatgtaattttcataaaaacaggtagtgggcatggatggataaaggttttaactcattcatgaaggaaccagcaaaaagacaagttgattcctaagaagaaatgagactctggatggattttgataaaagaaaagcagcaattagatggctcagttagatgccttagagggcaattaaaacacacatttggggccgggcatggtggttcacgcctgtaatcccagcatttagggatgccaagggaggtggatcacctgagttcaggagttcgagaccagcctaagatggcagaaccccatctttactaaagaaaaaaatacaaaaattagctgattatggtggcacgtgcctgtagtcccagctacatgggaggctgaggcaggagaatcgcttgaaccaaagaggcagaggttgcagtaagccaagattgcgccactgctctccagcctgggtgacagaatgaggcaagactctgtctcaaaaataaaataaaagaaaataaaatactggagatatcttttctatgagacagaaaatgaaatcattgcaccttttggttttgtgaaagtcaacatcaaactttacaagagttataaaatgcctgggccatagtcagtagtaactgataagccaaataaaggcaacttcccatactcagatgaccgttagcccagcctgttagacagtgctccaagcaggaccataagaatactgtcatctgtttgcattactttttgaatcagagtaattttccttagtaagagtgaaatatgaaaatatttccggaatttcgtttgtccaactctatgaaactacctgcagaagttgttggaccattcttggtagaggcttagcacgggatccactctctgtttagcaagggataaaagtcagtattaacaacatgtgaacatagaatttatgcagcactggtcaggatgacaaatgttcacttgccatttgaaatgccagatgta

SEQ ID NO: 21907 - DNA, 1066 bp, Homo sapiens
aagcactatagagttcagtttttaaagatagcacaattaaccagattcaataggtaaggcatgtgctctcaattgtgtgtgtggactcaaagggaaacaaatgttcaagacaaccagcagtcccaattttcagagagagcaaggtaacaccacatagcatgagaacaggagaagttgagggacagaaattattctgctctaatgaatagaaacatatgccagatacatgaaatatatattatccacctgcttcctttttctaatgtaaatactctttttcaaagttgtccaaaaatggaaggtagttgcgttgtttcctgcttctcattgttttctctcctagctcttttttcttcttgctgaagtacatcctttactatatttttttcaattgtggaatgtgaattttaaactctctcagttttgttgttctgaaaaatattttaatattggcctcatacttaagtgacactttgacttggtttaaaattctgagtcaacagcttctttcccatggcactgtgcagctattaacccattatcttctggtatctcttcttgctgatgcttcttgttctgtcgattaacgattgtccttttgtagttaatatatttaggtagcttttatagtaccctaaattgagttctacagtgttagtacaatgtgtatgccgtggatttttttatatttgtctagttctgcagtcagaaaatactttcaatctgaaaagccatgtttttctttaattctggagtattctcagctattaatctctttaactattgcttctctgccattctgtctattctcttttttagaatccctggtaggtaaatgttgctgtttattttctactggaatttgagctgtaatttcattcttgtttaattggttacccctctttatgtctttgaagattctaaacatacctgtttcagagacgtcttggatagaatgaattaatcttttgactggtgcttttgttggttttccttcttagtgttaatcttgattatttgggaattttagtttgcaggcttatattaaatgagaggtgtttgcttt

SEQ ID NO: 21908 - DNA, 1020 bp, Homo sapiens
tcattaaggaaattattgtccacatttttgccctgcagacagtacactttaaactcggttcttaaatgttatgttacatataataaaaactcagttttttaaaacattgacgacagaataattttccatgctcagaatactttgttttctaagacaggaagagtcttaagtgttttttccatgtatagacaccatctagcctgtcaaatattcctttagttattctggagaactaagatgcactacattattttactcatgccttgctcttgaaatttctcaattggactttcttattctattgctgttttaatttatatataataataaattaagggcaattatttaaactaataaaatggcaatgagatttcataaatatatagatgaaagctctgctgaaataaagatttgtctcatgtatataatatctactttctaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgaggtaaagtctaaaatgtgtgtactgtattagcaatgatgatgcttggccattttgtctctcatttgcaattcacgtaaccttttctgctttctgagtttgtcaccaatgctctggctactccctaatagcacataattgacttgaaacaaaaaatattttcatagaataaataatattggattccattagattgttcctggtattatggttttactatttttttttcccccacaacagtaccactttgaagaacagtttttttttttttttttttgagacagcatctcactttgccacccaggctgaagtgcagtggcgtaatctcggctcactgcaatctctggctccggggttcaagtgatcctcccaccttagcctcctgagtagctgggatcacaggcacgcaccatgatacccagcta

SEQ ID NO: 21909 - DNA, 1040 bp, Homo sapiens
gctgaggtggagtatcgcttgaaccttggaggcggaggttgcagtgagccgagatcgcaccactgcactccagcccaggcaacagagcgagactttgtctcaaaaaaaaaaaaaaaaaaaaaaaaagaaaaaaggttatgaatgtgacaaaagggagacagcagtttattttggaagggaaaggacgatgtcagagagaggtgtcatcagaactgggtcttacaagatagctgagagagaacagcatcaccacaagggaggctctgtgtattcccggactggagagtggtcggctctgcccagagagggtgtgttaagtggcgtgtatgggaaatgaagctggctagaagggtcttgtgtaaaggactgaggaatctgagggccttgtgggttccatcattcctaggcatccatgaggtgagcttcagagggagaagagcctgtgagcttacatgcagacagttgatttatgagcctgtatgcatttctctcaggtgacagtgcatgattttcaaagggtctaggggcaaaaaaaaaaaaagcaaaaataaacaaaaaacaccactgctttagggaaatggagaaccatcgaaggctttaggcaggtgaatgatggactaggattgtattttaggaagattattcacatgagaagctgaacaatgggtgagaatggagaaatactgggatcagcaggagaccaatgaggagcttgctgcaggaagccgacgggcaacaacaagggcaagtgccaaggctgtggcgttggagagaggagaaggcacaaaaaagaacctacagggtgccattggccagatgtggcgaccagttgaggggtgagggttaatttccaggtttctgacttggtgaccatgaactgaagtgtgatacagagtaaccgtcgcatttggaggatggggaagttagtgggttccgtttgggccgttttgtttgaagttcaagagggttaacttggggtctgcctttagtaagagatccggactgaacatcagaggaagtgagaggggaagaaggctgag

SEQ ID NO: 21910 - DNA, 1035 bp, Homo sapiens
ctgatgccctgtgaaatttgtaactggggtttccaagcacttctttggaattggaccttctcttgtggcttctgtttcctccttgatacccagcctggaacctttgcccgtcccaacaccctctgcttagcagccgtggcagggcctctttcattcagcagtcttgcaggtggcgtgagtctctgccctgaagtactgtcctgactcctaggcagcatccccaccaactccattgtgacaatgactgaatattgatgttaggtaaaggtgtgcaatggaggtgcttagttttctttggctcctctcacatacttcctatctaattcgcaggattctctcatttccctatggtcagagggtttagcttctacattgtctctcattggagcagattactcaacattcaaagaatatcttcacattttcctaaagtgtctgctagagtttcactttctgtagtacattgtttgtgatccaggagacagacggtagtttaatgagctgtttccgtctctcatttcactcattgcatgttgatgtcattctcttaggccagcttccctacatagcaggaaacctgtgtgtcatggtttctagatttgcgtctcagaactttgctccagaaagggactgaaatgtgatctctctggttccacattcaaaaatcctgagcctgtgactgtctcgtgggtcaggtgctcatctctaatcgctcatagctacagttattagctatttctatgggccagggattgttctcagcaccttacacattttgtcttattgaagtttaaaaatgacagtatgaagtaggcatagatggcaagctacatcgtgtcctgccctgtatcacacagctacagtgtgttggagcaaggatttgaactcaggcatttgactttggtgccctgtatgcagtttaatttgctgactctaaagataatggacctaatgtaataatagctccagggctcccccggggctgcagcccacaggctgggaatgactaacttaaaggtttagaatgagctgtat

SEQ ID NO: 21911 - DNA, 1050 bp, Homo sapiens
taagagaatgtagataatggtttgttttcctgagtctagttgtgattgttcgttttgtagatctgtttatttttgttgatgttacttgttaactctttttccccccaatttgcagagccgtcttaatctatcgctgattttcccttaggcacatgagttgaccacgctaagggggggtttccaaaattcccatgccattgtcttctctcttccagtgctgcttttgagaagtctgttgaccatcctgatggcagttactgttcatggaccagttttttctggagacttttgggatctttttgtatttttaaattttacaaagagcatcttggagctttgtttttcttctcttgctgggagcagtcctatcagtatggaatatcttacccttcatttctccaaaatatttttatattatttctttgataatttgtcttcctattattttcctttctttttggaactcctattatgtattatttctctctcgtttttcaattctttttctttcctttctatctttctgggagattgctctgactttactacaatgctttgatttgattttttaaattttggcaaacttatttttaagaattcttttttttttcttttcttactgttactgtctccctcaaataagaatgccttatcttcctttccaggaatattgaagataaataagtaactctaaggtgtaaatcaatgaacttgactagacactgtcacaaaactcataacaatagtaatcttaagcagttttggtgggagtgacagaaacccaattcatgcttattgcacttgctgctaccactagcaaggtaggagtccccatagagagagaagccctttttttaaaaacaaaaacaaaaagaaaaaaacaagaattttggtatatatgtagatatatatatttaaagaatcaggccaggcatggtggctcacgcctgtaatcccagcactttgggaggttgaggtgggaggattgcttgagccgaggagttggagaccagcctggcaagaccctgtctctacaaaaaatacaaaatt

SEQ ID NO: 21912 - DNA, 1051 bp, Homo sapiens
tgttcagttagtttcattctatttgataggtgggtatttcaactttttttttgtttttattcttaaaaaatcagtttgtttttgtcagtttttatagtaggcaatattttatatttctgttttgcgtttggacgtgctgattgagtcagtttatgtttattgggcacttccccaattctgaatattattttattaaataaaaaaaagcttactgtgttatgacattctttctctatttttcttttatagccaacacatatctctttatggtacaagctcgaggtataatgttgagagaaaatgtgaaaacaataggtcatatgatcaggctgtacacaaataaaaacagtacgctcaacggtacaggtaagactacttcctgcttaaccccttgtagttacaaagcagtaaaccaaatcttttacagtctgttttgccttcaggtaacttcctgttaaagatgaagaaggtatcttcccctaagcgtcctggtagattattttactgtgcaaatcaagactgttacctattttaggatgtatgaacgtgtggtcacaaaagtgatgaggttttgtacagacacttaagttaattcttgtaaacaaaatatagaaagcagcttctactttttcaattcgtatgttgtatttaagagaaattaaccagagaataatttattcatcttagtaagccatactaccatctctctttatgttcattctagttcctaagttgttcttccaactaggtctagaaaatagttgtttttaattatagaagattgttaatagtgttatggcctttttaaggagctaaaggagaaattttataaaattggaaattggtagctactcctttttattttacttatttatttttttagacagagtctcgctctgttgcccaggctggagtgcagtggcgcaatcttggctcactgcaagctccatctaccaggttcacgccattctcacgcctcagtctcccaagtagctgggattacaggcgcccatcaccacgcccggctaatttttttttaaatttttgatag

SEQ ID NO: 21913 - DNA, 1031 bp, Homo sapiens
aaacattcactaggattctgatcttcgaagtgcacttcttttggaacaggcagcacattgctttataaacatgaaaagtcccatggttagaaaatatgcatttcatatgatattggcaggccatcgatttagtaaagcagggcaggtgagtgcatttgctttacaatgaaaagttgctatttattttataaatgtgtgtcatttgtccatttttattatttaaaaaggatcttaaaaactaaattttgttctgaggtaatgtattggtaagggcgtgagatttggatttagacaaatctggctataaattttgatcttctactcacaactttggtcaagctacttctctgagcctcggggtttttttatttataaaatttgtaattttatccaaattttggttaggttaaactaaatcacatttgtgaaaggccagatagattgtatgcattcaagcaggaatgcattctccctatttcagctgtgatcttctgttctctttcaaagtactttttaaaaaaatcctgctctttctgtttcagagtgctttataatgctattgactaaatacttaatgtatagacatcttctgtctgttgtctcttgaagcagctgagttgctgggatctttactgatgtagagagatttatccggccccagttgtcctagaaccattagtcggagagagctagctttcttggaggctgagagtagcagtagggagatgatgatttactataaatataaatggaaacttggattaaacaaccatctctatatttcagagagtatactaggagctgaacattcacccataaagtcaacatggtcttacgtcttaaggagcttttgatctattaggggcatatgaggatcttttaaagatttagttaatatgaatttactaagtatgaaatgtaactatgaacatccttaatttttctaagtctgtgctaaccaaagcatcccagtgttttacacaatgtacattatttcaaaggtacaaagaagtaaagatgttcagaaatta

SEQ ID NO: 21914 - DNA, 1048 bp, Homo sapiens
aagtgatccatccgcctaagcctcccaaagtgctgggattacaggcatgcgtcaccacacccggccagttcagcatatttttggtgggaaaagataactgtcaaatactacagtgacaaagaggaaggggaaacatgagtagctctagaaaacagaagattaaaaaatctggacaaaataaaagtgatggacaacacacctaaccactaggcctgaccaaacattcacccataagcacattgtatatacgtgcacccactcacactgccacacaacattcacgtagacgcccaaaggaggacaaatccaaatgtctgctctggaatttccatggcaaatctgagtttaggcaaaagtgaagacctccctggggtctaaacaaatcttaggaggcagtctttgctccccatgtagccagtggtgcccttatatttgcctgagcctttcgtaattgtctggacaccagaattcattcttcattttcctggagtttaactgctaaatcttatctgatctaactttacctgtaatggaagcctctcccttttgatctctgtattccccatgttctttcaggaaaaacacatcccaaaacagtggtcattagagggtgttcagaaattggaaagtagaaagagaataatataaatacaataaagaaatgcctgttactctcatgatttctctgagaccagttggccaaggatccactagtctttaaggatatgttttaaaggccttaattgaaggtactgcagtctttgctcacaagagccaagtaagacagtgctacttggaggtttctgtaagactcttactcattacttaacttgaattctaggtgctcttttgacctctctgacttcagtccttccagagtcagatcacccatcttctctgaagagtgactgggctacaaatgtgtttttcaagtctgcattaggctatgaagtttatacatgtgtatccagttaaaaaaaaaacagcaaatttcattccaacttttagtttcccatctaaactgtaagactgtttcttcttttgaaat

SEQ ID NO: 21915 - DNA, 1064 bp, Homo sapiens
tttttcccaattgacatgtctaatttttctaaaatgaggaaggtctaatgtatctatttttttcaacttttgttatctattttatcatccattatcctgtttactcttacagcattatgtgttaaatccaagcatagtctttgaatggtatattttgggctgcatcttattttaaaaggaaggaagaccatattacccttccttaccaggtaaaacagtacattctgcatgtttttgttttgttttgttttgaggcagggtctcattatgtcacccatgctggagttcagtggctctctcttggcttactgcaacctctgcctcctgggctcaagcgatcctcctacctcagcctcccgagtagcggggactacaggtgtgggctaccatgcccggttaattttgcattttttgtagagatgaggttttctcatgttgcccaggctggtctcgaactcctgggctcaagtgatcagcctgcctcggcctcccaaagtgctgggattacaggcgtgagccactgaacatggccagaaaactttagtaggaaaacatggttgctatttcaattccaaagaaagaacatgtagagatggaaagggatatgaggaaaatagtgatttttatcccaagataagtccaagaaaattttttgttttttgtttgttcgttttgagacagggtcttgctctgtcgctgcccaggctggagtgcagtggcaccatcttggctcactgcagctttgacctcctgggttcaagcgatcttcccacctcagcctctcgagtagccagcgctacagcctcatgtcccactcccgactaatttttgtactttttgtagagacagggtttgctatgtttcccaggctggtctccaactcctgggctcaagtgatccctccacctcagcctcccaaagtgctgggattacaggcatgagccaccacgcccagccacaagctaccagttactactagtatttagaaagttattgcaatttaagagtatgtctgtgtatgtctgtatgtgtatgtattttgctttttaatttatttttaatta

SEQ ID NO: 21916 - DNA, 1035 bp, Homo sapiens
caatgatcagacctcacaatttgttaaaagagcagtgccacgttccttggatgcgaggtgaaattttgagttctgcacatcattagtgagtctgatagttttcctctaggcaggtttcatggactcatatctaagtcttagggaaacagtgaaatgtaaagggaaaagcaaagaaattactcttatataagctttccatgcaacactggtaatactgctttgaagaaacgagttctcttccgtttgtcacaaaacttagcatcgtttcagggaacatgggacagctccagcataccagctgcatccagcagcacccagcttcacctaggctgcagccctggccaccaacagcggcagcacaagcagtagtgaccctccactgaaaaacaccctcatgacagccacgtccccggcacaatcacagattatccaccacgacacagctgcactgccagatctgtgggcactggccccgggtgaggattaggctattgttagctatcaaggctgactgagcacggtatgccagactctgggctaaactctggcaacatagtgacaaataagacacacttggtctctgcccttgtggcacttgcattttggaaaggtcttggcaggtgtcttagtttcctagggctgctgtaacaaaatgccacaaactgggtggctcacacaacaggaatttactgtctctcagttctgggggccagaagaccaagattaaggtgtcaagattaagtgttgtttccttctgagggggctgtgagagagaatctgtttcatgcctctcacctatggtgtttgctgcagtctttggtgtcccttggcatgtagaagcatcaccctgatctctccctcatcttcacatgatgttccccttgtatgcatgtctgtgtcccaatgcccccttctataagacgtcactcatattaggggcccaccctactctagtatgacctcatcttaattaattacatctacaaggactctatttccaagtaagatcacattctgaggtactagaggctaaga

SEQ ID NO: 21917 - DNA, 1010 bp, Homo sapiens
gcagccttgaactcccaggctcaagtgatcctgccacctcagcttcccgagtaactgggactacaggcacttgccaccacacctgcctaatttttgtattttttatggaaatggggttttgctgtgtgcccagactggtcttgaactcctgagatagagccatttgcctgctttggcctcccaaagtgctggaattacaggtatgagccaccacccctggcaggatgaattatttcagacctttccacatgaaaagcctcccctaccaccctgctgtacccctactcccagtttcataagaattgcttacttgaatttcaggttagaggtatctaaaagtatttttaccatttttcagctcttagcacaatgcctggcatgtagaaagcacccaataagcatttaataaatgaatgagcaaatctcagtattaaaaattataaggtccaagatatctatattactacagcagtgtatgagctctgcaagtctgaaatagaatgtcacttttgtttcatttgaggcagacattatatttttaaatatgtaaattggaactaagatggcaggtcttaatattagcagaaggaaaaacagagactatcatgatttataaaataatgattcttagggtcattagttacccatattctaaataaagtatttctggaaagtacaactcatttttcgatttttcacctttttgctagttcttttcattctgaagttaagatgtctcctttacatattatgtgtttccatgtcactggatttttaatctttggtattatcatgctcttcatatgactcctgagtatatggactagaatgccatgaatcttagaaactagtcaactcttagcaaagacctgatggcatagtcagcttaccatttatccatcctctcatctctgggcaccacggattttacttctaagcaaacaagccacttggtccaaataatgttacaaaactacgactgctaatttggtacagttgtcatcttccta

SEQ ID NO: 21918 - DNA, 1026 bp, Homo sapiens
ttttttttactaaagatttctcttgaaatgttctgaccatttttaagttaaactccctcattttcagtaggggtagcccctgataacattcattttgtatatacaattaagtatgaatcaccaactttttcagtcatttaaccaccatgaaatacccccagtaatgtaggactttatgtttctgtatcatttccatgtctgggtctgctagtatgtgttcctggccctaatgcaaacatgagctatgtcctgtctccttctctacttttcttccacaatacagatcatcctctctttaagctcttataagaaaagtcaaccatcaagtaggtccgaagaagtgtttgacaaaaaaattgcctgagatgcctaatattcaagataattaattttaaaaactagatatttgcaactgatctttttctttttttctcattttaaattagaccaccagaaagtaatgcacctgagattttcatgattactctctgtttttaatttgattgatttctactctgattttcctaattctacttactttcagttaagtttctttgtctagcttcttaaagtaaaaatttagataactgattttaaaccttgtttctcctaataaaagcaaatatgttataaggtattatctaagcatagctttaggtatatcacacatattttaatatttttatctttttattttcattctaccgtaaatgttcaaatttcccattcagtttctttttttaacccatgagatatttagaaatgtgttctttaattcacaaatatttaaggattttctcgatatcttagtgtcattggtttacaatgaagtctatgttggtcagagaacatacgttgtacaaattcatttttgtaatttactggagcttatattataatttattgtctatttaggtgaagttcttttgcatttgaaaaggatgtatattctgcaattgttagacacaaaatctataatctcaattatgttaagataattgttcttttctacaacttctataaact

SEQ ID NO: 21919 - DNA, 1050 bp, Homo sapiens
agaacatcagtgcagcaagagcttggagaatgggggggctactggaaaaaaatgagtctgaaaaagtaaagagggccacatttcaaaagtccttataaattatacttataaatttgactattgtcactactatgagtagtgaggataagattttagttttaaaactgttgagaactggatgagccaaggtggagtcaaggagacaatttaaaatgcctttgaaataatctaagcaaggtattttgttgactttgtttctggcatggggacctgggtgagtggtactacaagtcactaaggtaggtttctgtgtggatggcactggcctcaagctgctgtgacacccagtttgaagataattgcctctcctagtccatgctttcacagcaccctctattcttcccacttcagtacctaaatgtagtattatgattaatttcagtattagcacttaacgctctctatggtgaaacctgagttccagtctttatgaaatattgtctttgtctggtctgagtgcagtggtgtttacaattaattgatcacacacagttacagatttctttattccttgtccattcccattgcttcacttgacaggcctaaaaataaaaataataataaaaaaagaaatgtcatcatcgaacaggtttttcttctatgtagaaagttcattgtgtctgctttccttatcctgccccacccctctaccctgcccttgccatcacacaaacacagacacacacgcacctgcacatgtcatgttgacgtggtgtgcttctatccattacttagactgtgtcagggctatgaagtctttaagacattaatatttagcacaatttctagcagatgtttactaaatcagactagctgaaaggtaacaaagggaatattgttcttagctaatgctataggtatgggaagaataaaaggtaaggacaattatgtagtttggaattgcgtagtagaacaaacctacagtccgtgattaggaaatgtagttcgcattatttgcagcgctaaaaaattagtgctttggaatgcatg

SEQ ID NO: 21920 - DNA, 1155 bp, Homo sapiens
acattattttatttggtcctaacaaaaattctttaagatcaacagagggttggttatgttcacttaacagataggaaagctcagatttgaagtgctgacttgtgtccaataacacattttaagtgcaagagcgaaaacctcacgtacttcattttaatactgaatatttattcttctacattgcaatttctgttgtcagagattgtaaaatttttattaaataattttgattaattatagtccctaaaacatatattttaggggtaagatggagtgcaaatggaaggggaaaataagataattagtggatattaagtaatgggatgataaggactgaaaattccacttaatttattttggaaaagcaaaatatttgcccaacacatattcctataagggagtacttgtgttgagacctttggctcagtggttctacattgctgctgctgatttcagggctgctgtccatttggctttatttcccatagtctgatcactcctgttggatcaagtcaagagatagctgtggtttctcttctccatttacttcatttgggttcagtttttcatctttcatccatacctcacccagcaatgagtgattgaggaatgagtgagatgtaaaaaatatcaaaggtaaatcactcttctctaccttttcagaagcaagggttcaatgctaatagaaaagacaatatagcatccataagtaaattctcccgtaattctatgatataaagttgattgaatgattaatggcattatatttgacaaatttgaaaatgtccaaccagttctgtatattagcaacgtttttggtttgggattttcatttacttcaaatattcaagacattttattctggatatagatagtttcttatatgaatatgcactatggctttctatctgctagtataaaagtccaagtggctttcttctatgacaatagctatagacatattttccatctacctgcctatttttattttgatatacaaaaaagttggacatttgagtaaaattgaatatgttattctatttttaaaagtcatataaccccttctttaacacattctgcattcaaaccagattaaatttatttcttagaaattttgaaaatttcaaatggggaatggaatggaaatggcaggca

SEQ ID NO: 21921 - DNA, 1026 bp, Homo sapiens
tagtgctattaaggccatagactgttgggccagactttaattcttaatactaatgctgaatttggctagtcataggtaggattagctagataactattgcaattataatggttcccattaagtttaagatttcttctaattcttaaacattagcttatagagcatgcatgatgattatgtttattgaccttctttttctcctttttcctacatggccaagaaaccatacttatataactaatcattaaagtgtatcatactgtcttaacaatattatcaatagatctagtggtcattttatttactttgcctttttgcaaatctttctatgttttcactctgcaggaaatggtggtcctttaatgttggattaacttttgaatgcatttgttttttctatctgcagtatatcattccttgaaatatctaggcatttataaagcttaaactttattgtaatctgatttgactttagataaaattggagggtatatatattatttcttatgagctcttgaaaatcccacacaaaatgacacattttaggaatatgtaaaggcaatcataatttttttttcaatcattattgaattatagtgactcttaggtctctttattgcatttgtatctgtgtatatattaactgttactggtacattgaatgtgtttcagtatatttgtctgtagtctactcttggttatctacatgaacaaaacggagaagaggtgtagacatctcaatatcactcatgtttgaacttaaaatatatccttttactaaaaaatataatctgaatgcagatgtggttagcaatttggaaagtcacttcaaaattaatgatgtggcattataaaaataacttgggaccctgttttgtcttccagtgtttaacttttctcaaattctgccaaaacttcactttctgtgaatacatcactgttttctggttttcttttatcaattgtattatatcacagggtaagcgagttcagacacatttcttaaattagggactaatcaaaggg

SEQ ID NO: 21922 - DNA, 1032 bp, Homo sapiens
tacaagtagttcattcattcactgcatgtggacatttttttaagagtcctatttttacatgaacatttctgtttcaagtcttgtggcccattgctcacatgaccctagaaatttacctgactttatcaactctgcattttaaactatgcttattagtcattctttctagttgttttataatggaagatttctttctttttaaaaataacattaaaataagttaatgtttcatttcctatccttggcagatttttatttttcaatatgaattgttttgaaaaaaaagttaatgatacatgcactaaaaagggatacaaagatttcgttattatattttaatttaatgtgaatttttcattttttcaaattgatcaagcatagtttacaaaaaattccttgagctggttgtcggtccactagaataactttcctctgttgccgcacaggacagcaaggctttcactcctccaaagagtatatccttttccccctctcattttaaatagacttcaggtttacagcaatactgagcaaaagtacagagtttccaggtatcccctgccctcacaagctcataagcacccctgctatcaacatcctgcaccaaagtggtacattggttacaatcaatgaaactacattggcatatcattaaaatccaaagtttacattagggttaatcttggttttgtacattccatgagtttggaaaaagatgtataatgacatgtatctacccatatagtgtcatacagaatagtttcactgccctaaatatatgttgtgctttgtctattaatcccccccttcccataagccctggcaaccactgatctttttactgtctccttagttttgccttcttccagaaggtcagatatttggaaccatatagtatttagacctttcagattggcttctatcactcgataatatgcatttaagattctttcatgtattttcatggcttgatagttcattttttagtgctaagaaatatttcattgtctgggtgcaccagtttattcactc

SEQ ID NO: 21923 - DNA, 1043 bp, Homo sapiens
ttgtacaaaagctctcattcttttgtacaggcaaggcttcattgctgggtattgtattggagttttgcaccaaatggttcaccagttagtaatgtttaagaacttgattaccatttgggatagagagtataattctgattaaggctagaatgtagttctaagagtcttaatttaatgctgcttgataaaaatagtgacttagaatactacttgataaaagtcatggtcagaatatgtggctcagactcaaagtttctgactttcctgagtgactacattcaaatatctatccaattatcatctctttatttgtagaagaggaagaaatgaagtaagagcaagcattactagaagaatgttgactttcccttcacactaggcccaattttcctctgctttggttttctctgttaacctaattggacttttaacaagtaagactatggtcattcaggtatttgactatttcttcttgaaggagggtacaaagtgaatattctggaaactctacaatatcttcgattgctactttaaattttagggagatgaatgacataggtgatatggtggctcataagagcaaattaattacaaatttattctctattctatgatgaaacttttccttttgtattatttcttgaactagccaagcctatcaaatggttatacaaagtgtactaccttctttacttaatggtagcctttgatgaaaacaacaaaacaaaaaacaacaacaaaagggggattgagatcttagagtggtagaaggctgagaaaacctaaatctacatcacatttcataacataaaccaagaaaatgtgttgtatgattacctgaagaaccaataaacctgaattgaactaataacagtaaatgtaacatctggtaaactacagttataatgcagtttttcttatgtggacaagaaaatgagaggctaactaaccatttattctatgaattaaaagaaagcctcaaatatttattccctcaaagtcatgttctatctgctaaaaatgctgatcaatgttagcttaat

SEQ ID NO: 21924 - DNA, 1030 bp, Homo sapiens
ttctctatacaagatcatgtcatctgcaaatatagttatatacttcctcttttttcatcatggatgcttttatttttcttgcctaattgtcttagctagaatctccactatagtgttgaatagaagtgacagaagcatacactcttgtctccttcctgatcttggggggatattatgcttaatgttacttgttggttttttgtagatccccttaatcaggtggaggatgtttctttaagtccccagtttgttgagcttttttgtcatggaagcatgttggatttttctcaaatacttttcctgcatctctttagataatcatgtgtttttactttattttatgagatattacattgctaatttttatctattccatcagctttgcatttatccatatgagataaattccatatggtgatagcatatgcttttgtatatgttgccgaatttggtatgctaatattttttgaagatgtttgtgtctatattaataaaggatattgttctgtaattttgttttcctgtgaaatcattgcatgattttgggataaggctaatacttgccttatagaatgcattggtaagtgtttcctctccctcttctaatttttggaagactatgtaaagagaagatgttaattctttttaaaatatttgataaaatcaccagtgaagccatgtggtctttggctttctttgtagaaagtattttttttttcaatctgtttaatcatcacaggtttatccttttttctactttttctagactgattgtcttactccatttggggtgctaaaacaaaataccataaactgagtagtttataaacaaaagaaatttatatcttacagttctgaagtctgggaaatcctagatcaaatcactggaagatttaatttctgataggggcctgctttctggtgcacagagagtatcttcttgctgtgtgctcacatggcaaaagatatcccccatcctaataccttcacaatggtgattcggtttcaatatatgaattttggggaacac

SEQ ID NO: 21925 - DNA, 1079 bp, Homo sapiens
gttcttacttggattcttttgattattgacatagggtttgtcgtcttagtaggtcatgattggcaaactttttctgtaagcggccatatagtaaataaggtcatgcataactcaacgatagtgctatggtctgagaaatatgttaggctatttcatccttgtgtgaacgtcatagaatgtacttgcacaaacctaaatggcgtagcctactacacacttaggctatctggtatagcctattgcgcctaggctacaaaccggtacggcatgttgctgtactgaatactgtagagaattgtaacacaatgctaactatttgtgtatcaaaacatagaaaagataagagtaaaatatgatataaaatgtttgaaaaaaaaaaaagatatgcctgtacagggcacttaccatgaatggacctcgctggattggaagttgctctaagaagtcagtgagtgagtggtgaatttggaggcctgggacattattgtacattcctatagaccatataaacactgaacacttaggctacactaaatttattaagaaaacatttttcttcaataattaaccttagcttactggaactttttcacttacaaacttttacatttttttttaacttttttactcttttgtgataacacttcacttaaaatacaaacacattgtacagctgtacaaatatatttatatccttattctgtaagctttttgcttttttttttttatagacagagtctcgctctgtcgccaggctagagtgcagtggcgcgatcttggctcactgcagcctccacctcgcgggttcaagagattctcctgcctcaatctccccagtagctgggactacaggcgcaatccaccacgcccagctaatttttgtatttttagtagagacagggtttcaccatgttggccaggatggtcttgatctcttgacctcgtgatctgcctgcctcagcctcccaaagtgctgggattacaggcctgagccaccgtgcccggcacagctttttgctatttttaaattcattttttagagacagggtcatactctgttgcccaggctggaatgcagt

SEQ ID NO: 21926 - DNA, 1082 bp, Homo sapiens
ccaaattccaaatgccagggaatggggaggtgaccttttctcttttatggacctttgggaaggagacccataaagttaaggaaattctcaattcgttgcacaactgtcattctcctcttctttaggacatatgaaaccattgtgccaatgtagatcagaacctagatgtttagtatttgctttccttatgcactttgaatattgcatcaggaactactctacttccaagtaggggagccaagtccttgaaagtggctcctggtggacacctgttttccagagggattgttgttctttcctgtgtgctgattgtcagttaggacacatgtgtcgggttctatagtcggtaaacttgtttcaggtccagaaatctgcctggaagagcaatttcaaacttactacagtcagagtgtcagcaaaagcttagaagtttcctccaaggtggtggcatacatccacagctccacctgccaggaattaagctgggaatgtgggaatgttgatctctgtaccctgagtgggcttggcattctgtagcattgctttcacctaattgcaatctcaaggctagaccatcaggctgagttgatgaggacattcactttgtgacacagtctttgctttcctgggaccctcaggaggagaaatgtggcctacttgaagaacaggacactggcacttctcagcatgccacttatttttatcttaacaacactgtgaaccaggtaagcttctcctttcagtgttagaagcttctgaaagccaaatgtaaggatttaaacgtgtctacagggctttacagtatgcatttttatatctgctaattcctggctccattttatacccctacccttgtttcattccttctttctcacctactttttatgtgtcttgatgtagtttatgtatattttcagatttggcttccaaaggtgtgctagaacctttgcacttgttaaatatttaggaattttgtgtgccccttctttaacagttgatagtttgaaatcagccatgctgggaatacctacactatggatattggcaaatgctacaaaacagaccttaccctaacccaaggg

SEQ ID NO: 21927 - DNA, 1058 bp, Homo sapiens
ctttgcatgctatttcttcttaaacggtgaggagtttagaaaaagtactcaagcttagttttggcggaaaggcattaatagtattttctcaagcagtgtttgtacagaattattaaggagccccctaacattttctcataagcccccaggaacggattccttgtacctcagaggcaaggtacttgccaataagcctttagcttgaggcttgctgtaatatattttataagactgtaatggaacttagcaatttaatcagagtatgtgcttctcgttatattcttaaaaaatacaacgcatcagcaaatgttgcattatgggctatgaaattccttctgttagttgttcacattttagcctgtgcccactgtgttttgtatgatggacaaaccaaataatcattatgtaagtaaggtagagctttatattttttccaatgtgtaaacactctgtaaataggcagtccttggtgggtgtggcagctcccctagctcatcaggaacctggactcctctctttcttctctgctatcctcagtgtgtagttctcatctttcaggctgcctggtggttgcaagatgactgctgaagttctagtcatgacactcatgttctaggcaggaagtaggaagaaagggagaaggtagctgaatacaatttaacaacttccatttaaattttgtggtagaatgtctgcaaagatggctgccaataatttttgtaggcttaagtcattttttcctgtcaagaggtatagtctgtttctcttctcctttagtcagggctggccctatgacttgctttgaccaatagaatgtattggaaggccttgctaggctttgctgcttctgtttaccctcttgggatccagctgccatgtaaagaagcttagactagaatatatatatatatatatctggaatacaatggtgtgaacacagcttactgcagcctcaacctcccaggctcaggtgatcctcccacctcagcttcgatagtagctgggactacaggtgcactttaccatactcagctaattttttgtagagacagggtttc

SEQ ID NO: 21928 - DNA, 1028 bp, Homo sapiens
tttcaataagaaattacaaggcctgctaaaagtcaagaaacagcctgaagagagaaagcaagtgtcagaaccagacttacatatggcacaaattttgaagtgatgagactaagaatttaaaataattgaaatgttaaggggtctaacagaaaaagtaggtacaatgcaagaacagatgggtaatataagtagagaggtggaaatgcccagaaaaaatccaaagcaaatgctaggggaaaaaaaattaccgacactgggaggcttaggtgggaggatcacttgagcccaagaggttaaggctgcaatgtgctgtgattgtgccactgcactccagcctgggtgacagagtgagactgtaaaaaaaataataagaatgtgtttgatgggcagttcagcagactgggcactgccaaggaaggaagtggtgaacttgaagactaggtctatagaaacttcccaaactgaaatgcaaagtgaaaacagaatggaaaagaagtccccacaaatagaacagccaagaattttggtaccatttggaaaggtataatgtacatgggcttggaatactggaaagcaagagaatgaagccaaataaatatttgaggtaaaaatagccaagaattttaaaaattagtgacagacacccaaccactgatccaggaaactcaagagaacaccaagcaggataccaaaatgcctacaatctctacttaggcatgccatattcaaagtacagaaaatcaaagtaaaaccttgaaagaagccagagggggaatcaccttaccttacctgtagcgtaacaaagataaattatggacttctcagcagaaccatgcaagcaagaagataagtgttgaaagaaaaaacccaccaacttagaattatatatccaatgaaattattcttcaaaagtgaaagacaaactagtgagtttgctagtgctggaggtggtcaaaaagaggtcgaataacaaggacgagaaatgttgggttcaatgtttgcctaactatattcggtacataagctgt

SEQ ID NO: 21929 - DNA, 1030 bp, Homo sapiens
agacttagccctgtttatgggctctgcattttctgtcctttctttttcatgtaatacattatatgcatcttacatgtcattgttttccttttaatatatggatgtatgataatttatttaactgctctgttctctgttacttttttttttttaaatagacaggatctcactttgtcatccacactggagtacagtggcaagatcatagctcactgtaacctcacacacctcctgcctcagcctcccaagtagctaggactacaagtgtacctcacaatgcctggccaattttttatttttttgcagagatgaggttttgctgtgttgctcagactatttatttttattgcttttctattcttaacagaatttcagagaacatctcttcagttaacttttcactcacatattgatccgttaataattctgataaatttctaaagatgaaattgctgattcatgttaaagacttgatcctgttaaccagtcttattgccttctttgatgatttctgaatattatctataagccttctgtccaaggccattcattttctccagaggaaaacacaccagatttgctggttagataacataggacatctgttttttgaacagtgcttttacctcttagcactgtgatttgggtccctagatgcgcacactcttttgctgagcttcttatcttccatcttttagttatatgggataagggttttaccagattcgtgtagagttttagttgatccttcttgtcaaccttaagacttatcattacatattaaggagactggtactgcaaagtccggaacatatccagaattcctcaggatgaattacattactttcggtcattatttcctgttgcagctgtcctcatcttccaacaggttcgtcctttccattcctttccttccccttccattctttcagatggagtctcactctctcacccaggctggactgcagtggcgtgatctcagctcgctgcaacctctgcctcctgggttcaagcagttctcctgcctcag

SEQ ID NO: 21930 - DNA, 1825 bp, Homo sapiens
gttcttctgcataactggattttatattataaagaagaaatcacctcaattatgttcagctgttttttaacaagtaaatactctttacaagtacagaaataaacttgaaagttattccacagaactctttgtaaattatcacttagaactatgttattcctttgtagaagatgtggaaatgatttgagatatttagacttttttgtaccaagtaggtggcatcactttgaagttgagactgagaggtgaagatttatgttttctgaatcagctgtgatactatcaagtaattttcatctattgtgtatctttgaacattaacagtggttgaccagatactgatgtgtcatttgttgctgcatttttgataatggaacataaatttaaagtatcagttcgggaattggccatttcatatttcttaaggaagccattattaaagcatgtgtaatgaatgaaaacatgaagtggtttaaaatttgtgttttaagacaatcattatttttgaaacttctgactatagttggttactaagcagaagcagataactgttgggccgggtgtggtggttcacgcctgtaatctcagcactttgggaagctgagctgggtgaatcacttgaggtcaggagttcaagaccagcctggctgacatggtgaaaccccatctctacttaaaaaaaaaaaaaaaaaaaaattaaccaggtgtggtggtgggtgcctgtagtcccagctacttgggaggctgaggcagcaggatcacttgaacctgggaggtggaggttgcagtgagctgagatcacaccactgccctccagactgggcgacagaccgagactccatcacgcgcgtgcgcgtgcacacacacacacgagataactgttaaaatagactattaataactttagtttacatttataatatttagggattgctataggaatcattttaccattatgaagttgaaagtattgcataaactgtttttcagttagcttattatcttggaaggcatacatgaataggagaattaaaatgacattttgactttgacattgtttcctagtacatacaaaagttatgtttacaactttactgttgtctaagtattacaattacactttactgttgtctaagcattaggattacatataaaattacatataaaaaatgtacgtatcttagttaaaaatgcttcattgctaaaaaagactaatcatctgagccttctgttagtcatagtctttgctggtggagggtcttgccttgatattgatggctgttgactgattagggtggtgattgctgaaggatgtggctatggcagtttattaacacagtgataaagtttgctgcatcagttgacttctttcttgaaagatttctctgtaggatgcagtacatttgatagcattttgcctacagcagaactgctttcaaaattagaagcaattttctcaagccctgctactgctttatcaagtaaatcctttgttgtcatttcatctccactgggagtagattccatctcaggaaaccactttatttgcccatccataagaagcaactcctcaccaacaagttttatgagattggagcagttcagtcacatcttcaggctccacttctgtgtctcgttctcttgctatttgcagcagatctacagttattttcaccactgaagtcttgaaccccacaaagtcagccatgagaattggagtaaacttcttccaaactcctgttaatgttgatattttatctcctcccatgaatcatgaatgtttttaatgccatctagaattgtgaatcattttctgaaagttttc

SEQ ID NO: 21931 - DNA, 1034 bp, Homo sapiens
gaaatttttagggatgattagatgtgggtaaggaggtactgcatagaaaaatgaaaggcaaaattcctgtgatcacaactctagttttgaattctttcttctttccttgcctattgcagtattcttagtgttcagtgttacctacttctagatttcatgacgtacctcagggtatcccattcacccctgctcccaaattaaaacttcagtacttctctttttgtttataaaatgaagctgaaacacttgttagcttggtgtttagtttaagtcttcccttctttgcaactttacacttcattattccctcatatataatgtacagtgcattcattaggtcatgaggggagcttctttctgccaagaatattcttttcactaatgtttcataacacatttacacatatggcttaagtagacttttatcaacttgaccgttgagtcgtcttttattcctagtagctaatgcggtgtctgtgaatggtagataccaagtaattatttgttgactgtatgagtggcatgagatcttaatcatttataattatcctttagttaaatgcatttatagttccacctaactcaaactttaggaagataattaaattacacttaaaatttgaggatttaatatgtgtatactatataagcaggatatatagaatctttttctagtctatagtcattcattttaccagggaaataaatgaggatgtctagtaattgttaataaatctttaatagatttttgtttcaaaatgacttttctcctgattttcttgtacaagacctgtagtaatgctcattcctcccattgatatgtatgtgtatgtatatgtacatgtgcatatatttctgtttgtgtgtgtgtatatgtgcatgtgtgcatgcgtgtgtgtgtgtttccttattcaatttcctgctgctgctttccatgtagaaggtttccctcggaatgatggttcttatgtttatagataacaggattttagctgtttattgtatttatcagcattgccatctactgtagtttt

SEQ ID NO: 21932 - DNA, 1050 bp, Homo sapiens
tgtgctaaatgtatcttacttgattctcgtacaggctaatagaaggaagtattgaaggattaagttgcattatgaaaaaagacttaaaactgaaaacatcaattagtttttctctaagttgggaaatgatttgtattgattgatttttgtgatggcacactttggtccagttaaaggaacatcattttgcttcagagtatagtttaaaaataccttagacatttaatctagcaaatcatttttgtcaaggacagtatttttgccaaactatcaaaaaatttcacttttcttagttgaatatcatgaggtattatcttgaacagcatttgtgatggttaattttctgtgtcaacttgactgggcaacaggatgtccagacattcagccagccatttctggatatgtgtgtggaggtgttttctggatgagatgaacatttaaatcagactgagaaaaacagatgccctccctagtgtaagtatgccttatccagccagttgaagacataaatagaacgaaaaggttgattcttcagtgaataagagagaacttctgctgactgcctttgagctgggactttttttttttctttctttttttctcctgcctttggactcaaactgaagtattggctgctcttccaggtctccagtttgccagccttcagacttgaactacaccattggtagtcctggttctaaggcctttggacttggactggaactactccattggctcccctgggtctctaggctctcctgcagtctgaactgcagatcgtgggacttgtcagcctccagatttcccatggccaattccttattatcagtcaatatttctctctctccctctctctctgtcctattggttctatttctttggagatccccaagtaaaagtaatctgagcacttcatctagatttactaacattttatttatttacttacttacttattttgagatggagtctcgctctgttgcccaggctggagtgcagtggcatcacctctgctcactgcaacctctgcctccctggttcgtgattctc

SEQ ID NO: 21933 - DNA, 1032 bp, Homo sapiens
agccagcactttgggaggctgaggcgggtggattgtttgaggccaggagtttgagaccagcctgggtaacgtggcaaaaccctgtctctactaaaaatacaaaaattaacagggtgtggtggtgcatgactgtagtcccagctacccaggaggctgaggtaggaggattgcttgagtctggaggcagaggttgcaatgagccatgatctgaccagtgcagtctggcctgggcaacagagtgagaccctgtcacaaaaaatacaagaagtttcttctattaggtttctttattcaagaaatacttgttgacctccttactgtcttagtgaacaaggatgattgagcagataaagggacatacagctgtgttcatggagcttacatatcagccaggcaaatggactttgccaaactagtaactgcacagtaatacaaaggagaaatgtaattgggaacctatcctagtttatggaatcagggaagggtcctttggtttaagatttgaagtatatgtagaatttactaggagctgtaccaagaatatagacataggttttagctgttgtaatcatttgaatgtggtgttatgtagaacagcattatttgacttttcaaattgaacatttctgttcataagtcctttctggaggtagacaggataatacacatttagataaacttttatttatttatttatttttttgagacagggtcttactctctcacccaggctagagtgcagtggcatgatctcaactcacagcaacctctgcctcctgggcttaagcgatcctcccacttcagccccctgagtactgggactataggtgcacaccaccatgcctggctaataattttttttgtattttttgtagagaccgtgtttgccatattgcccaggctggtctcaaactcctgggctcaagtgatcctcccgttttggcctcccaaagtgctgggattacaggcatgagccatggagcctgggctagataaacgtttagtgttttatgtctgaaaataagtgactta

SEQ ID NO: 21934 - DNA, 1027 bp, Homo sapiens
ggaagtggacgcaagcgggttgttgctgctggtttgggtggcctgcttttattctcttatctggccccagccacgtcctgctgattggtccattttacagagagctgattggtccgttttgacagagtgctgattggtgcgttttatgatcctttagcgagacacacagcactgattgttgcatttacaaacttttagctagacacagagtgctgattggtgtgtttacaaacctctagctaggcacagagcactgattggtgcgtttacaaaccttgagctagacacagagtggtgattggtgcgtttacaatcctttagctagacagaaaagttttccaagtccccacctgacccagaagcccagctggcttcacctctcaatggcactcgccgcgggactttgcggcacctagcttgggcactctagcagcccagagggagctcgtcccccatcaagcccagcaggcacccacccggaaccgcgcgtagcccaggctcctgccggcgcctctctctctacacctccctgagagcagatggagccggctccggcctctgccagccgcagagaggggctcccacagtgcagcagcgggctgaagggctccttgagcacggccagagcagacgccgaggccgaggaggcgccgagagcgagcaagggctgctaggacgttgtcacctctcaataggagaaagctatctaatatttaatgtatttaagaaaatggtgcaaatgtggtaaaattgtaagatgtgcttttagcaaggtttgtgatgtttccatatgtttaagtgtttcataagtggaaaacgttaaagcatataaaaagatgctttaggaggagggtggtagtgatgatagtgttgatagtaacggtgatgctgatgaacataccgctgccgctttaatcctcatattagcctgggctactctgccaagggtttccttttcttgacagatgactgcttttgcagggtgtagcctttgtgtccttcccctttcctgcagttttgctcatca

SEQ ID NO: 21935 - DNA, 1045 bp, Homo sapiens
gatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaaggtgagtcaaccgcttatgtcggccgcttcccaccacccggccggcctccaggcgcccccgggaaccccgtttctccagcgcccccggcttcccggcgtcgggatgccagcgcgcggtggtctgcgggcttggaggagctgcgtgcaccacgcttctgcaaagtctgggcttagatatttattgaataaaggaatgaataattaaaaaagaaaactccggttagcttaacacggaaacagtagcagggggttgggactccacacccaattagggccagaaattcaggtggtcaggtatttttttcattctgtgaatgataatggaggataagggagggagaaggtaggggagtggaaagaaaaagattggtgtgggtttgggagttacttccgtcatttctgtaacgcagcaacttattcttgtgaaattaatagaggaatagttttagaagtctaatataagaagatgggtaatgcagtggaaaagactctgaatttgtagattttagagggtctcaattgggcaagtttcttataacttctgcgttgcagatgccttacctgaaaaggagagatttagagtaagtcacctaaagtcctttcctattctatgattatatgccctaatgcagtgtctttgttttgcaaaacatttgatagtgttcctgtaaatgaagtaaacttttttgagatgtctgtcactaaaatattcagaatcagttcatgtatgcagagcaactttgtaaaaaattatcctagtgcgactgaaaataaaaaatttcatttgcttagtctgagcttgtactttaattcttaattcattgggtagagtggacactcttcattattgttgcaaacatcctgatggatatgatggttttttatcaagtgtta

SEQ ID NO: 21936 - DNA, 1500 bp, Homo sapiens
gagccaccacacccagcctagatttaattatgaatcattggcctcaatgattcaaataatcgttcaaataaattctcaacttcagtaagcagttgatggctgtggccacatggatctcccttgtctctgaattactattgcttttacagtgctaatggcagtctcttagcactcagctcttctccagttgtttcatgtgttttaggaatgcaagggtagagcctaggactctagttctttccatcttcacagtacctagcgtcacactggtcacaccacatgatgctctggcaactttgattatttgattacacattaattttcagtatgaggtttcttaattcaatttgttttagaagtgagtcaagaatttttttttcctgtcttttctaggaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagagcacgagcatcactctgaccatgatcatcactctcaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggaggtaagatgagtgctgttcattattttaatatacctgtgtgtctgtcctgtctctgctactctatctctagttatgaggagtttaaagtaaaagtaaaatgttgaagttattgaaaagggaatttccaccttctcagcaaggcacttgccacaaagcatgcctgctatgttgtaaacattcccaattcagaacttagggaacagttcttttggtgagcgtagtgctgcctcctacaattttttctaatacagaatataaaatatgtagagaaagatatcaaggctatctttagagaaagtctataaaggt

SEQ ID NO: 21937 - DNA, 1028 bp, Homo sapiens
attactagaagttatttgataattcttactacatgcagaaatttgggggacataccagagacaaatacctatccagatatgaatgtttatgagaagtcagaaacttaatgagctccatgtcctctatttttaagacactcactcagttgctcaattccttctttggagttggttaagcagggagcctggtaatatttacaaagcatctagtattgctaggttctttgtatatatcactttacctcaccacaatctgttacaataaatatcatttgttgatgctgaagctgaagcagagattttaagtaacttgctcatgggagttcattaagtgtggggagagagtttgaatcccagtctgtgagtctaatgtcctttctcattcaggtatgccacaacacatcttggaatttctcttcctcttcagacatgaatctacagggaacgctgtacttgtttatactgatacttatttgacaagtgtcattcacatattagaaaatcatagaattctaggattgcaaagctctttaaatgccatttggttctgcattcttttaatgtttgtgtgctttataaaatagtgctatataaaatgaacttataagtctaaataagactattctttatcaacaaagaatgtcatctttgccaaactacctgaccagcatgaaataaagaacatgtggctaccatgctccctgaaactcatatacaactttttgcaaggtccgttatttttttctttctaaaaacagagaattggctgggtgcagtggctcacgcctgtaatctcagcacttctgggaggccgaggcatgcagatcacccgaggtcaggagttcaagaccagcctggccaatatggtgaaaccccgtctctactaaaaatacaaaaattagccaggtgtagtggcagcaggcgcctgtaatcccagctactcgggaggctgaggcaggaaaatcgcttgaacccaggaggcagaggttgcagtgagctgaaatcgtggcatttcccttcagcctggg

SEQ ID NO: 21938 - DNA, 1050 bp, Homo sapiens
ttatccattcatccagtccacatcttttaagtagaaagtttaatctgtttacatataaagttattatttgtatgtgagggcttattcgtggcattttattatttgatttctggctgttttgtatattctttctttctctcttactgtttttatcatgtggtttggtggttttctatagtagtaactttttagtccttcctctccttatttgtgtgtttgctctatcagtggatttcatactttcatgtgtttttataatggtcaatattgtcttttagcttttaaatgtgcagctgccttaagtatttcttgtaagtctggtctaatggcaatgttttccctcagcatttgcttgtttgagaaagactttatttctccttcatttatcaagtgtaagttgttggctatagtatccttggcaagtaggttctttttgtttttccttttagcactttgaatatattcttcaattatctcctagcttgtaaagtttatgttgagaaatccactgttattctgatggaggttcccttataagggactagaagcttttccttgctttttaaataattctttgtcctagacttttaaagtttgactataatgtgccatggaaaacatctttttgaattgcatctacttggagatttttgagcttcctgtatctggctatctaaatctcttgctagacttgaaaacgttttagctattattttgttcaataaagtgtcaatctttttgttttctctttaccatttagaacactgaagattccaatatttggttgctttatggagtctcatgtgtcacatatgctttatccattcttttttgttctattatctttatttttttctgaattgtttcaaaatacctgtcttaaagttctgaaaatctttcttctgtttgttctagtttactgctgaagcttttgaatgtatttgtttttaaagtaattaatttttcagttacaggacttctgtttggctcttcttaatgatgtgtatctaataaatttcttattcatatcctgaattgtttttctgatgt

SEQ ID NO: 21939 - DNA, 1030 bp, Homo sapiens
aaaactggggacaaatcagtgtgattagtcaagcctagtcttataagggacacagtataaaattagggccagggacttttcagagcttattgaaagagggcagagtgagctctcctaccactatccctctcagcaagcctctgcctcctgttaacatcagaaggttgtagagggaagacaactgacagaataggagtgtatggaagtgcagggtgtgctgagaggttactccttccttgctccatcaaggggatgccaaatgaaggggagcctcatgaggattacttgcagatactggcatcttactgagaggtagagttgctgagctgtggaaactgtagaccaaacacatagtagcgaggggtgtggtaagggattgcctaacttttaaagtgattcccagagtttggtggtctatatgaatatggacagactaatgctgaatttttgccagcaagtttctgaaagcaatagattacaaaagcaatttcaagaatactgtgactagggactgtagcatagttttatctgaacacactgaagataaagaagacaacctcctagtctccagggcttcatgtaaagggacacagaagataaaggataggaccaagtgatgggggaagggctgctagtgacagcaaagggaggcagggctgcggctctctgaagggtgtccttgatgataaagtcgaccagaataaagctgaacacaactccaaaaaacaagcacaccacacacatttacatgaagactacagtcatttttgctggagcataataaaggatgtttcccctccactctgaaatgattgaaaaccaagttacataagaaaagctctacatgcctgattatgccttctatcatccaactctcgaaagggaaaaaaggcattgtcccaggctaagagcaggctccaactccccagaggagacctggagcgggaggaagagtaaaaggacaggcaccgatcctccacctctgctccagtttccttgagtcacaacctgactgcctctaggggaaggg

SEQ ID NO: 21940 - DNA, 1070 bp, Homo sapiens
caccacacctggctaatctttgtatttttagtagagactggcaattttttaacagtatctccacattaagtgtcagccaaagagtttcatctagctattttgtataatggccttaagctcaggctaaggcacaggatcaagaattagattttctacattgttatgctcacattgattcaggccattgatacaaacaatattcaaaggaaaaacaagctgcagtatgcctctggaataagccagcacacaaattgaacacacacatatacatattctgtgaatgttcgtttcagattactttgtgcttttatttgtctctgggagtaaatgggacatttctaatgagtgctcatcattttggcagccagactactcacagatgatatgagccgctaaccaccagggacaatgtttgcccagatgtgactctatcttatgctacaaagcattgtaaatgtcaaacccctggttggtatgcaattctccatttaccatacacaaagcctgctggagaacaaaaggtgccagatatggatgtgtaaatcattataatgggaccaacagatcaacaacatcaccccttagaaataggatggcctgaggtcacacttcttagatcactagccccttttcaaaatgtccttttttgtttgtcctctttttcaagaggcaccacaggctttttgtaattaaagttgtattgattttgtatttttaaaaaaggattataaaaagactagcatgaaccagaacaaaggcagataatggatggtaaacatgaggaaagataatagtccagcaatgcgctcataataattcccacatacctgcttcccaaagttgattcagatgctactttgttttaaaagctatcctatgtaccagcaattttcaatagtgatcctaggcagttacttaggttgattatagcaattttgctacatcatgatatagcaaattgctatatttttgctatatcatgctatattatgattgcggtctttttattttccaaatctttaattcattttaaaagaaaggtttgttccaggatggcaaatacagtggtt

SEQ ID NO: 21941 - DNA, 1061 bp, Homo sapiens
taaaattaagctgataaagttgtgtcaactggaatcccaagatgtgtagggtccgattatcatccctgctcctgttttgtgatcacttgagtctcccatataggtgagagcccctgtaaagataagagcccctgtgaagatgagaggagaactttgcacaggatgccactttgatgtgtagacgtttaacctggtttgtccttgcccgcatgtttctatagctttgtcttttgctcttccccttgtcatttgatcgtttttacttattcaaaggcttcattcctataccgccaatttacttcttgctactggatcatttccatcagtctcaagacatgttataatcttaaaaggaaacaaacaaacaacagtaacaagaagcaatcttccattaacccacatttcaatccagctactgtctcatttctcttctccctttgtggcaaaacatttcaaaacattgtgtatatttatgtgtttgtgtcttttatacacatactctttcatgctattctgagcctatagtcatccccattacacccaaaactgtttttgtcaaggtcaccaccaagttgttaaatccaatggccaattcttatacctttgtttatctgtagaagtgtactcagtatggacaactggagactaacagtataaagaaaataaacttttcttagaaaagaaggcttgattaaaaaataatgagtcggtactggaagaacgaggtgagttgatgtcttaaattctagttctggtttggtgcccatcagttgagaattgagacaatgaatgcaggattataaaattggaaaagccagaagccaaaactaccattttaatgatgttaccatgggacactgggggtacaaactgtggaacagtggcattggaaaaatttttgtaataatgataataacattaaggagggcatctccatattggtgatgcttgaacattgttttgcagaagtacttgtggaatcagaattaggggtattggtcatttgcttagagcaatttactaattattttatctatgttcttcaatatactatatatggc

SEQ ID NO: 21942 - DNA, 1048 bp, Homo sapiens
tctttggaaagtatctttttagattttctttcacattttcaattatgttgtttgtttttctattgtttaatgtaaatgtttagtctattctcatgctcctataaaggaccacctgagactgggtaatttataaaggaaaaaggttgaattgactcacagatcagcatggctggggaggcctcagaaaacttacaatcacggcagaagggacaacaaacaagtctttcttcgcataatggcagaaaggagaagtgcaaagcacaagggagaaaatcccctataaaactgttagatctagtcagcatgaggataaccacccccatgattaaattacctcgcactgtgtccctctcatgacatgtagggattatgggaactataattcaaagtgagatttgggtggggacagagagccaaaccatattattatgagtaacatttctttcttagatatgcgttttgccatgttttctcccatctttagcttgtctttttattctttcaatagtgtctctaacagatcaggggattttaaagttaatagacattgtcttgtcgtttgttttttctttcattggtcatgctttctgtgtttgtctgaaacttcattgccaaacccaaaatcacctatatttctatgttttcttctataatttttatagtttttaattttatattcattttatttgacatttgatttaatttttgcaaaaagtggatctatgttccttatttaaatatatgaacccacaatggttcagtacaatttttttaaaagactgccctgtttctattgaatcttatttgctcctttattattgtaacatataaacaaatgttgactatatttgtttagttctatttctgagctctttctttcgttcattgttctttgtctgttctttcaccaacatcacagtgctttggttattagctttacaataagacttcaagttgggtagcgtgaatcctccaactttgttttttattttcagtcttatgttggctattttattatgtcttctgcctttccgtggaaatgtataaa

SEQ ID NO: 21943 - DNA, 1047 bp, Homo sapiens
ggttccaagccttggccattgtgaatagtgacacaataaacatacatgtgcatgtgtctttatagtaaaatgatttataatcctttgggtatatacccagtaatgggattcctgggtcaaatggtatttctgattctagatccttgaggaattgccacactgtcttccacaatggttgaactaattttcactcccaccaacagtgtaaaagtagcaggatgcctccagctttgttctttttgcttaggattgtcttggctttgtgggctcttttttggttccatatgaacttcagttttttttctaattctgtgaagtaagtcaatggtagcttgacggggatagcattgaatctataaattactttgggcagtattgccattttcacaatatttattcttcctatccatgaccatggagtgtttttacatttatttctgtcctctcttatttccttcagcagtggtttgtagttctccttgaagaagtccttcacatcccttgtaagttatattcctaggtattttattctcgttgtagcaattgtgactgggagttcattcatgatttggctctctgtttgtctgttattggtctataggaatgcttgtgatttttgcacattgattttgtatcctgagactttgctgaagttgcttattagcttaagtaggttttgggctgagatgatggaattttctaaatatacaatcatgtcatctgcaaacagagacaatttgacttcctgtcttcctatttgaatatcctttatttctttctcttgcctgattgcccttgccaaaacttccaataccatgttgaataggagtgatgaaagagggcatccttatcttgttctggttttcaaagggaatgtttccagtttttgcccattcagtatgatattggctgcaggtttgtcataaatagctcttattattttgagatacattccatcaatacctagtttattgagagtttttagcatgaaggggtgttgaattttttcgaaggcctcttccgcattcatggagataatcatgtgat

SEQ ID NO: 21944 - DNA, 1025 bp, Homo sapiens
actgtatgtatgtatgtttatgtgcctgtgctttcatattacaacttacaagcctatgaaggcttaatgtgtcactattcctgaagactataactggggattcatataaagtatgaatactaagacaaaacatgtcaaacatttttttttcttaataaactttttttttcacacaagttgatatttactgaaaaatggtagagatgatactgggatgccatatgcctctcactcatcttcctttattattaacatcaatattcctttattatgatgaatttgtcacaatgaataaattaatattgatgtattactattattaactaaaatcaatatggtatgcatatttccttagttttaatataatgtctttttttttctattcaggctatgacattagagttagtcatcatgcctccatagactcctgatagttgtgacaatatctcagacttttcctgtttttcatgatcttggcagtgtgacaaatactggtcgactgttttgtagaatattgcttgatttggatctgtctggtgattttctcatgattagactggagttacagttttgggaggataactacagaggtaaagtgatattctcatcacatcagaccaagattacatactagcaacatgacttatcattgttgatgttgactttgtccacctggctcagtagtgttcgtcaggtttctcaatgggaaagttgttctttattgtctccttttgcatattgttctctttggaaggaaatcactatgcatagcccacgcttcagaagtgggattttatgctgcagctctttgataagagaggatctgcatggattatttgtaattcttctacatgggagatttctcttcctctcaatttgtttattatttaaataattataaattcatgggtatttactttatactttagggtatttcccaacaatatttattttgtttctcaagttgttccaaaaatagttatgagagctctttcagttgactcctatattctttggttatacac

SEQ ID NO: 21945 - DNA, 1024 bp, Homo sapiens
tacacgtaaactgaagaaacttcaagcgtgcagctcaattaatttgtgcaaatctagtcacctgtgtaagcagaatccatatcaagctgttgaagatttccagcacactagatatctccttcagtatttcttcttcactactatttttctcttcatttgtactggattagtttttgttatactcattcttgagctttatgtaaataaaatcagatgtatgtatacatcttgcttttattaactatctgtgagatataaccattttgttgttatatataccatgctagtcatttttaatcactgtatattatttcactgtattaatatatcacactatatttgttcttccactgatgtttctttaacacaccacccctcttcccccacctccagtttttttccttttctgaatgaaactgctatgaattttattgtacctgtcttatgcaatacatttatactctgttccatgataagcaggtttgtgcaaacctacctccaaagactgagggagttgagaagctgaagaaagaggccaagaaatccactttcactggaaaggttagctaagcatctttgtgaggggtagtctatactgcaggcatggtttaaagaccttattcctgatcaccttggtatgtgggggtcaaacatcagtcatcattgtggttttgcttcaagatggcatcactcatgccatgcaacagactgttttcccacaccctcatttctgttgggggcatagctagaagttgttcataagagtatgcagatgttcaatactattcataaataccagtagttttcaaaaatgctttaccaatttgtattcctgccagtattgtaggtgttcaaggtgctccaaatccatttcaaaaaaataatattgttagatttttaaattatttttaaatgttagccattgtagtgggtgtgtagtagcatttctccttggttttgatttgcatttccctggtgggtaatgatgtctagcacttttttataaacttattacattttaaaa

SEQ ID NO: 21946 - DNA, 1022 bp, Homo sapiens
aagtaaaagatgaaatagcatgagttaaaaatcaagagaagcaaaactttagaaactcatttgatatttacaatagacttaatggtcataaattgtaaaaatgtaggtttaaatattgacaaaaaaacaaaaaaatggcagaaaaccaaaatactataaatgtgaaccataaagaaattctatacctgaaaaataaataatttcaccaaagaattggactatacacacatacatatataactgtaaatataaattttagaaattaaaaaacacaaagtcaggaattcaatagatacgattaatagcatgttagatataggagaaaaaaggattacagaactggtcattggaaattaaactaattaaagctcgagaagactcttgaatagaataataaaaaggatgataagaggtataggaaacctggtaaaacactctcacatataaataattgaattccagaaaaaagtaggaaataaaatggataagaaagaatattttgagaaattttggctgacacttttctgaaattttttcaagatatgaaattcctgtttctggaaactctgtcaatatcaaacagaataaatacaagaaaaaaagaaaaactacctatagcatattgtaatgtcaaaaaaccaaagacaaagagaaaaatcatagaagtaaccagaagtgaaacaaagccattattctcaaaatactaataataatagatacagttgattgaaagaagaaatgatgacaagaactaaaagaatataactgacaagctagaattttatatgaagcaaaagtatccaccacgaatgagagtagatattgccaacagatctgcctaaaagttgtgctaaagggacttgtttaggcaaaaagaacattacctgaggtggaatctagaagtgcaaaaggtacagaagaactctgacaaggtaaacccattggtaaatctaaatttttattgatagttaaagcagggaatcaacatttttggtaatgggtcaacagatcttttaggatct

SEQ ID NO: 21947 - DNA, 1027 bp, Homo sapiens
cccaacataaccagattatttccactttcattattttacacattgggctacatatttgaaaactagaaattatataaccattagtcaagaacaagaattttagttcttttattacataatgtgtgtttatttatttcatacatagagattgattgtttttttcaaggttccatttatatgcaagtaaagaatataaactaaataagcaaaccattttgagttcttccctggcccactccaaggcatagcctggagagtattcctttttcagtgtccaacagcatgttttttcctatcctccacatagtaacatgaattctttgggggcaaagactttgacatttttctttgtatacataatatgcatcacagaggcagaaactaataggggtgtaaatcaagaagccaattgaatttgatctaatctgagcagaaaacctcaagaaatggtgtaaattttacttaaaataggtaatcaagtgggagaaagactttcctaatcacacagattgtatattctctccacaaaagattgtgtgaaagacaattattatatctttgaaatagtagcccattgctactcagctaaagacctgattatctgagtgatgaattgattctttccttcattctttcaacaaatactcatcacaagctgctatatacataagcctgagctaggcactgcgggtggaggcggggggtgctatagagataaactgtagtgtatatttctgaatttcacataacgtaaacgaagaaataagacctgcatggaaacagcatcaaattgtagctcaaggcatactgtagatgaccaattagtcctaagaagagaatgtactccagcagggttcaaaggaagacagatgcccgggagtagggggttcccgtgtggagtggagtctaagggaggtttttagaaatggttaaggttaagagaggcaaagacatgtgtgtgtgtacgcctatatggagttaggggatgcagaggaagcctggataagatggggagatgcagattgct

SEQ ID NO: 21948 - DNA, 1023 bp, Homo sapiens
aacactgaaaaacagtagagtctatatatatatatatatatatatatatatataaaatatgtataatatatacacattatatattatatataatacttatataatatataatatatatcatattgtgtatataatgtattttatatatacattatatattatatataatacttatataatatatcattgtgtatatataaaatatgtgtatatataatgtccataaaaataatgtatgtatatataaaatacattttcaagagcatatggaacttaccaacatacactgtattctgagccataaaacaattctcaataaatctacaaaacttcaagttatagaaagtatgttatttgactcagtagaagtaaactagaaaacagtaaaaaaaaattctctgaaaagctcccaaatatttagaaacaaaatggcaaacttctaaataacacaaatgtcaaagaaagagtcaaaaggccaatttaaaaatattttaactgaattaaggctaaaacatgacatatcaaaattgattaacagtagctaaaacaacacttagaaaaaaatatcaaactaaaaggaagatctaaaacagaaacccaaagtaagtagaggaaaaaaatagaaatatcacagtgaaagtctaaatacagaatggaaaaaataaaacagcaaatgaataaaaccaaaagtgggttcttgaagaagattaataaagtgggtatatcttaaccagacaggttgggagagaaaaagaggaggcgaaagagaaggagaaggaggaggaagcagaggaggaggaagaagaggagaaattaccaatatctgaaaagagatcagtacagattatagagatattaaaaagacaataaggaaatattatgaaccactgtttggcaataaattcaccaacttagatgaattgaacaaattcctttgtagaagcaatctatcaaagtatttgtgtaaaaatttatgtttatttgaaaagctaaaatagtcaaagcaatttggtaaaagaacaa

SEQ ID NO: 21949 - DNA, 1032 bp, Homo sapiens
tactccttatagtctccgttatgttgagatcaaagatgatttatcatggatattgttgcacatggttttgcagttttttctctccgtgacatttaaaggtagcaaagttgagattctgcttttaattcatcctcacgagatatgaagacttctctaataagactttttttcttgaaagactctggcctaagctgaattaaataacaaaaaattaaatatagctcttaatgcttctaaagattagcattgtgatataatctaatttctattattctcctgttttattagcatttaaaattttataaacatttgctggctgaaaacggatattatgttcttgttagtgttatctatctaatgcactctctcttattcctaataactgctaacattgtttaactgtttgaaagttcttaataatttttgtacagcaaattaacagctttcaaaatcagcatatttcaacattttattattgaaacacataaatatgcttatattttaacagcctgtagaagcccatggaggtttttattccaagttacatctagactgctctcctaagtttgaaaatgaatacttagtatgtattcagatgttaatagccaattcgagggctacaccttgttcgtaatttgagtggtcctacctccattgaacaagcagatgatgaaggggccagaaaagaagtagctatttgttactctgtctttcaaagcctgaagccaaggctgaaaccaagtatatcttttcctgagtactgaggccaaagttaaactttgtggcatctctgtgtaaagaattcctagatacaattaagaaaaacagaaaaatgacaaaagcctatcaacaacccccagaggagaaaactggaatcaccaataaacctatgaaaaactgcttaaccctgtcagtaatcagataatgaaaactgaaacagcaatgagatgtcatttcatacccatcaagttgggaaaaaaattagcaaaaaatatcacacattggtaagaatacatgtaaatggaacgctgc

SEQ ID NO: 21950 - DNA, 1024 bp, Homo sapiens
ataatccgtttcctaggtacttctgtgtaattctaaatttcactttaaacctcccagtaaagtgtttacccctgtgaatggagagacaatctgtgttgagacagtcccgctgcctcaggcaggatctcatcagctctcatatcacagcagatagagaaagggatgatccattagggcaataaggccaacttgttcctaccaccgaaattgttccttagagtgcatttgctactgccatgtccagtctggtttttactgtcacctacgaaattacatctcacttaaaaaattctccaattggatggttctgctcttttagttttgactctaccagctttttttttttttttgagtcaatctcttagaaataccactcagttcatttttactctagtttctagacttaccttacaggagttctccataatgttgcccttttgattattgtctttaagattcaccatttagtctatccatgggttatgcaaaaagtggatatttaatctgattgtaaacaaccaaccagcaattgaaaaacaaaaaaactttttttttctcttcttttggtttaggggccttgatcttaaggtaattgtctcaatgttccaggtagtccctgtgtgaccatagcattgctcagtgtcagaaaccacttctgattattgctcctgtggaactggcaggtgctctcaattgtagccaaggtttttaggtaaacccatctaaagcattgcaaagcaagtgaatttgggagtaaatgtacatttgtaaagcaggttcgtgtcagctaaacttcatgcaaaataataagaaacagtgatctacatgcaattgtaggaaatttcattaatatcatgaaggtaatgtgagtatggctcatgaaagatatcttgaaacccaaaccaataagcattataaaaggaggtgatgggtggacatgggtgggctttaggacttagaatgctgtcacaatgtccaaaaaaaaagcaacataaaaatacaggagaagaagcaagacagagtc

SEQ ID NO: 21951 - DNA, 1085 bp, Homo sapiens
ttctttgctttccatgcttgagacagcttttttacccttcttctttaattttataatttctgattttgttatttgctcacataccatatggctcttcttttctgaaaatatgtgtttctcccttttacccactgtaaagccaactacacctccacaattcttcctcaacaatcaaaaagactcacatgaaaaggccaccccttcgtacacacacacacacacacacacacacacacacacacacacacatcttcctctcttgtcctctggaaaacacatctctaactcgcgttgtggtgccttcacacttcaggctgaggtcctgacactcaatctgcatagctcttatctgtcctacacaggaggaggcaatggggtctggggggcaatggagagaatatttgttgcagttcaaagcaagccatcttttttttccttctctctttttttgccctttcaagataaatagaagtagaaagtacaagcagttttgattagcatttaaaatgttgtcaatttttaatgaaagcgtaacctccagccatcaacttcacacaaactggagacaaggttgcaaaacgaatgctaatatatttggcacactttctcacacttgtccttctgtgaacttttcttgttgctaatttgttatgtcagcccatgttagtaggtttcaaaagtccaaactggcaagtgtggtgacccaaagagaaccagcctttggaagatctttaaattgaaacataggagatgggcagtttattagctgtacctatagtcctataaatgtgactatgttaacttggaggaggtgccaagtttcaggagtaatcttcagagtctttcaaaatccacttcgtaatgtgacatttttatttaggaaataaatggttgccggtcagttaacaacattcattgcctgcaaataatatatttacctatcttgtgttgataaagcccaaaattccaacatgattgcatgatacagtgatttccctcaatgaacttacatttttaatagcaaaacaaggaaacatacatgaaaaggatacaaaaacacttggaaaatacatacataattagga

SEQ ID NO: 21952 - DNA, 1084 bp, Homo sapiens
atataccttcaatgcgttttggcgtaacataggcaatgacaaaatttccattttataattattgaaacttggtcccagggcaagttatttactcaaggtcactgcaatatgttggggacttcacccactgacagagtcagaaggttccaggaaaagcagaatggttagctctgtatatttcagcatgttagattaatatttttaatttatcttcgatattcagggatgtgtttattaagtggtgaccctgggacagacgttggggaaatggaaatattataaaaaagttatactcctcaatatagattgtcaaaacaggcatacagaaaaaaatgaaaacaaccaaccaaacaaatacaaagcaatatgaccacaaccataagaaaagcatgtgtaagaaaattatcccacaatggatgtaccctaggagatcagagagtactttattaaggatgtgatatttgtgtttagtgctttagggggtatggggttgctaagtaaggattgaaggagagtgaacagagagcatagcatgcctgaaggcaaaagaataaatgaggaatccatgggactatggaagggccttggtaaggtctgaaaattgggcagggaacaaatcattaaaggacctactttactgtactaagaatataaagtttattttaaaggcaatggtgagaactcattgcaaggagaggatccgtggtgaggtattgggaaattattaaactggtataagacataaagtggttctaggttagaacagagtgtgtgagaatagacaggaagaggcagattcaagagatgattaagggagattaaaggatcgaaaggagagtttgggtgacatataatctgctctctaaaccaagacacttttgagaaacatgaaggatgcaccactaataattatgccagaataaaaggcacaaataaggattatcctggaccaccaaacacaaatggtcaccctgatcttagtacaggtcatacttgcagagcctcgcctgatgcaggatcaaggagaccagagaaaagcactcattttcttttttggttgtttatttttaatattttttcgaga

SEQ ID NO: 21953 - DNA, 1154 bp, Homo sapiens
aaaaatgaaaaaaaatattgtctatcacggtggcttgaagaaaattagacttgggtttctaccttgaaggaaccttgccatatatttatgaggctttctctcatttcacgataatttgatttttgcattgagtgctggtctgcagaagggattacagagagagagagtagttccagcactgttgcaaattatctattctgttcattatcaaaagtataatgttgcttgttgggcattgtttaaatttttgtcccttggtatatatatgccatttgataggttttgatgtaggagtatgttttgcatagtgtaattatgtcttgcataattctggctggattctgggtattttcttttttcctgaaggttctaaatctttatgtatgatcttctctaaaaagcacaaaatatatgtgaatgtgagtccctgtgtgtccacatatatgacatttattgaatgcctactgtgcaccactcaccctctgcaggatttactgggattgctttcactttgtagattaggaaaatgaaccctgaaggagttaaataacttcttccaaggtcacacaaataatagggggtgaagctgagatctgaggttcacatcctttctgtcttatttgacttttattcactctgctacattattgggacagtgctaagggagagagagaaagttagaaaattagtttattattagtaaaaataattgaattttaagtgtgtatttttagacccgggttctaatttctagaaaccctgaggagtcaaaggtgataccaacacagtccttgtaccttataggcactagatgttagttgagtgttttagtcatgggggctctctaagcatgggtttacagactacttcatgggaatatttatgaccaggtaatgaaattcttccttacattactggttatgatactggcaaacctcaaatgcatttgaatggattcagaaattgtaggatttagaatcccatgtggtattccagttaggaagggaggcggtagaattttcagcacacatttctcgtaccttttcctgtgcctcatcgacctttctttcaaactaggcaagagcatgcattaacccaagctggactttaaaacctcctgagaaacagccacacactggcactggattggccag

SEQ ID NO: 21954 - DNA, 1034 bp, Homo sapiens
acacaaacacacccccatactgattctgcactttggaaaagcacaacgtaatcacccaaagtacctaaagcagaaaaggaggtagcgtggctgtctgtgacccaaggcacagggattctgctgtcagcatgagctttcatggaagaaaaaggggttgaaagctactttctccgtaagtagtatgtttatgtattattcacagtagcaaataattgcaaaatgtcaacatttcatcttcttcttaagagcttctttagtgacctaattaaccattaagaagaaaagattttttaagtgtaaatatgaaaagtgagagtgtttcttagcagcaatttgtgatcttaaaatgtcacaagcaggcacatcacggaggtgctaccaaccagcacttttcaaaatatgactctgtgtcaaaagcgtgtgctgtggatttgtattttttgtctttattctgaaacaagcaatgcaaatatagatacggttgcctgagagatttccttctctttttgaaaacccttcaacattttctctgacagcctaggaaaggttgtttttaatctatttaatttgaggctgtattctccacagataatgccatattttctctttcacttcctgagcatgtacaggaaaaaaggcagaaatgtctctcctcacacacactacatttacatatatatacacacacccctaaacataacgtatatatgttcaatgcacacatgcaacacacattcacagacacacagcatacgctaatatacaacccaaacatgcatatataacacaaattatgcacataacacacatgtacacatttatatgctgtcacgtacataccacatgcatacttatataaccataacatctacatgcactcaatcaaatggcatatttacatataaatttaaaggcatctccttaagtcctgacacacatgtcaaggtgtgacatctcctgcgagatctcagctggaagcatttctgaaacagtctttctcacagttgacagtaacctgaccttttattcagact

SEQ ID NO: 21955 - DNA, 1053 bp, Homo sapiens
tatttattcgagtttgcatggtgtgatagtgtgtagtaagaaatatatgtttggcttttgatcctggttcctgacgcagagctcataaattccttggaatttcctgggtgataggagcatcttttattctaatgaggtgtctcttaaggagttcctagatagcctgaggattgggattgattgccaggggaactaaccatatgattagaagattaaaactttcaaccccatccctcaacctctggggaggggagaggtactaaaggttgatttggtcactaatggcctatgatgtaatcagtcacacctatgtaatgaagcctccataaaatctccaaagggcagagttcagagaacttcaggattactgaacacatggaggtgcctagatgtttttgcactgggagatggcatggaagatttaccctcctttccacatgccttgccctgtgcatctctatcatctggctgttcatcagaatcttttgtaatatcctttataatcaatcatttcatgtgtttctctgattactgtgaattgtcttagcaaattaatcaaacctaaggagggagtcatgggaaccctgatttacagccactcagtcataagtgtaggtgacaacctactacttgtgattggcatttgaagtaggggacagtcttgtgggactgagctctcaacctgtgggatcttatgccatctccaggaaaatagtatcagaatttaactgaattataggacaccattgtcttctggagtgatagttgttggtggggtgaaatctccacacatttaggtgaccagaggtgacctaaattctgtactgagagtaggaatagaaacaaaacagttttttttaattcctattgcaaacacatggtgtaatttaatttctatctttttacttttaacttaattatatcattttatttgaagtcagtttaacataggcagcatatacttgagtgttacaaaaatctattttggtaatctctgttttttaatttaaatagtaagtcatttgcattcatattattgatttgtttggattt

SEQ ID NO: 21956 - DNA, 1069 bp, Homo sapiens
gtgcttgagtacaatgatgaacagacttcataagcctgcgacttaggtgtttacacaggtccccgaagtttagaaggccatgcacttggcttaatgttctgctgtcattgtcttgacatttttagtattttttcaacaaaggaccccataatttcattttttgctagactctagaaattatgtagctggtcctgatagtaaataagataaatatgacccctgctgttatgaggagactgaatatgaataagcagatgaaaaagtaagaaagggaaatatcaggcagttgtaagtgttatgaatagctaggtgaaaactttaaatttggtggttagcaaaagcatctcaaggttacatttaaagctgagatttgaatgatgaaatgtactctgtaaaatgctgcagaagaatattccaagtagaggaaataagtgtgaagatgctaaggcagggatgaaattgaagagtttaggaaacagtctttttgggaaagaaagagcaaggtagagaatgatcaagcctaaagattggtcgtggccagatcattaaggccaggatacaagggtttgcattttattctaaatgtgataggaagccattatagggtttatagtgaggacattaagtttgatttattttttaaaagatcactgttttcaattatagtgagacagaaatagaagcaggcatgccagtaagaagactactgcacatgtctagacaagcaatggtggtggattgaaccaggacaatacacaagcagctggagggaagtgcaagtgtttaggatatatttaggagacagagttgataggactgctgacagatgggatgtggaggatgagagaaagagagagatccaggataataactgtatttttggtgatcatgtcatttattaaaataaagaaaatggacaaaattaatttatggaaagatattatgtgttctctcttaggtatcaatgtggataagtaaagagggaaaatgagtatcatcactatcaaaaaacagggataacagcacctacctcatgtgattaatatgcctattaaatcagatcacgcat

SEQ ID NO: 21957 - DNA, 1034 bp, Homo sapiens
agttgcttaagtagtgaaattggttccttagtgacaagaaaagttattagggacattaagaagatatcagtgaatcagaattaagaatgagttggatgatataggcaggaatacagggaagaattagatcaggaatgtatagacaggtcataatgagaaaagttgatggagaactggggttggcaaccaaggaaacaaagggtcaaaggctacatttggagctggaggagctgagaaaattgtgtgactgaagtttgcttgaagatggaagcaaacaacaatatcaaactttacctgagtctatactccctatttttttatgttcaactaactacaaagaacaattatcttctcacatattttgagatatggcccatctcccttcttccacataactccaataagactcatgaaccacttcctcacctatctgcctctgtaacggtgcaggccctctttctcttccttgaactgtttttcattaatgacccctctccatattcaagaacctgaataaaataatctccttgattgtctggtgcattttgtctttcacaaagcaagacacattttttttgaaaagttatcaggttatcagttaaacgtacatagatttattgctcagtgttactcccatccaggaaataataattacacctgagtcctaaaaggggaaggagaaaggaggaagagtaattcaggattattaaaatcttcatcttttctgaaagaagtttcttctgagtctaactcaagagacagagcagtgtcccaaagccaggtggattgcttagtttggatcctgattcacccccaatttctacagcatagatggatgtgagtaagtaatatgggatgaaagatgattctcaacaaggatgattgtacattccaatttgaatgccctttctcctataataaggataaaaactgtgccagataaagctacagagttaatggccagactttagattacgaagccccaaagagtctgagggtggaggtgagagaattgatcagctgtaggatgaaga

SEQ ID NO: 21958 - DNA, 1035 bp, Homo sapiens
taccttactatacccaagaggctagataactaaaaattagatttcttagcattccttgcagccagtgttttttttttttgtttttgttttgtttttttttttttaattagactttgtcagttataggcatttaggtaaaatttagaaggtgagagtgaaacaaaagattttttcctgctctttttggctattttctgatgaaagtaaggtcatgggcatatgttttcttgccattcagtgctcagccaccagctttacggggtttgagaagcagtaactacagtggcatcgtgattgtggctgactgattcctagaatacagtggtgggttcttgaatgcaatagtttcagtggtggccttggaggtagtggctcttatggtagatcagttttgcggagttccaggagtaatttccgacccacctctagagctccctcccgcaaccctgccccaaattttgtaagcccttatatctctctattaaatctttttctgcttaaaatacctgtagtgatttctgtttcctatgctgaactctcattgatggatgccataagaaaggaaccagatagtgttacatgagattggggcaggggagaggaggggagggatggaataattagaaaggaatttttggaggaggtaactttttagcataaaggagtaaggatttcaaatagcccaggagagatgagggttccctggtgggagtgattaaaaggggctgtttctccttcccccaacttgatacttcctcatcacctccccgcctccagctggatgggttatggtttttattaaagtctggacttgaatagttacttggagtttctgtttgttgtcagtgggaaatgtgttatttcagtatggaactcaataccccgaaaacagattttcatgtagtggtctcatggatcctgcaaagataaatgtacctggaaaaggcagtgcatttcctctcctgtagccttccttcatcacccttctggagactgcaggctgctgttccatgctaggctcctgataacctatct

SEQ ID NO: 21959 - DNA, 1050 bp, Homo sapiens
agaagtgagtttaaagagataagcaacagctggggcatgaagtgccgtgtctgtcaagctcaggagtttgggctttatccttcagacaggtagaacctctgagggatgctaagtaggaaaatctatcacctccaccactaccactaccaccaccaccaccaccaccactaccaatgccaccaccagcttcaccaccaccaatgccaccaccagctccaccatcaccatcaattccaccaccagctccacctccaccatcaccaccagagtacctattacaataattgtcttcacagaataaattttcatagtgctaattatagcacaattaattagggaacaaaattatttatttatttatttatttatttatttatttattgagacagagtctcactctcttgcctaggctggagtacagtggtgcgatctcagctcactgcaaccccctccttccgggttcaagccattcttgtgcctcagccccccgagtagctgagattacaggcacccgccaccacacccagctcctttttttttttgagacagagtctcactctgtcacccaggctggagtgcagtggtgcaatcttggcttgctgcaagctctgcctccctggttcacaccattctcctgcctcagcctcctgagtagctgggactacaggcacccactaccatgcccagctaattttttgtatttttagtagagacagggtttcaccatgttagccaggatggtctcgatctcatgacctcgtgatctgcccacctcagccttccaaagtgctgggattacaggcatgagccactgtgcctggcccccacccacctgcttttttgcgtttttagtagagacggggtttaccctgttggccaggctggtcttgaactcctgacctcaggtgatcacctgcctcggactcccaaagtgctgggattacaggcatgagcctctgtgcctggccagggaacaaaattttaactacatatttttaaaaattgatgagcataatgtagagaaagaaagctgagtgagtggagtgtaaa

SEQ ID NO: 21960 - DNA, 1026 bp, Homo sapiens
agtttacagtgagctgagattgcgccactgcactccagcctgggtgacagagtgggactctgtctccaaagagaaacaaacaaacaaacagagttcctttctcatagggttttcagccttatgtgagttactaaagtgcccagcatgtggtgacagctgtgcagaggtttgctgttactgcccaaaccagccccgagctggactccagtctgagtacacgccagatgggagggcaaaggggtctaaggtgtgggagtttatcatccagttatggagccaggaccccatacagggaatgttgactaacagctcaggacaccatgatgtcagtgtgtggcctgtgatggccgagcatacagtggcatggatgctgagtcctaggatggggatggggtaaggactgggatctggagagaggtgctctgaggattgcctttgccattaatcccaggtgccctcaaatgcatcgagtgtcagaatcacccaagaaggtggtgaaaatgcagattcctaggacttgctgcctgatactctgattctgcaggtctggggtggagccaaagaacctgcattttagcaaatgccctctcctaaccccagggattctgatgcagatggtccctgtgccttttgaaacactgttcccaggataccaagtcaccgagctaagtgactgatgacattgttgcttaaacctgccacagtgttcccactcacccactgggattcctgctgggagggcctctatccctcactatatcccccacatgaaatcaccccctcccatgcatcagcactgtccccaaacgcccatgcactccccgcccttcttcctcaggctgtgcccatcaaaacacacggcacttgggtgacagcagcacaagaagcttgttcagagcctgtgatgtcctctctgtacctggcctattgtcctctggatgctcgcagcaatgggtggggcaagtagcctttatataggcagccaccctgaagccagagacatggagtgcctgtctcaagtcacct

SEQ ID NO: 21961 - DNA, 1030 bp, Homo sapiens
gccacagaggcttgggctgctggcctccttctggttgtggttaagttaatcaatgcctgccttccggactcctggcctcagttctgtaggcctccttcccacaaggctcacagttgaagtacacagtgataatgggtgtgctgtacctctggcagtcacattatgtgcctctatggagttaaccctctcatcttccgtgtcttttaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcct

SEQ ID NO: 21962 - DNA, 1016 bp, Homo sapiens
attagggggaggtggtaaagcccagggcctgcctaagatgggagcctaaaaggaaatccgatgcataatccacagggtgacatttttactgtaaagataagctagaagtaaacctcctcttgtgagaggaaggcaaagacagttacctgttttggcctcgttgttaggttaaatgtttatgcaggaaaagagatatctgttttgagaattgataacaagctgaccctcatgtggttttgaagcaagaattcagactacctagattggtagaaacagcagtaataacaacaacctcaatctaagaatttagagtagttctgggttggcggtgccaccagcatctggcaaaaagcaaccatagctcctgtttggagaaacgcatctttaactcatgcctcaaagttccaagaaactcacagtaaaaaaagtcacaaaacacaggaaacaaggtaccatgagcaaagtaatagaaaacaacagcagcgtcagaaatgaaaagattgaagatagtggaataattagtacagtaagcaaaaaagttatttttattatatgctgaaataagagaggattgaagatatcagtaagaagcaagggattgtagaaatatgcagatttgagagatttatataatttagaaatgaaaaatataaagattataataaagttaatggataagttcaacagattaaacccatccgaagagaaaattggtaaactggaaaacaaaactgaagaaaatactcagattgcagcacagaggaacagagaaggaacgtaaaagtgagctgggcatggaggcggaggcaggaggattgctgatggccaggagttcgaggccacagtgtgcaatgattgtgtctgaatagccactgcactccagtctgggcaaaatagtgagaccccatctctaaaataaaaagaatacgaaagtgaggttaaaaggcatagaggataggctgagaaggtttaatatacatcctattatccaagtagaattccagaaggagaggaga

SEQ ID NO: 21963 - DNA, 1048 bp, Homo sapiens
actccaggcttccacggcacttttatctttatctcccttagggcctgtatcacctgacacaggagttagtggcacagtagagaagtttcatctgcctactatgttctagctttgagagtggagtctttgcaaaatttgatcctcctgctctaatttgctgttttttcatcttctcctttgcttaatcttttatatatcaattttgttaggaggcttgatttttattgtttgtggaagaataaggctttctaacatcttttcccttcctcactttttatatttagtaaatgccagaagtgcttattctttataaccagttcttatttatctgtggtaataggagtagggtgagcttgaaatcagtttccagggaacaaattttaactagttttaacattttctaactagcagatttcttagcaatgattgttaaaaaccagtctgttttaatttggcttctttttgtttatttctagtctaatcaacattctgactactagtaaagtgtagccataagcaaatctgatgataaataactgtagaaatgtgtttgtccttatagttaatattttaaaagctaattagaaagttatttcactttcccattgttttttctatagagttatttaaaatataaggccttttccttgatttgtaccttaaacattgtaagtttgaatgataattcttttttttctttttaaatatcctttcacaatatacgttagaatgatcatgccaattttcattattctgggaatactttgtgtaataatttccactataaatccaatttggagatggaaaatgaaaattggtttggtaaatgtcccagagttattttgaaaatgcaggaaatttggtgagctatctaccttggtttctcaaatgtgtaaatatgaaaagaattattggcttgttgccttcttactgtgaaaagttccatcaaggatatatatatatatgtatatatttaatttaattttattattattatttttttgaaatggagtcttgctctgttgcccaggtgggagtacagtggtgt

SEQ ID NO: 21964 - DNA, 1047 bp, Homo sapiens
accagtcgcagtattacaacttgaaggagaaactgaaggaagttccaggtggctgcaggatttgttgagagagtaaaataagtccacatgccacaactcttggtttctaatctaactctagcatttattcagtttttgtttgcttgttttttttttttttttttttttttgagatggtgtctcgctcagtcgcccaggctggattgcaatggcgtgatctccgcccactgcaaccaccgcctcccaggatcaagtgattctcccacctcagcctcccgagtagctgggattacaggcacccgccgtcatgccctgctactttttgtagtttttcgtagagacggggtttcaccatgttggctaggctggtcttgaactcctgacgtcaggtgatccgctcgcctcggccttctgaagtgctgggattacaagcatgagccgtcgtgcccggccgcttgttgtcgttgttgttgttgttgtttttaagtaaaattggaactactttgagttttgccccttgtaggaagctgtttatcttagaattcctgcaactccattaaaatacatctaaagtcaaaataataaaaattgggtacctttaaagggaaagacacttacattttgttaacagttgctttttttttttttttttgagacggagttttgcttttgtcgcccaggctggagtgcagtggcgcgatcttggctcaccacaacctctgcctcccaggttcaagcgattctcctgcctcagcttcccgagtagctgggattacaggcatgtgccaccacgcccagctaattttgtatttctagtagagacggggtttctccatgttggtcaggctggtctccaactcccgaccttaggtaatccgcccgccttggcctcccaaagtgctgggattacaggcatgagccaccgtgccctgccaatagttgctttttaaaatactgactgccaggccgggtgcagtggctgacgtctgtaattccagcactttgggaggccaaggtgggtgcatcacctgaagtcaggagttcgag

SEQ ID NO: 21965 - DNA, 1044 bp, Homo sapiens
atatatctaatcattcattttgaggtttaaacttaaaaatgttacataaaaaaataagtaacctgccaaaaaatgcagagtggcggcgggggcggggggagaggtggtgaacgcgaggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtgaggttcctctctttcgattcttagggtcgcgtcccgctgaaggtcagaaaactgctgtcagctcttgttgaagctagtcagtggagtctgacattgtgtgaaggtcagcaggcccagcatttcacctctgcctggagctcagtttagaggaaaggaataaatgaaggtggtttttggaatacttacgtaggctttctcttagtgctgaatacgaaacgaccgtgaaaacgtcctgcaggtgcaaagaaccatttcatgtggccagcactgtgacaacagtgaagctggtttctaaattgtctctccggcagagtgtgtgctttgtggcacttggacgtgtttaaagaatttgtccttgagttttccacctggttttgagtaatttttagtgatggagaattcaagta

SEQ ID NO: 21966 - DNA, 1094 bp, Homo sapiens
aaatgttattgccctcttttcaggccacttccttctcagaagatgactttgctgcttaattcaaacagaagggacagtccgaaagcatgatttcttccccacctatgaccacctccatccttttttgtttccagtttcagagaatgaggtaggcctttaaggccaactgactctggtctcctcctgtcatcttcaggaccttcctctgtcagacttcccctctcttatctccatgtctctcacctctctactgctgcttttcttggcttacaaatggtctcagtcatccagtatttgagattatattaggtgccaggcattgtatcaggcacttggaacacaaggcaggatcctgcccccaccaaagttgtgctccaatagcgtcaacagaggtgtgaaatagggagattacaatgttaatggtaaaagacaaagtatagggtgctacaagagcatgtaaatgaggcacctcaatgatttaatagaagtaatgtggagaaatgtgaggattgatgaaaagcttgtccaaaaagggccagaaatgtttagaattgctggaagtttgctaaggaatattgagaaatatgcatagatagatcgtgaagggccttgtaaaacagtgatgagacattgaagagttttcatgatcattagtagtaatgagaatttgttgagtttggcatgattatctccatattacaaatgtggaaacagattctgacaggataagcgacttacttgcccagggtcatgcagcttgtaattgaggagtcaggtttcaaatccagttttaactactttctcagaggcctttcttgatcattctatctaaaaagcaagtgttccctaactattatcccagtaccctggtttatatactcttaatacataaaataatccctgcatattgtgtgtttcccctactagattgtaagctccatgagggcagaggtgataacttttttcacttgcatcccagagcctaacatgatatgggctacatagaaggtgcccagtaaatattggtggatgaagaaatggtggataaccatttgcatttgacttatgctgactggaaattcaatacctttgga

SEQ ID NO: 21967 - DNA, 1052 bp, Homo sapiens
attacttgaatatgtcaaaagtatattactggacaaccttttacacattcctctttctaaaatcgaattggacaattacagttctctggttcagaaaattacattagctcagaacccagtaacccttgataaccctgttagcgcagcaattcccgagtgtgtgctttgtgcagagcgttggactatgtactgctcttgatgtggggacagcggggacagagagctgtcattgaaatagacatctgtttaagaagcgatacttagatgaacctctgtatttctgaaaaataaatgtgaaatatcttaagagcttaagtatgtttttttttttagatggttcaaatccagatcattagctcatcatttttattgcttctcattctgttaagcggcaaagggggaaatatttgttttgactagtccttcactggaaagttttggacttctgcatttgagtctctgggagctagtttttccagttgttttatcagagaatatattcatctttgggttttaaacacttcaaatatcactgatcatggtatagaacttctctgtgacagagtggtaagcacttaccacaaatgttttgtgatttgtgataaagatgatttagggaaataattctggtctcccaaaatatgagacaactattaacaaagcatttttgttttaggtttggattttctttcccttattccagttgatccccaggtatgtatcctgaatttaagcaactaatttgtatttgattgttggttatgtcatactaactaaaaatgaccagttgcataaaatcaggacagtcatctctgaattacttacattgatggaaaggaagtactgtgcaaatatttcacaattttatttgaaggaataaagttgttttcagtttatgatttttgtctttaatatctaaattttaaattctgttttatttagcttaatcagttggcatctcctacaagcatttgaatgattagaatgaatagaagcagtgctgggtggctagaagttaaaattttacaaatacagttttattttttagctaa

SEQ ID NO: 21968 - DNA, 1874 bp, Homo sapiens
gagagttctcctggctgtctacgaacacattctttcaaacttgggtttgctagtgtcatctttttggcctcttggtccacttggttttctaatggctttactgagttataatttacatagcataaaatgtacccatcttaagtatataatggcacaattcagtgattttagtaaatacatagagctgtgcaatcatcaccatgattcagtagtagaatattttcaacacccaaaaaactttcttcatgttcttttgtagtttattcctatttacaccccaaatctaggcaatcgtttttttgtgtctataatgcctgtttagacattttatataaaatgtcttgttttgcaacattgtttatttttataattttaagaattaaaccttttcagctgccttctttgctgttaaaatacttacatttccaaatataatttacacatatattaaaggcatatatttacttctacccatttaattagaatgaggtggggtttttgtgtgtgtggaacaaaatgaggaagtatttcaagtggattttttcctggtgtgccaatcatttattgctcctttgagacaaattggttggtacatctgtaatttaaatgataaacagaaaatgaagttataattttgaaatggttacgttcaaaatgtattttgaaggggaatgaatgcttagatgtgatgtttctggattttactctgtaatgatacgctttagaatatagtggaaaaacatgagttgcaagtactgcagttggctgaattcatgccaggttgagaggtcatgcctagtgatgctgactcatgagttgttgtgatcttggagcatgtctctggtggcatgccacaagggtctaccctctgtcctttactacatttttatctgtgtttgataagtccatgaaacaggagggatggcacatacacagtgggcgacaaaatctgaaatgacctcagtatgcagaggaataaggatagtttacatctgtgatcagctactatagagataaatgttaaggttcctcatttaggctgaaaagaaaacaaaaactaacattggtaagtataagatagaaatttgtgactaaaccagcaacacatgaaagtttattttaaaagtctgtataaagcgcagctacctagttcgttccatgaagctgatgtagcccttaacacccaacctagacatacatacacattaatacacggaagaactcttaagaaacagactcacatagaaagataaatgaaaattctgaattcagtcttaggaaatcatttaattatatattaaaatgacatctgtgaccaactagagtttatcccaggagtgctttaatattaggaaatacattgataagatggatctcgtcataaggacaactttgtagtcatcttcatggatgttggaaaggccttcagtaaattaattgccatttctgatagaaactctttcaaatgtcaggtttcagttaatggtttgaagagttcaccactgaaatcagtttgttcttagcattaataaaataagcatagtgtccaggatccataccatgccagttttgttccattttaggctatatgactctcagagcatttcagtcagtgctgatcatcaagaatggtattaacaaatgagtatggccagagcaggggaacgggaaggtgaatagtggaatctggagcaagatggatgagtggatcttaaggactgaagctgttaaaccaggagaagagattatttgatacccaccttgtagttcttaaaagggagacaatgactagctggattaagtttgttctttattaccagatttaggtccagtggactaaagatacatggataaactttctattggagctttct

SEQ ID NO: 21969 - DNA, 1026 bp, Homo sapiens
tcaccacatccggccagttaatctttttaattttagatcatactagtggtatatagtggtactccattgtgggtttatttgcattttccttattactaattgttttgagcatctttttgcgtatttattctccatctgtacgtttctttggtgaagtgaccaaacttttgcccacttttttttgtttgtttgtttgtttgtttgttttgagatggagtttcgctctgtcgcccaggctggagtgcagtggcatgatctcagctcagcgcaaccttccacctcctgggttcaagcaattctcctgcctcagcctcccaagtagctgggactacaggtgtgcgccaccacgcctggctaatttttgtatttttagtagagacagggtttcaccatgttggtcaggctggtctcgaactcccgacctcgtgatccacccgcctcagcatcccaaagtgctgggattacaggcatgagccaccgtgcctggccttttgcccactttttagttgggttttgttttcatgtcattgaatgttggtggttcttatgtattctggatacaaacgtcttaccaggtatatgatttttaaatgttttctatcattttatcttttcagtcttttaacagtgtatgtcaaaaagcagaagtgtctactttgaatgaaggctggtttaccaagtttttcttttatgaaagattgtgcttttggtattattttaagacattttccctaactcaaggtcacaaatattttttctgagcttcctgtagaagttttataatttacttttacacttaggtttattatttctatcaagttaatttttatgtatggtgtaagataaagaacaagggttttgtttttgtttggtatatggccatgtgattgctgcaccatcatttgttaagatttgtttttcctcattgaattgcttttgcaccttttacaaaaattaattgactatatgtgtgatctctgaactgttctattgatttatttgtctgtagttatgtcaatactgcat

SEQ ID NO: 21970 - DNA, 1025 bp, Homo sapiens
tacaaaacaccttcatgcattcattttccaggttcccttggtgcaaggaagacagcagctcatagtagggcttgtgggatggtgacatgcagtgtggacagacaagaacctgctgcagagaccatctcccatctttgactccaagggctgccagtgtacagactgacagccagatgagaacattccatgtttttaatgggcagaagaaagaaaaaggccctctttgtttagggagttattttaagaagctggattatttttcttctaaacaatttgtgagaaatatctataaatcttgtgtagctctaaggttgaagaaaggaagaagggttgacaagaatatttcttttaaagatcccaaagagtagagaggatatgtgctgtaattcagctggcagcaatctccaagtagttcctttggtgcagccagaagacttagcagtactggcccccttctccttataaattgtatttctgagttcatggatttatgttccctgatgttgtgtgttagttaccctgatggcctgtctcatagtaaatcaggactgacataaactcaacatttcttcttttaaaacacataattgtgtgcacactcaccccaatttgaagaggcacctccttacctgagaagggataattttgacatctgaaagaataatgattatagtagactcaaaactatcaaatatgtaagtgtgcttataataattatactaaagccactggaggttgcactaactcactgctgctccgaagattgatgaaggaagagaatcatttatttcaaggtgaccagctgttgatgtggtcaagctctttatggaaacatttcggctaatacaatcaaaagggtaatagaattagaaaatcattattccacaattcataatcatataatgggtctaggtagctatcatcaatggatgccgaagcttgacggggaacttcatggtagaggaatcaggctgacatcccctgaactcctgatcaatcttgacaccactgaaaacagggcaaac

SEQ ID NO: 21971 - DNA, 1024 bp, Homo sapiens
tccttaatggcattggaatctgccttgacagaggcctctttgtgataggccactcttcatttaccacatcctgtctgtttgctgcacttcattgattctttttttttttttttttttttttttgagacggagtctcgctctgtcacccaggctggagtgcagtggcgtgatcttggctcactgcaagctctgactcccgagttcacgccattctcctgccgcagcctcctgagtagctgggactacaggcacccaccaccacgcctggctaattttttgtatttttagtagatacagggtttcaccatgttagccaggatggtctcgatctcctgacctcatgatccacccgcttcggcctcccaaagtgctgggattatgggcgtgagctaccgcgtctggcccttcattgattcttttatgtcattctgaatatttaaaactcagcaaggcaactctacctttgagggagctagtatggtctttagagtaatactaagtataaagtgaattctgaaccaaccacttaggtccgtatgcccctagacaggtgactaaacctcactttctcagcatgcaaaattggaataatgatcaccacctcactgggtggtttgggagattgatgctataacttgctctgcctcttcttgtcctggtgagtagcatggccatctcttcagttgcagcattccaaaacctggataccctcctagaaactccccttcccttatcctgccttctcacatctagtcattcatcaagtcttaccattttttatgtgtgaatatcactcagtggtatttatgtttaatagctttcaggccctcatttgaaattactattattttttgagccagggtcttgctctgtcacccaggctgaaagtacagtgccgcaatcaaggctcactgcagcctttaatgtccgggctcaattgatcctcccaccttagccttctgactagctgggactataggcatgtgccaccatgcctggctgatttttctattttttgcataga

SEQ ID NO: 21972 - DNA, 1037 bp, Homo sapiens
taatatttgtatttttaatagagacggggtttcaccatgttggtcaagctggtctcgaactcctgacctcaggtgatctgcccaccttggtctcccaaagtgctgggattataggcatgagcaactgcatccagccttatgcgttttttgatgagtagaagttcttaatttttatgtgattgcatttatcaggcttttctttatggatagtgcttttgaatcttgttgaagaaatttttcaacagagttctcgaagatattttccattattgtaaaagtataagacgtagtttttttgttttttgtttttgttttttttttaccttttctcatttaaggttttaatccacctggagttgattttgtatacagtgtgaagtggtgaccaagatgcatggtttttcctcaaagaataataaattgttccatcacctttcatgcaaatttttttcttcactggtttggatgccatcactcatctgtgctttggttctggactctgggccgttagtctgtttttacagaaattgttaaaaagttacagtaactaaaacaagatgatgctgctgctagcataaacaaacttcttgcctggtgaggtggctcaaggctgtaatcccatcactttgggaggccatggtgggagcatcacttgagccaggagttcaagaccagcctgggcaacatggtgagaccccatctctgtgtaagataatattttttataataaaaaaccaaacttcttttgatatatagcatacacataggaagtacacagataatgaaattatagctggatgaattttctcaaaataataatcgtgcaggtcaagaaagagaacattaccagcactctaaatattcccctccccagtggctaacctcacctcattcttccaaaagcgacctactatcctaactttaacagattagtattgcctgtttttgaactttatataaatggaacctgtgtagtatatatacagttgccccttggtgtacctgggggattggttctaggatccaccctcccaaca

SEQ ID NO: 21973 - DNA, 1033 bp, Homo sapiens
tatacttttaacatatatacatatgtaaaatttatttatttatttatttattttttgagacggagttttgctcttcttgcccaggctggagtgcagtggcgcgatcttgactcaccgcaacctcctcctcccaggttcaagcaattttactgcctcagcctcccgagtagccgggattacaggtgtgcaccatgcccggctaatttttttgtattattagttttcaccatgttggccaggctggtcttgaactcctgacttcaggtgatccacccgccttggcctcccaaagtgctgggatcacaggtgtgagctactgtgtctggccatccatatttcttaaatccaaatgtttgaaaatgaagagaaaaaaactgtaaagtttcaccaaacttgtcttgcagaaaaaccctgacctgcactgatattgtaatctttgttgatctcacttagtgtgaatatttgtatgtttcactgtagagattctaggaatagaattgctggtatttaagaagaatgtgtgcatattcaccaatattggataatgtcagattatcttccaaaaaaggtggtgtcagtcttcgttctctccagcaatgcagaagttttcattactcagctttcttgctaacatctacttttgtcacacttcaaaaggttttatcggttgggcatggtagctcacgcctgtaatcctagcactttgggaggccatggtgggtggatggcttgagaccaggagtttgagaccagcctgggtaaaatggtgaaaccccatctctaccaaaacaaaacaaaattagctgggcatagtggcccacacctgtagtcccagctacttggcaggctgagatgggaggatcacctgaagctaggaagtgagctgtgatcatgccattgcacgccagcttgggcaacagagtgagaccctgtttcaaaaaaaaaagtttttacccacgagtataaaataccaccttttagttttcatttgctttgctaatgagtttgagcatcttttactatactgattagc

SEQ ID NO: 21974 - DNA, 1120 bp, Homo sapiens
aaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtgagcactgtgtttttgtttttgcaaatgcctcatcttagtacttctatatcccagagtgcaaaagacagatgtgatatgactaccaccccaaatcagaaggatgagcggagtggctaagagtatactctggatcctggtaacacaaaattagctctctggccttgggcaagtcacctcacctctcatgccttctttccttatctataaaatggggataatgatagtgcccaccacatacggttggtgtgagcattacgtgcatgaactatatattaagtacttagaatatcattgggcaaatgatgagtgctgtgcgtttgtgatgatgatgatgatgaagcaggactctccacatttaacagtctgaaaaaggttggtagaatttatctttacatttatctcagtggagaaagtcttcctaaggattaaaaaaaaggatattctttactacatttagacttcctcagagcaaagctgcacagagagagagctcagcctgtgggtagagagctctgcgtggtgcctggtgggtgggctgccttcaattttgccctgttgcttgggcacctgggtcagtgatgccttggcccaagcattatcaagtgtttgctagttgctgtgcactgagtgccctgattatggtgggaaataagcatattaagaaaaagattttgcctcaaggatccttttcagttgaagagctaaggaaaagaatacacacagaggcgttcctgtcctctgatgtcgtccctgacttcaggatggggcaaggtgtcccctccttcatgtccgtgtggcacttgaagagtgtacttatgtcttcacatgctcttctccccactagacagggctgcatctcatttttttaaatttt

SEQ ID NO: 21975 - DNA, 1035 bp, Homo sapiens
taattcagtgttgggattttgtccaaatattccatcagggagcagtcacagaagggccaggatcaaagtattctgtagccaagtagttctgaggaaagtgaagcactgaactgaacatcaaaatatgtcatatctggaggccacttcataattccagtttgtggctgaagaggggtctgtaagctttcactggtcagccctggtttccccagagcagttgtgattcagtaaacagagtgtgttattttagtagacagtaacttaagtgcctgttggcctgcccatgtcctcccctttatctattaccaggattaacaatttgtgatgattctggactccaaataccgatgatgtttatagtccttatgtattctggccctgtgtttgcatgtctctgaactgtgcgaaggttcttggctctagtctgtagatattaaccaaattcatcgctaatcaagtacagtggttttcaaacttttatagttaacagcagaaccagattttcaaaggaattctgacacagaactgtaacattcccgtatctaaaccagatgagagtaggtccatttatttgtttttagttgaagtagagctgggattcaaaggctcactattcagcctccactgcactcttgtcaggcttcccaaggcatttccataaaaccctaaattttcaaaaatatagctaaaaagtatcttataaaaatccctgctttagccataaaaaagaattagataataccttctgtgggaacatggatggagctggaagccatcatccttaacaaactaatgtaggaacagaaaaccaaataccacatgttattacttataagtgggagctaaatgataagacctcatggacataaggagggggacaacagacactgggggctatttgagggtggagggtgagaaagagtgccagaaaaattactgggtactaggcttagcacctggataacgaaataatctgtgccaaacccccgtgacacaagtttacctatttaacaaatgtactgtacccctaaaagt

SEQ ID NO: 21976 - DNA, 1081 bp, Homo sapiens
ttctgaaattaaggcagcaagtactgctgactggtcttatcatttattctctgccaggccctctagctgtggaagtgacaagaaagccagagaattaaatctctctctctctctcttgttttttttttttggaaagagggtctctggcacccaggctggagtgcagtagcatgatcacagctcactgcagctttggccttccaggctcaagcagtgctcccacctcagcctcctgagtagctgggactacaggagcataacaccacacctggctaactttttaactttttgtcaggctggtctcgaactcctgggctcaagcaatcttcccacctcaacttcccaaagtgctggaattgtaggtgtgaaccaccacacccggccaaatctttctcttaaaaagaaaaaaaaaaaacgaaaaacagcaatgcttcttaaagctttggctaggttcctgagaaaaacaactgagactccctatatagcagttggagggtaaactatttgttttagtaaaagataatccctggcccctgatcttttacttgtcacatttttatttgtatgtggaatatctagactaattatttactctctccatccaaaaattctccatccatttttttttttcattctggtggcataagaatagagactgggctgcaattaactaacttactatatgtttaaattacttcagtggtgatgcttaaattatgttaattccggtattgtagagttttatcttgttttgttgaagagcaattttttttttctgggagtcactcatctcacatgtgaaaaaatatgtttaagcaattttttggaacagatctaaaagaaaaaaagattgctgggaagtatggtttccaataaaaattgagtgcataatccatatagtacttaagacaaatcctttttaccatatgcgaaattgtggctgtggatggaaaggattgataattttaccaatgatacattttaaaacaagtaaagaaaatgaaactatcaataccatgtaaaggtggttttaaaacataattttaaataacatgatgccacagaactcatcctagccctc

SEQ ID NO: 21977 - DNA, 1050 bp, Homo sapiens
ttagtgcaaaggtccaataatcaaaacaggatgatgctggcataaggggagacatagatcaatgaaatagaatttaaagtccattaaaaaatccttacatttatatcaattgattttcaataagggtgccaaatagccttttcaacaaattgtgctataataactgaatagccatataaaaaaaagtaaaattggactcctacctcacaccatcttcaaaaattaactcataatcatagacttacaaactgtaagataaaaagctatacaacccttagaagaacatacagacaaaaagctctgtgagttttggttgggtaaaaccatctcagatacgataccagaagcacaagtgccaaagaaaaaatagataaattggatttcatcaaaattttaaaaagttcatgctttaaaagacaaccacagactgtgataaaatatttacaactcaggtatctaatgagtgatttctatccaaaatatataaagaactatttgaactaaataataaaagataaataactcaattaaaacatttacaaaggaactgaatagaattttttccaaagaacataagcaaatgatcaataagcacatgaatagatggtcaacattattaatcattagagaagtgcaaaccgaaaccataatgagataccacttcacaccaaccaggatggctataataaaaaagttaataaataataaatataataaataaaaaagttaaaaacactaaataataacaagtataggtgaggtggtgaagaaattggaattgtcgtatattgttaaagagaatgtaaaatggttcagccacttcggaaaacagtctggctgttcctcaaaatgttaaacatggttactatatgacacagtgattctactcctaggtataccaagagtattgaaaacaaacatggaatgttcaaaatagcattattcataaaagccaaaaaatggaaacaacccagatgtccatcagctgatgactaaactgtagatatctatactgtagaatactatttggcaaaaaagtaatgaagtatt

SEQ ID NO: 21978 - DNA, 1046 bp, Homo sapiens
aggggaaagaagaaactagagaaactggaatgcttcctatctgacccccaagtacagggactgcctctttccgtaacggcacagaacgtctccatccctttgacctccacctccccagagatgcccgaggaggacagccttgtttctgtgatctgttgttgagaactgctgctgagaattcttccttcagcaccgccttaggcaccattggtttttcactaggtccgctgtagaaaacagccaggaattacttagttgactaccacctgaggtgctgtttggtgttggtaataaagaataaaggtggaaatgaagcaacgagactgcttttctttgtggttcataaattaattctgataacagtttttaaaagagaagtcaaatattttgagcagagccaagctcactgacatacctaggtggtcttagatgtagccaatgcgccaggtaccacaggacgcctaaatttgtatcagtgtataccatcactagttatgaataagaatgccttcttgccacatatcctcattaactcagtgtattatcaaacttatttaactctttcaggccaggcattgtggcccatgcctgtaatcctagcactttgggaggccaaggctggtggatttcttgggcccaggtgtttgagacctgccagggcaacacaggagtttgagatcagtctgagcaacatggtgaaaccccacctctacaaaaaatacaaaaattagctaggcatggtggcgtgtacctgtggtcccagctactcaggaggctagatggaaggatcacttgagcctgaaagacagaggttgcagtgagctgagatcacaccactgcactccagcctggggggaaaaatatttcagtctgagaggtgaaaaatggtaagagaatttgatcttttcaaaaggtaatcatgtttctcccatgctcaagaccttcactgctttcttattgtgcttacaatgaagccaaagtcctttagcatggtccagaaggtgctcatggtctggactcactatctctctgactttatctcatga

SEQ ID NO: 21979 - DNA, 1082 bp, Homo sapiens
tatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttg

SEQ ID NO: 21980 - DNA, 1034 bp, Homo sapiens
taaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagtttggagaatagaaaaataaggctggacaattaaattgagacaaactagatgtaggttaagaggaggaacttcattcagaagtagaaggaatacttgctaatgtgccaggcactgtgctgttttaagtgtagtatctaaaaattattatttctgttgtcaattcattctttgtaaggttgaaatatatgaaattgccatcgttgcaggtaacacatggttcaaactaatacatatttggaaatagacatagaaagctgataatttgcccaaggttacattataagtggttgagatgggactggaagatagttctcctggactctttacctcttttataaggatagtagtaacaattatgtttaagttttacaaaaactaatttgtcatcagtggataagatagtctagattattgatgaattaaacaatagattggatttcacatcaaagagagagaagacttcttgaccatatttaagagtaggaattaagtaaaatacttagtctttcttcaattcgtattgcttactccatatgcctgcttaagaaatattcatgtaatatagtgattgtattcctgcttcttccagcaatttagtcccttccaaatttatttgttttggacttgcttgtctatcttaagttttgtcagaaatctgatttgagattgtgcaatgtgaggtctacttgttgaatacatttaaaaatatatggtatatatttgtatcagagaatgaagacttgtcactatttttttctgagttatattggtagaataattcattttgtgattttgctgtagttctgttttgattattacccttttgagatgttgttacctgtt

SEQ ID NO: 21981 - DNA, 1048 bp, Homo sapiens
tgaaggaaagttagcctaattgaggctgctctgccattactggaattagaacctccattctgttttgtgtattcttttactaattgcatactgttttaattattgagaatttattatgtgcttcagaatctggtaggacaggtctttactatttgttagaattttctggtcatacttatttgttttggcttattacagtatttggactaatacctggatttttaaaacatttatttttattgagattgcatcaaatatataaatttggtagagttaatacctctatgatggtatcttcctgtgtagggacgtatgtttttcttttttgctcagtgcacttttgtgttctttagttatgtttaaaatgtttctttgtatagtttgacacagttttaattacatttatctagatgctgcttatacaactctcactatctaagggggattggttctaggatttcccactcataccagaattagtggatgctcaagttctgataaaaaatggcattgtaagcctgggcacgttgacttacttctgtaatcccagcattttgggaggctgaggtgagaggatcacttgagtccaggactcaagagactttgtctctacaaaaagtgttaaaattagccaatcgtggtgacacacgcctatagtcccagctactcaggaggctgaggctggagaactacttgaggctgggaggtcaaggccgcagtaagccttattttaaaaataaaatggcattgtatttgcatataacctatgcacattttctcatactttaaatcggctgttcccaaccgttttggcaccaggagacagagtcatgaaaggcaagttttccactgaccgtggtggtgcggcaatggttttgggataaagacgttccacctcagtcatcaggcattagttagattctcttaaggagtgcccagcctaaagccctcgcatgtgcagttcacaatagggttcttgctcctatgagaatctaatgccactgctgatcttccaggaggcagagctcaggtggtaatggtctctccc

SEQ ID NO: 21982 - DNA, 1049 bp, Homo sapiens
cactaaaagaaaagaatgtaacaaatgaatacagaaaaaaattggatatagaatatgtgataaattcagaagaagacaagaaagaaaatataaaacaagcaggcaactaaattagtaattatgttacatggaaatgggctaaatatttcaagtaaatggcaaaaatcatcagactggacaaataataattacctaaatataagtacctagaaagattgagagaaaatgatgcgaaaaggtataccatccaaatgctaactgaaggaaataagtgtggctataccaatcaggcaaaggagactttaatacaataaacagtagtagaaaaagagaactacattttatagtgtaaggggattgatccaccagagttaccacaatcctttatgtgtacccagtaaaatagcccaaacatctataaaccaaaaattttattttgaactaaaagaaacagacaaatatgccatcacaatggatgcacatatataggacatacatacatcacaattagcaggcttgatctaattgtcatatgtagaacattgaaactattaatggtggtattaaccatcttttcccttgcacatggaaattgtactagaattgaccataagctagggccatgaacaaagcctcagcaaatatcattgattttaataattgaatatgttgtttgtattatagtaaataaaaataactagaaaattcctagctgcctagaaataaaacactatgcttttgaataacatatgacttaaaataagaatttatgatggctattagaaaatattttaaactgattgaaaatgaaggtgaactacaatgatctagattgctgctgctgaaatgctaagatgaaatttatagccttaagtctatgcattggaaaagaaagcttttttaaggaggtagaaaaggaataggaaatcaaacctaaagacagtagaagtaaagaaataatgaagacaagagcagaaattagtgaatagaaagtaatcttacatagagaaaattgacaaagctaagaaaaagttggttctttgaaaaga

SEQ ID NO: 21983 - DNA, 1004 bp, Homo sapiens
tgagcttacctttttgtgtgatttttaaattttgttggtttatgttacatacacagatttgagtatcccttatccaaaatgcttgggacccgaagtggttcagattttttccaatttttagaatatttgcattatagctgtatagtacaatgaccgtttttttgggggtgtcatgttggtactcaagaagtttcagattttggagcattttagatttcagttttcggatttgtgatgctcagcctgtattttttttttctttttctatttctttttttttctttttgagacatggtcttgttctgccactcagcctggagtgcaatggagtgatcttggctcactgcagcctccgcacccctgtgctcaaatgatcctcccacctcagcctcctaactgggagcacaggaggcaccacgcccagctattttttttgtattttttgttttttagtagagatggggtcttgccatgctgtccaggctggtcttgaacactagagctcaagcagtcctcctattttggcctcccaaagtgctgggattacaggtgtgagccaccatgcgtggctcaactgtatttctcttgtggttaatgctttttatgttttaaggtcatgaatgtattctgtgttttcctctaagagcttaagattctgctttcccattgaagatggtatgcacttgtggttgaggcttgttattttccatgttgttgaaaagttgttgaaaactagattgaccttgggccttactggaaaatgagttgactgtatatgtgtgggtctatttctagacttgttctgttccactgatctttttttcttatgcctactctatactcttgattactaagtctttttagtaagccttgaaataaggtggtgtaaggcctccagttttctttttcaagaatggtttggttattctagtttttttttttgtttccatatgaattttatatcatatgaattgcttaactctgctggaagtttggtagggatt

SEQ ID NO: 21984 - DNA, 1047 bp, Homo sapiens
cctcccaaagtgctgggattataggtgtgagccactgggctcggccagttctgtgagttttggtaacttgtactcatgtgtgattacctctcaagatagaaaacattcaggaattcaacagtggatttacaggagcgagggaataaaacaaagatagagaacacttttgtcaccgtagaaaggtactttgtgcttctgtccaaacatttccacttctcttccttagtgcctctgagatggtcatcttgacttgtcattagattagttttgcctgttgtgggaagccatgaatgaaatcagtctatatttctttgtcttttgcccagcatgtttttgagactgatccgtgttgtggagtgtataagctcattcatatttgttcctgagcagtattcctttttatgagcacactataattatttgttttcttttgatattttggctgtttttagtttttggcgattattaacatggctactatgaacattcttatacaggtttctttttgtggacatacgtatttatttttcctgaatgtgtgatacagggtagatctatgtttaactttttggaacttgccggttttccaattgtgctatataccattttatactttcatttcagcagtttatgaatgttctagttgcttgatgtggtagactgaatcatggtctccaaagatattcaggttctaatcccaagaacctgtgaatgttgttttatatggcaagagagactttacagatgtgattaaattaaggatcttgagatggagagatgatcctggattatctgggtgggctttaaatgtaatgccaagagctcttactagaaggccatagagggagatttgaatacagaagagaaggcagtgtgacgatggaagcagagattggaatgatgtgctctgaaggtgggggagagagcacaagctaagggaagggagcacaagctaaagactacaggtaaccactagaagctgaaaaaggcaaggacgaacttcccctcagacactccaggaggaatcagtcctgccaacactgtgac

SEQ ID NO: 21985 - DNA, 1049 bp, Homo sapiens
gtgcgggcggccggtagggctgcgggcgcgcgcctgaggggaggaggggcagcgcgggcgcgcgcgtcctcaccccctccttccccgcgggcggcggccaggctccctcccctccccttccctctcctcccctcccctcccctctcttcccctaccctcccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggtaaagcctgggcgcccgcgggcctccagctagggaagtgtttgcgtgcgtccgcggccggggcgatgggccgtgtcacatggccgctgcgggtgggggctggggtgtggtgagttcgggggctgtgggtgcgccggcccgggcgtgcgggttcggggccggagagccgggaagggacggggctcggttgcactgcgctgccgcccaggctgacgggggcgggggctgcctgcgtcccttcccctcgctgctctcacactccatagtttgtggttctgatttttaaagccgaagggccagagctcttgtttcaggagttgtggggaagccttgttagggacgcgtaatactttgcctccactttttttttttggtctcgtaacctttgttaacagtggtagtctcgggttttccatggcttgtgtgtactcacaaacacgcacacagctgataactctgtgatcatccttcactcacttgtgaaagttgttctgcgggtggagcctattagtttttatcacacgcctttggaaagccctcgaagtgatttctcgtatttcaaacttggtttttaaaattgcaacttactttgttctcttggagggggatattgtctttgggtcaggtacttttgtcttttacttatccttaaaatgtccttttgatcctaaacagaaaaagaatgcctggg

SEQ ID NO: 21986 - DNA, 1021 bp, Homo sapiens
atgtggcctgagttcagatcctggctctgagctgccattctatgaaaagagaataataatatactgacttcatagaactgttggtaaggattaaaagaaattatgcttgcaggccaggcaccgtggctcatgcctgtaatcccagcactttgggaggctgaggcgggtggatcacttgaggtcaggagttcaaaaccagcctgaccaacatggtgaaaccccgtctctactaaagatataaaaattagtcgtgtgtggtggcgcgtgcctgtaatcctagctactcaggaggctgaggcaagagaatcactggaacccggaaggtggaggttgcagtgagccgagattacaccattgcattccagcctaggcaacagagtgagactccatctcaaaaaaaaaaaaaaaagaagaagaagaagaaagaaatgatgcatgcaaagttcttagcacaatgcttgccaccattatgattattttcctattcttgggggtaaacagtgggtcttttctttgatgtggtctttgcaggaggccaagctcgttgttttgatctatgtaggggccgtttggttctgccctgttcccccatccatcctacaagcctaaccttggcctactggcaagacagatggtccttgtcttactggccttgcagtggggtgaaggtcattgttctgacccactaccctggcgatttgtcttggcccacattgctagatggggaagggctgtgggttggctcagccttacgcactgtctcctggcagtggcatgctgactagcattaggggtgaggccaacctctgcctcagtatgctggagccagctagagaagatgctttcccggagggtgtcagagccctgtttggtgttgaaacaacacagaaactgctgtgctcaccccttccccatctagcagtcagccacccagcccagcttctggtccttctactcactgtgactcctcacacattacaaccacatgagcatgcatgcatacacacacgcgtgcacacac

SEQ ID NO: 21987 - DNA, 1030 bp, Homo sapiens
gttatactgtatcatttagggataatggcaagaaaaaacagtctgtaatgttcagtgcagatgcaactatccttgttttttcctcagaatattttaaatccatggttggttgaatccagggatgcgaaacctatggatacagagagccaactgtgtaaatttagttttgctttttatttataagctgtggaggccaaaagaacctagctgttaaagtggtcatctttttcaattcatatgactgatcagaatcacaactcggatagttttaaaataagctgggagactccctttcccttccatcttaacgttttgataccaaattattttaccttaataaagcgagtgtaacactgcctccctatagtgaatgcacagacttctctacttatcctgggcctggacacaacccaactcagtgtcaccaagaatccaaaattgaagtcaaaaaaagaatgtgtcttgtggttccaaaaccatggaagaagaaaaaatggattaaatggttaaagaggaagcttagggctcattggcattcccccattccttgttttagacgtggttattatcggtgggtgaaattagcctcagcctctctgtagacctccagcatgtccttgttgctgctgtgacgtgggtttgcagggtgaatttaatcaactccaggcttccttactgccaggccaaggctgccagcctcttgaaagctcactcgtttcagattttgtttttttgggttttctaattttttctaattgagggcctgaagccattatttaagacttttccaaacttctcttgccttcaagtgttcatttgactattttatgggggtggggggaggtggtattgtttgtgttttctaagcaaaccaaaattacatattttttaatctgtcaagttaacctttgacaaaagtttaccttaattcagtaaacatatttgtactttggccaattctgaattaacttgaaaagtgttaagatatttttaaatttttaggcataaatatagcacatatagagttatg

SEQ ID NO: 21988 - DNA, 1026 bp, Homo sapiens
aaggtgggggaagtgctgtatttgaagaaggcatttacatctgtttgatagatgtattcctgaagcagtctcacaatataaaactcatacttcaagactaattatcccataagaaaaagatgtaaagaagatcctttggggaatgcatgaatgtacagcattgcagcttacttttactttactgttctttttagttttttcttcattagctctaattttttagagtgctttcacctaaattaccaacacaggaggtcatagtggatatttggccttcatagtgttttgtcacagttcacgtctgttccagtgttgttactgtttttgggggctatgtttttcagcactatcactagaaccactgcttaatgaatgcttgagagatattgttgtaggatataaaaatattttcaattataataacagagtttgtaaaataacagcacattagtcatcataatcatttactgaagttccactgtacataaacaacagggagattcacacggtactgtgcaaagatggcaaatgttctgtttatcagccaaagtggcaccaccatgtggtaatagcataaaaacaggttagagttcactgggccctccagcttggatgtgttcctattccagataatttttttaaatatagagaattcatattgtttccatttttacataaagtaagaccttggtttgttggttggtttgggggtatttttgtgggatttttttgaactatttcaaatttatgtaaactataccatgtgaaccagtacaaaaaaatctatgaagattaaagtggctactcccaggaagtgatggatcttggtgtgtaagctcagtcaagaacaaagtagaaatatcgaggctgccaaaaaaggacactgcaatggagtctggggaaggttaatcttgtagttcactgtaatacttaccttaaagcaaaatgaattacagtgtgcaggctaagtgctggaatgttaatatttgttcatttattatactatattcaaaaataaaatgtcat

SEQ ID NO: 21989 - DNA, 1029 bp, Homo sapiens
acaacttaaatcactgctttttacgtattggggaatgtatatccttatttgagtagtgctttttaacttcaagaatgaaaaagaatcaataagttgtttttttcagaggatgaggtggccttattgatttataacgtgtggaagtttgatatctctctccataatcaaaaccacagaactcactttctcaatacctattgtgttttttagcataaagaagccatatgtattatcatgttatttttcctaacatggttctgtaggtgatagtctctgattttgtacatttagaaaagtgaatttttccctcttacataaccaaatgacatttcttctggtggtctatatttatataaatacaatagttattttctggcctattaatatttgttactcaaatatttggggagagtttcattctcattctgttatttttagatatattatcatcccattaaaaatatctttctgatgtcctatttcagctttgaattttaattccttgtatttgtcttaaactgtgatgttcaaaaatcagtgttacctagaattaattgtcttgtttaatgtacaattctgctgaaaaatatgttaatgggatttctaatgccttagctcattatactagctcactaaatgtatagtgtttggcccaaaagtgacagctttccatgtgtgctattttgtttatttattactgtccttactgtcaatgtgaacaaatgagcacagagttgatactcagaattgggcaagttgtaggtgttaggagcaggacaagaccagatcttcacttcacccattttccccatgagattgcaagagtaacttttcttagactgtgtaccagcagcggccgggcgcagtggctcacacctgtaatgccagcactttgggaggccgaggcgggcgatcatgaggtcaggagattgagactatcctggctaacacagtgaaaccccgcctctactaaacatacaaaaaattagctgggtgtggtggcaggcgcctatagtcccagctactcgg

SEQ ID NO: 21990 - DNA, 1039 bp, Homo sapiens
tttttttcttttctttttaactgaatggatttataattctaagtacgtgtaatatgaaatcatttttatatctcaactgtagcactttcaaatttaggaatacttttacccatttgtcatgtcttttatactgtgctttaaaaaaaatcacatctggtgccattttattactttcaaaggattgcatcttcagtctaaatctaagacaaagctctaatgagtttcctcaaaacaagttttaaaaattgctggaatggtcttgtcatataatatgctattcacttaatctgtaatgaataaatacttgaagctatagtaataatttttcatgcatatgatactgtcgtaataattctgttgtggctgtgctttattgatttctgtgccacttctgtggcatgaaatgaaatgtattatcccacttaaaccattatggtttccttttgaattacatattcattacttgatcctgtcatcaagcctattctattttccataatgtggtattcagtcttaaagatttacagcgttagtcagtgcagtataagtcaaaataggacaagtaaattcagatcagaaaagttggtaagaaaatgtaatagataaatttttttatttaattatactttaagttttagggtacatgggcacaacgtgcaggtttgttacatatgtatacatgtgccatgttggtgtgctgcacccattaacttgtcatttacattaggtatatctcctaatgctatccctcctttctccccccaccccacaacaggccctggtgtgtgatgttccccttcctgtgtccaagtgttctcattgttcatttcccacctatgagtgagaacatgtggtgtttggttttttgtccttgtgatagtttgctgagagtgatggtttccagcttcatccatgtccctacaaaggacattaactcatccttttttatggccacatagtattccatggtgtatatgtgccacattttcttaatccagtctatcattgttggacatttggcttggttccaagtctttgc

SEQ ID NO: 21991 - DNA, 1128 bp, Homo sapiens
cagtttctgagtcagtgtagaatttattctgcattttctgtttcctctttcaacacctttcctggaaccccctccttccttacccacttgggtttctcagtactctcagctggggtttacagtatgaagcctccagggggtattttttcaatatcaagccctcctgaggccctgcccatttttttctgaacaacagagaagaaatacagtgttaatatagtgtagtggctaggggcatgggctctggagttaaggcttcctccccatacccccaaccaactttcactccttgccttaccacttgcagtctgggacaggacagaggacactgttctattcaggacagacctgaatagatttgcataaaaggaattacctcgccatcttctcttgccgtgttcctttgcaggtgacaaacattttgcatacacagtgacacatggccaggtggagtgtagtccctgcaggtgagagattttcttcaacagaactacattatatagagagacaaaccaagccaaatatctgaatggagcaatcatggacttacttaacaaaatcaaatagctttctgttatgcggaatttaaaaatgtaactcagtttctagagagaaatataagcttatttcttaaaaaagaactttaccagctgggcgcggtggctaatgcctgtaataccagcactttgggaggccaagatgggcagatcataaggtcaggagatcgagaccatcctggctaacacagtgaaaccctgtctctactaaaaatacaaaaaattagccaggagtggtggcacacgcttgtagtcccagctactcaggagtctgaggcaggagaatcgcttgagcctgggagacggaggttgcagtgagccgagattgtgccactgcactccagcctgggtgacacagagcaagactccgcaaaaaacaaaaaaacaaaaaaaaaactctaccttagtcaaacatgacttactgctatagatagaagtcttactccactgcaaacttcttccaaatgtaagaattcgtttcacagcaaccctgaaagagagcacttctgtgtgctgcttacctcagaaggcagtaaagctcttgctgtttcatttttagaaagattagaat

SEQ ID NO: 21992 - DNA, 1067 bp, Homo sapiens
cagctcactgcaagctccgcctcctgggttcacaccgttctcctgcctcagcctctcgagtagctaggactacaggcgcctgccaccacaccctgctaattttttgtatttttaatagagacagggtttcaccgtgttagccaggatggtctcaatctcctgatctggtgatccgcccatctcagcctctcaaggtgctgggattacaggtgtgagccactgtgcctggcctatttacatattttttaaaaatttgtaaatgggcatttcgcaggccattctcatataagagggagaattggaagtcctttgaaatatgttttttaaaaaggttttaatttttaagttatccaaagtgacacctgtaatgtgaataggacattccagaacaaaaaagttgaaacaaaattatcagtgttttatacaaattttgtactccttgtgtagctagaaatcaaacgtttcatattaaaatgagaattgaattagtttaaacaagttttgtttgcagaagtctctgattccttatgaagaggaaaagaatatgaaaattttatagtattatgtttttatattgcacttacaaaattgagtgaatattgtgtgatgatcgaaagattttaggcattttttcaagccacagtttttttttttctttcacagtgatatatggtacttactggaaattttacttttatttcctaccatatcatttgcacctgttttgctggtgtgtgttgattggtcttattctatctcgtaagtaattactgaccctgactggtctagacactgactggtagcagtgtaatgtcaggccacttaaaaaaggactttcttaaaattgggccacagactaaatgttattaagtttgaagtatcacaccatatctttgttgcaactaagaaagtgaaaataggccttattaaagtctgtttaacttatatcattacatctatttttaaatttttttcacaacttgaatagtatttcactttagcttctgttattctttagcttttgatcatgatattgctatgtgttgaaaggatttcatcaggtgtat

SEQ ID NO: 21993 - DNA, 1033 bp, Homo sapiens
gccatagttttggtccttagtcatttagaatctgattgagttcggggcttactctatcactcatattgctagtcagtgttatatggatgctgtcttatttaattataagtctagccatctataaggtacagaatttctgtttaataggtgaggaaactgagactcagactgaaacttagccaaggtcatgtagctaatagtgtggagctgaaattgaaatccaagtttgaccctagcgtagaaatgttctttttggcagacctgacattgataaagctgaaaaggataggcagacatcatctaccttatacctgcactcagattctcagttgtgagtgagtagaatgtccactatataaagtttctgtgcagtcttggatcacttctgtgcattgattctcgaagtgtgttctgtgggccacagagagtccatggagtctaagccttttataataagacatcatttgccatttccactgtgctgacatttgcatcaagggtacaatagcaaagttggggtaaaactgctgagaccttagcataaatcaagtggtgcctaactgtactagtactcactatattttccacaaccacacacacatttgtggtaaaataaaaaccatcttcactgaaaaatgtccttggcgaaatagtaaaaatgattagttgttataaatcttgacccttgagtacatctttttgatattttctgttgtaaaactagaagctcacataatgcacttctactccatactgggttccaatgattgtcttgaggaaaagcaggtgtgtgatagagttgtgagctgaactagccacttttctgatggaatagcatttttacacgaaagaacatgagacagtcttggcagagaggaaactgccagtgttggttgccaataaaaaaaattttcaagtcaaaattaaaatttcgaaaaacttatatttggcatcatgagtttgacaacttcctaataatttagacttttgttataacatcaatgatgttagtaaatatggattttaaaaacta

SEQ ID NO: 21994 - DNA, 1025 bp, Homo sapiens
aaatgtccatgaaatcttcacaatttatgttcagagactgcagtaaagacaggcataagaaattataaaagtattaatttggggaagtaataaatgtccatgaaatcttcacaatttatgttcttctgctatggcttcagccagtccctctgttccgggtccctgatttcccgcaacagttacccagtaattatcaaaggaaaaagatcttccttgttagagggctcacagcaccatgtcttgttcttgatggtgcagtaggtatttgaatgaatgatgaaattctgatacttgaattgagctaaaacaaatggttaaaatctactggctctataggtaaggaggaaccagtgtgcctatagactaccttgtttttgggtttttttcttcttcttcttctgtgaagctggtatccgtcacacacatactggatcctatgcaatcggttatttgtgttatccaataatatgagtattatttatattttataatgaagaaactaaatgtcagagaagtagcttgtctatggacagtgacaacattggtatttaaacctacacctgtgctctgtctacaacaccttcctttgccagtgcttcttataagtgaagttttaaattaaaaacaagtaatttgtgtacttggtcgtttaatataacactttacttaggggcagttgttgccagtctttctaaacatgtgatccccctgttgacatgtttttaaaaactcattgactatctttcagtagttactgactgaaaagatttgagggtgaatagtgggggtcccagacaccctgtgacagatggtctaagcagcttttcccaatcggagttcatgagaaaatcaagtccagcggagaaccagttaagtgaggatttcctcagttctcccaaggagatagtcatacgtagcaaataccctctaaatgagtaggagagaagttagttgatgacaaaacttttgccttcttaggaatcctggtttaaaagatctgtgaggacttcggggtttgaggtcca

SEQ ID NO: 21995 - DNA, 1053 bp, Homo sapiens
accagagcatcgtgtcatgcaggagggagcttgttggaagtgcggagtgtaggtgtggcttttgacctactggatcagagtcttctttctaacaagatccccagatgatttgtatccacattaaagtttagaaaacacttttgagttttggcctggaaatcattatgtatttcctgagaaaatatttgtcttgagctggaaatgggggccagcttttttgtactttgaggaaactcatttcctactaaatatttgtgtttagggtatagaaatgtaaagtatgataagggatgcatgacaaaaactgtttagatacccagaagggttattacagcagtacaactcagaattcaccagatgctctagtaaccacttcaagtgagaagtaagcagttttcatatacatgattcctaaatcctcttttagaaagagactacacaattttatatttgtcagttgcaaaacttagaagagtcagtatttcacatgatcttcaacaaaatgcaaaacagataacatgttacattgctatgaaaggatgtggataaatctttgaaaagcctccttagctggacataaatgtaaggaatgattccttacagtacctaggctgttgctcatacttaatgaccatgtgccttctacagactcttggtgttctaggagaatcacagatctaatttgagttttgcttaactttgtaagtcttttggatatgccataagtgtgcatatttgctgcgttctttatttgggattatgaggttattgaatttcaagacatttataaagagtagattatatgcaaggcattgctttagattagaaagataccatttacttccagcccttaagactgtcccttattgtctctcatgtccctccactggctgtttcctctggcttctccttcaccctttgattaacaggtagttttctctagtatctcattctgtcttgttttcttctgtctttacacattttctctgggagatcacatatatgtctatgactttatctactgtcatttgtatactgaaaatcacctgataa

SEQ ID NO: 21996 - DNA, 1032 bp, Homo sapiens
caggcaacctacagaatgggagaaaatttttgcaatctatccactgacagaaggctaatatccagaatctacaagaacttaaatttacaagaaaaaaagcaaacaaccccatcaaaaagtgggaggatatgaacagacacttctcaaaagaagatatttatgcagccaacaaacatatgaaagctcatcatcactggtcattagagaaatgcaaatcaaaaccacaatgagataccatctcatgccacttagaatggtgatcattaaaaagtcaggaaacaacagatgctggagaggatgtggagaaataggaatgcttttatactgttggtgggagtgtaaattagttcagccattgtggaagacagtgtggtgattcctcaaggatctagaaccagaaataccatttgacgcagcaatcccattactgggtatacacacccaaaggattataaattattctactataaagacacatgcacacatatgtttactgcagcactattcacatagaaaagacttggaaccaacccaaatgcccatcagtgatagactggataaacaaattgtggcacatatataccatggaatactatgcagccataaaaaagatgaattcatgtcctttgcagggacatggatgaagctggaaaccatcattctcagcaaattaacacaggaacagaaaaccaaacacttcatgatctcactaataagtgggagctgagcaatgagaacacatggacacagggcagggaacatcacacattagggcctgtcggtgggtaaggggctagaggaggggatagcattaggagaaatacctaatgtagatggcaggttgatgggtgcagcaaaccaccatggcacgtgtatacctatgtaacaaacctgtaccttctgtacatgtatcccataacttaaagtataataataataagacaaaaaacttgtcaacaccagatttgttcttttagttaattttagtttttagtttttagttagatggattttaggagttagtttggaaga

SEQ ID NO: 21997 - DNA, 1096 bp, Homo sapiens
acacaaaaattagctggacgtggtggtgcgcgcctgcagaccccgctacttaggagtctgaagtgggtagttcgcttgagcctggaaggtcgaggctgcagtgtgctgtgatcacgccaccgcactccagcctgagtgacagactttgtctcaacaacaaaaaaacaaaaacaaaacaaaaccctaaagatatacacagtagagagaatggtagaatgaactcccatctacccacaacccctgctcaagaatgatcaacaatctttttttcccatttatctgcattctcctacttaaaaaaaaattttattttgaaataagttcacacatatagaaaagtccccaaaataaaaatatcacaaaaaactatatgtaactttatccagattgatttattgttaacattttatcccatttgttgtgttttttctcctcttctgtctcattctgtactttcttctctctctctccccctttctctttctctccccccaccacacacacacacacacacacacacacacacacacacacacacacggttttttaaaatcatttgaggataagttacatgcatcgtaatatccctttactcctaaatactttaatgtgtatttcctgaaagaggatatcgcttatgctaccacagtatacttaccagcttcagtaaatttagcatccaactgtccttaaaagccatttgcttctacgtcaataaaaataagaaaatggatattttcctctgtattttaaagtctcctttattgagtatagcgttatttgtatttcacttaagttgaatttttacaattaggtattcttgtaaccactctgctatcaatttatctatcttacactaaaagccccatgaggcaggatccacctctcttccttctgtttattattggcactgcagtactcagtgagtgcttggttggcattcaatcagaatgtaataaataactggaagaattactaataccttttaattaccactagtaagtttttaaaattagtgtaatagaaattaacttatagattttaggttttttttttttaagcttttcaaatgtgtcaagtgtggtttacttcagtc

SEQ ID NO: 21998 - DNA, 1036 bp, Homo sapiens
tgttcatctcatttgttgcttttaaaaatttaaagtagagacagggcctcactatgttggccaggttggtctcgaactcccagcttcaagtgatcctcccacctcagcctcctaaagtgcctggattacaggtgtgagccaccgtgcctggcctcatttgttacttttaaagcagtgattctccacctttaaaaaaaagtattggccaggtgcagtgtctcacgcctgtaatcccagcactttgggagcctgaggcaggtgtattgtttggatgcaggagttggagaccagcctgggcaatatagtgagaccctgtctctacttaaaaaaaaaaaaaaaaaattaggccggatgcagtggcttatgcctgtaatctcagcattttggaaggccaaggtgggcagttcatgaggtcaggagttcacgaccagcctggccaacatggtgaaaccccgtttctactaaaaatacaaaaactagctgggcgtggtggcgcatgcctgtaatcccagctactcaggaggctgatgcaggagaatcgtttggaccaaggtcgggaggcagaggttgcagtgagccgagatcacgccactgcactccagcctgggctacagagcgagactacgtcacaaaaaaaataaaaaattaaaaaattaaaaaaatatattgtccccctgagaagccttgtttgacatttctttgataattgcctctcccacttaatgaaatttgaatccccagacacactgaatatctgtttatgtcctgcagccctttggaggaccgcaaaccattattattgtatctatgaagatttttacttacctctgtggaaccaatttacatctcctgttgaaaatgcatatgtacaaggaattatttttgaaataaaaaagtagattttaatgtttctcatcacagaatctcagtctacatggagatataattggaaatgtgctatttgtctatggccccaaaaggaaagacaggtatttgtgagaaaataggctccaggctgctgtcgtacatgaatgca

SEQ ID NO: 21999 - DNA, 1051 bp, Homo sapiens
gcctgaggtttgtagagattcttaaatctgtgagttggtgtcttttatcagtattggaaaattcttagccattatgtgtttatatataaaatttttgttctattctgtctctcctctcctcctgggacgcttgttacacttctgttcaatgttttgtttccattgtgtcccatatacttgttaggccttttttcttttgtagtttacattctttttctctctgaccttcaatgagatattttctgttaattcatctttagtttctaatgttttccttttttttatttttatttttattttgagacagggtctcactctgtttcccagctagagtgcagtggcactatcaccgctcactgcaacctcagcttcctgggctcaagaggtcctaccacttcagcctcctgagtagctgggattacaggcatatgtcaccatgcctggataatttttaagttttctgtagaggtgggatcttgccatgttatgttgaacttctgggctcaagtgatcctcccaccttggcccccacaaagtgctgggattacaagtgtgagctactgtgcctggtactaatctttccttttgatatgtcccatttgctgttaaaactatctactgagatttttaaaacaagcttttaattttagaatagctgtagatttatggaactgtttcaaagctagtatagagcattcttgtatactcttcagctatttcccctattttattatcttattttagtatggtacatttatttcaactaaggaatcaacattggtacaggtataccccagagatattgtgggtcagttccagaccactgagataaagccagtattgcaataaagtgagttgcatgaattttttggtttccccatgcttataaatgttatgtttacattatactatggtctatcaaatgtgcaataacgtgttaaatgtatgtatcttaattttataactgtgttgcaaaaaaatgctaacacatcatctgagactttaatgagtcataatcttcttgctggtgacaacatgacatcaaagatca

SEQ ID NO: 22000 - DNA, 1011 bp, Homo sapiens
actagccaagcttctgttagttgcttgtgggcctttttctggcctttctgcttttgtgccggagttcctgttcacactctttgggatggtgcccttgaaggcccttgagcctgctctgggatgctatttccctttttagcccatctccagctgttttctactttatggggattcttcacagcttctggccgcctgttatttttttagcatggctgtgtaatcactggctatttaaaaaaatatgatttatattatttctagggtttggtgagaaaaaacggggaaggaggcactgtactctttactcaattggctgtctcgattttttttgttaacattctgttcagtgtctctcctgatatgcttgtaggctttattcatactgttttagaaagatttcatagtgttcttggactgagcagttattttgatttattaattttatttttgatacaaagtcttgctctgttgcacagtgcagtggtgtagacgtggctcactgcagcgtcgaactcctgggctcaagcgatccttctgagtagctgggaccacaggcttgtgccaccacgcccagctagtttttaaattttttgtatagatggggtcttgcccaggctggcctcgtactcctgggctcaagcaatcctcctgctctgtctcccaaagtgctgggattacaggtgtacaggtgtttgatttaagacttaattttgtggtctatcctagcctctttgaaaataaagtttatttcctataaaccaatagaaaacagtcataggatatgagcaggtaatggtcttattcacggcaagagagatgcaaaataaaattgtattgaaaaactgctttttaaaaaaaatctaagttggcaaggatcagaaagtttgattaaacaatggtggctgtggagtagagaaataggcgttgctggtgagaatccaagttggtacaacctctgtagaaggcagccaggcagtatctatcaaaattacagatgcatataccctttga

SEQ ID NO: 22001 - DNA, 1064 bp, Homo sapiens
aaggatctttgggaaggccactcatagacaaaatgtatagcacactgagtttggtggcaatttagacatgtaaaggtgaaggcagacaactggttaaaaaaatgctatttgcagaataaaaggattgccttttaaaaatgatttcattgaggcaggactctggagcaagcctgggaattcatatttagcaatgatagtttgtggtgttttactaattaaggatgttcctggtttcattctccttcctttcttccccagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaaggtaaataagtagttgctcggttttgtttgtgatagtagaaagatttgtggttgctgtgatgactatcttaggacacctttggaataactatgaaagaaaactattctgagcaaccctttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgggtatctgtagtcccagctactcaggaggctgaggcaggagaatggcatgaacccgggaggaggaactaggagtgagccgagatcgcgccactgcactccagcctgggtgacagagcgagacgctgtctcaaaaaaaaaaaaactggtagttttatattcagtacctcaggcccgtatgattatctgctgatggccccacttagatgtacatagccacttcaaaatgggccctctccccaaatctaagaagcttgttttcagtaattgatcacatttagttcttttaagtcaagaacctgag

SEQ ID NO: 22002 - DNA, 1413 bp, Homo sapiens
ccggcccgccgtggggtgcgggccgcctggggtccgtgcggactccggaggtccggtgtctagtggtgagtggtggccgcaacgaggaaaaagttttgggggaaagaaaagtcgggtggaggcgtaacacgttactacaagagtgttgcgtacaggagggctcttaaagtgggtcatagcccgaaggtgttgagagagacggcactcactacctgcagccctgacagcaaaggggtttctgtagagcgggagggaggaggtgtagagggttacggttgagttgtgccctgcggatgcgtcgagtcattttacgcctggaagatccagcattggattgaaacaggctgtattttcttccaaagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatgtaagtggacaggaggtagatacccatttcctacttggggcttggcataagataccaaaaattaaccaaaacgttttattttctagcatgcaaatcaagaggttccaatcttcgtgttcactttaaggtatgcgattcatagttgtgatccaacagttcctcatgttccactcaaaaaaggtagctgcagtgatgactttcttaggacacctttggatttaccgtgaaaattaataaattctgagcagccaccttatatttaggcattgatgatcagggtgtaaggatgtagcgtttgtgaaattgagaagtagtaccagaaaaccatttgaaaacctagtgtgcagatcaagatggggcattttaattgtaattacatgatgatggaatttaaacgttttatagtgaataaatggagttttggagttttctctagcttcaacgaagtttacctggcttttagtcacaagtttttttaattgccttgcccccaaagaatagaaataactcgacattttgaaaagctgaaaattgaaaatttaacgtttactttaaaaattaaagctttgatctagttaaccaacactttattcttcatacttagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggtgagaattc

SEQ ID NO: 22003 - DNA, 1031 bp, Homo sapiens
taaggggctgtgagctgcggccggcgctggaggatcgcacagtacctgctcggaatgctcgctccgccactagctgcaaaactccaagcgagccagccagcttctccgaggcggttctctcgtccgcaatacgtgggtgataatgtatcggcggcttagggatgttgggaaaactaagagttcacgtagcaaagcacttagcgaggcgcggagctcgtggcaggcgctctcctacggtggggtggagggctacgggaacaccaggcgacctcctcaaagggaccagtgagccgagatttggagtctaagacgcgtggccagagcccagtgtctgccgatgagcactcactccttggcgagtgaaatcaagcatctcctttctctctgttctccatcatttcctcccggctctccttccctttattgatccgggtcctgcggcagaaagcagcgagcggagggagaacttggcccggagtctgcgtctggcgctggggagcggggactgagcccggaacaccgacggggcggctgcgccaacaaccactgcggacgcagggcgggtacgagaggctgagaggctgcgtcccgccatccagcctcgctccagccgggaggatccggctctttaagacgatacccttaaccctgcagtcgcccggaacaggtcctgcccctgcctggggagggaaaacccccacagcagtcccgcgccccttcctccctagcgtcgaggatccagctggagagacctgtgcgaggaaaccgagccggagccagcagatcctgttccgacctcgcctcattacttttgttactccagctgccagcagagcacgctttgtccctcccgtgtgctatcattcattaacaagactcaggcgggctttagttttttagtatagaactcaatggtctgtgtgcgatggtaaatatcacccccggatatgttgttcccactctgtctctctcttcatgaggaaactatacagacataggtctaatgttatctccattttacagatgggaaa

SEQ ID NO: 22004 - DNA, 1031 bp, Homo sapiens; identical to SEQ ID NO: 22003

SEQ ID NO: 22005 - DNA, 1031 bp, Homo sapiens; identical to SEQ ID NO: 22003

SEQ ID NO: 22006 - DNA, 1123 bp, Homo sapiens
ttatttgataatgtatctgtgtagttaaattcaaagagctgaaaagcaatatggtgatgttttccttctgcctttgtccccagtcaggcagttcctttttccgggagcaaccagtgtaacaggtttcttgtggatctttttagagatactctatatctatatatcttgtatctgtctcactcccatctttaaaaaacctttattttcattgccccatcttttcttatacataaggcagcatgctaaacacactgttctgcacttgtgtctttctcttaaagatatctcaaagattgctcccttttgtgtttaaataactccccccacctccctccttttttttgtggccatatggttctcaaactttgcatctagaatcacctggagagctgatgaagaatgcggagtcccaggctcctggaggtgggaggggcctgggcctttgtgttttgaccaagtgccccaggtgattctgttaaagatcagagtctgacagccactgctgtataagccccaccttgcaaagtgaggaataagctggagtgtaatataccaggacagtcatggggttgcagtggggggacagacagacagacggacggacggagggatggagggatttctgggctcatcacatgacttctcttggttcttgagtcaacttccttcactgggcagcttcagcagttgtgtctgcacctaccttttccttctgggtcatgtttctgacgtctgcaccatatgagctttcactctttctattgaaggttcttttaatactttggaatagcattaaggcccaaacattagcctcgtttaaggcagcaagcactctcatgaactcctctctgatcttgggatgtagtatcttctttgtggttattttgtttgtgcttatttttaccttttccaatttgaggagagcactagagaagacagagaacaaaaatagtgtttctgtatggcttgaatctctttttgcctgggatatgtagtctgtgttgaagtactttgaagggggccatggataaggaacttgagactcactcctcctcattgatatttttgcttttccaggaaggaaacagtcatattctggattaattctgccctcagcagcata

SEQ ID NO: 22007 - DNA, 1086 bp, Homo sapiens
gctggggcaggatacgggcaaccagccaggacagatggacctcccttccctccctctactgccctctctactccaaatccccagggccacacgactcttctgtgatgtgtataatcctcagagcaaaacatactgtaagcggctccaggtgctgtgccccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtggtaggtttctgtgcggttttggtgctgcatgtggtaggtttccatgtcggacgtggccggggcaggcggggctgcaggtgttcctgcttaggactcctgccgctcccttggcagtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaatt

SEQ ID NO: 22008 - DNA, 1049 bp, Homo sapiens
ccttgaataaaaccacacccagcacccacattccatacaatctgcagtatctgtttcttttaaatggagcaggactttacaatgattacaaaatcattctatattacttttttttttattccagccctttacagctgtctcacctattcataattcagtagcagctttttctttaagatactcatcttttttgcattcatgtttcactagtttatgcagtaatttagataatttagttactagcgtgagtacacctaccacaaacaacatgggaataaacaaaactgaatcatagcaggcctagaatttaactggtgggagcagaagtgagatgacctactagccatgagcacggtgtttttgtcatcaattgagttttacagaggaaagagtaatgttaagttaaagtggtaagataattaggtggaagtcagtttaataacttctgtcagataattgtgaaaatcgaggttcttggactagcaaaaagaccacagattttaagtcaaactaggtttacttctggctctgccacttcctagctatgtgaaaaactctaaaacttaacccataaccagatatttagcttaaaaggtgcattctgtgatttgtctttatatatatcattgaagtagatgttgattcttatgaaatgttttctttctaacaggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctga

SEQ ID NO: 22009 - DNA, 1017 bp, Homo sapiens
ctgtaataaaagttggtgaacgtggtcttactcactctcaaatatctttttattctgtactgtacccacctgcatttggactatggttgactgaaaggagctgaaatgatagaaagtgaaactgcagataagggaggggggctactgtaatttaaaataatatcagtagcactaaccaaacgtctaatcaatatgctaagactagtaaagtgtatcatttctgtatatttaatttgtttttcttttctaacttaatcatatttatttgaaaaagtaatgtgtatgtatgactcaaaatttattaaaaaaaataaataagaatatacagtgaaaactgcctccctccttccctgtccccctaggtcaaccacttttatgagtgtatagcattccattatatagctgtaccagcctcatgctaattcaaacaataattataaaatacagaagttattttgcacttgtgcacatatttctacaggatcaattgtacaagaagattgtagaagcgtaagaatatatgggcttataactgtgatagctcttagagggcagtttatactctcacagctaaatatgagagttcttttccccactctttactagcattgttgtaaggtttttgttatttgacaatcttataggtagaaaataataggtcagttcccttgaaaatgggaatttccatcttcagagccatttgtatatttactttgatgttagctgtttctttcacccttttattgggtttttgttgttttgatttgtaggggagagatgtgtgtgtgcatgcgtgtatgtgtgtgtttgtgtgtgtgtaagaaagtgagaaattagccatttctaataatgttataaatattttaggtttttttactttgtttttggtgacttgtgccatgtagcaacttaaaaaatacaggctaatatatcataatacggcttctgaattttatttcactctgagattataaattctattatttttaaaaatatcttcgagttttcaaataaaaa

SEQ ID NO: 22010 - DNA, 1008 bp, Homo sapiens
tttgtcatacatagcttatgttattttgagatacattccatcaatacctagtttattgacagtttttagcatgaaaggctgctgaatttagtcgaaggctttttctgtatctattgagataatcatgtgttttttgtcactggttctgtttatgtgatgggttacgtttattgatttgcatatgttgaagcgaccttgtatcccagagatgaagatgactttatcatagtggataagatttttgatgtgctgctggattcggtttgccagtattttattgaagatttttgcattgatattcatcagggatattggcctaaaattctctttttttgttgtgtctctactaggctttggtatcaggataatgctggcctcataaaatgagttagggaggattccctctttttctattgattgaaatattttcagaaacagtggttccagctcttctttgtaactctggtagaattcggctgtgaatccatctggttctggactttttttggttggtaggctgttatcgcctcaatttcagaacctgttattggtctattcagagattcaacttcttgctggcttagtcttggggggtgtatgtgtcctggaatttatccattacttctagattttctagtttattggcataaaggtgtttatagtattctctgatggtagtttgtatttctgtgggatcggtggtgatatcccctttgtcattttttattgcatgtatttgattcttctctcttttcttctttattagtctttctagcggtctatgtattttgttgatcttttcaaaaaaccaactcctggattcattgattttttgaatggtttttttgtgtctctatttccttcagttctgctctgatcttagtatttcttgccctctgctagcttttgaatttgttcgcgcttgcttctctagttcttttaattgtgatattagggtgttgattttagatctttcctgctttctcttgtgggcttttagtgttataa

SEQ ID NO: 22011 - DNA, 1091 bp, Homo sapiens
ttgcaccctcgtttttcttatgtaaatgatgtcagcatgagtacagaccaagtttgtttaatctttctgattataacaatcagtgctttaggtcctttcatcatcttaattgcattgtgggagcaagtagcctgactctgaacaagcagcttcatcaagtacctccttaatgaagcattttctggtcattctggcctcagtaatttcctttgctgttccagaacaactagcttctatagtctatgccagtggttaccaaactgtagtgcacatcagattcacctgaaggatttattaaaacagtgatgtttggttccaccctagagtttcggattcaatttggtccgaggtagagggaggggtttcatcaggcgatgctgatgctgttggtctgattaccctgtgataattgccagtgtctaccaaatagtttagcatgaaatttggtataatcttgaattatttgtcacatgcaaatcagtatattttgagtacctactacgtgtaaggcctgtgctacctgacattagagatcattagctgtattttaaggacatactgcttattttttatatcctttatcatgttagtagataattggttcatacttattaattggtgttaatcaatacaactgacttctgttttgtctttccttaaaacaatgaaggattgttagaattaacatagatcatatgcaaacatgaggatttaggtggattgtgaaaatctgtgatggagtcttttgacctctctgattgtcttgtgggaatagacaatcttattctgaagcgatttaataaacatggcatgtgaattgttcaatttcatgtccttggatatcctctgtcaaagatattgcaaaagcattagaggtgattagacttggctcttaattaaaagactttttgactttccatatatattaatggaaatgaactaaaaatcctctagactacatttaaataactagataaagaggctctgagattttaatttgctctgatgctttttggccaaaggtgaattctatgcaagagtattgatcatatattattttattgttcagtatgtttgctatgtactatttt

SEQ ID NO: 22012 - DNA, 1091 bp, Homo sapiens
gataaatcactggattacttaagtttgttcttttttttttttttttaacaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattctttctgttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctagacagagttgcttaatgaaagggtttgtaatactttacaaaccattacctgtacctggcctggcctccaaaatattaacattctttttctgttgaaactcgcgagtgtaactttcat

SEQ ID NO: 22013 - DNA, 1048 bp, Homo sapiens
cagtgttcatataaataagaggggcagagcctgggttagaaggaaaagaatgaatagaatgtgaggaaataagacacaagttctctctactagtgggaggggaagataaagatggcttgagggggaagcagtgtgaataaggacatgttttaagttgtcagtgttcaagtgcatctgtcacttaaaagaagaagtcccaggggaggaggggaaaaatggaaaatgtgagaagagaagttgggcaaattgatggggcaagatgaggaggaggtagaagatgtgatcaggagcacaggtggtgggataaccttaggagggcagcaggattcttatttctctaaaataggaggagatctgaggtggaaaggacgatgttcatagaggctctagaccttcaggcttcacgcctggcttttctagtcagtctgaagttgctctgtaggcttcttggcttgggggttaatattcagctatggtgtctaaaataaacaataaaaaacaggagtttggatatgtaggaattttagatgaacttcccttagtttcattattgaagttcagcatgttcctctggtcagttcactttgttctaatagagattataatttcaaaagggaagatgctttttaagacaatacatgagagctaaaataagttttaggtttttgtgtggctcagtttggtgaattttctccagttttcatgtaagaataagccagacctactgatagctacctgctaatttatggaaattaacatgttccaaataaacctgtctgttctattttgctgctgtacctacatttgaacacttaaagtcattctaaatggagccgtgcctttctcagtagtcagtgacagattcacacatgtgtgggaaccccgatcctgtggtaaataagagagccccttctaaaatctaaaatctctctgtacagacactttctagtttataggttgtgatataaaatttcatgtttcatttatttggaactctacatcttccaatagaaatgatattataaatggctctagtgtcccagaccga

SEQ ID NO: 22014 - DNA, 1053 bp, Homo sapiens
cttacgtcatttcaacccagatcttttgagggtttaatcttccttttagcttgcatagacaggaagtgtttaaaattatttagcaggccacttctccaaaagctttggctgttttttactttatccttatggtacctgacaatttttgctggatgcttttgattgtgctaagatattagttgtctttcctctttctttatcatcaatgtaagaattgaggtaatatttgaccactgtctcaccaataggactgtgcattgggcagaatattggaaaatagtaaaaagacaattttcatgttaatgttttaaaaatcatgatctgttatcccaagtattccagtttagattcagtttgttagtaaaggaaagatgttggttttaattctattttgatatacatatggtagatgactgctaatcagctatttgtaattgaggagatagttggcaaaatatacataggcagaaatgattcttccaattttgctatccattcttagattcattgaattcagttgataatataaattgccaaatattccaattggagaagttatttttattagagagtaaatgaattagacaatgaggtttctatttttgaggttcccatagatataaatgtttttattctttgtatcacattcttttaataagatgttcaagatagtgatattgtaattccttttaaagtgttgaattttgaggcctataactaggattaggcttctgaatattaactaggctttactgtgagaagatctgaaatgtttaatttagatgagaagcaatcattaaaaataataattctgtcttttataaccaacatcctatgcccaggtcatttatatggcagcctaatttgaattctataaaatatataaattacgaatttttaatgtattgactccttgaaaatgccttagctttaaaagtgcaaattagggtatgaaaagaaaagcattaaacagaattcagtagtgatttctacttataattaaaattttaaggtagtgatggaatttgtaaaacctagttataatagggtagt

SEQ ID NO: 22015 - DNA, 1023 bp, Homo sapiens
attttcccttagcattgttgtaaggagtaaatgggaatttatatagaacatctagcaaagtaaatttgacctatgttaattcctttgctttccacactgctcgttccctaagccacccccttcctgagcaccaagccaccttggtgaacagtgttgcctggtggcctgcattggaaactttctgacccgagctctcttgcctcttgtcatgttacattttctgaggggcatggggtctctgcttcatacctggcttcactcaatttgtgcagtttacagtaatataattcctgataattgatacagaggtcaaaatgcattgtttcttcatatcatacctcgcattggttttcatagggacattggcaggtcctttgtttagagaggcagaatgaaagagaaggctaaattgcctctgtattgcttaactatggggtggatttgagttggtcattatgaagatgttaagaaaggtaagaatagcagtagagggagcccaagttagcaaaagttaggaccttgtgtgtgtgtaaatcactgtgatttcagcttcaggaaacctttattctggggttactttgcttcttaaatgcacagaggaaaattcaggtgtatttttctaaaattgccatcttaaaacacagtgctgggtacctataaaaggggcttcagtatttatgaaatgaagagtacttttagattactgtactgttaccagaaccacagtttagttatgttaagtgtaatgtgcagatttattttctgacacttatgtttcatcaaaaaccaaacactaattcatctcttcagtttgtgtgcacttttctgctctagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaac

SEQ ID NO: 22016 - DNA, 1051 bp, Homo sapiens
cttgatattttttttttaaagctttcctattttggggggaaatcttcagctagcatacttaatgtttaaacaaaatagagaaattttcattcatacatacaaaagtagtgggaactacccagcttaaacaatttgtcaacacatagtcaatcttatttcatccccatcccaatttactactcctgacccaaccttcattatttgaaggaaatctgacgtcaagtaagttcattcataaataagtattcaatatgctatttgagaagatgtaacttgtgaaaatttctaccagtgcagaactcagtgtttcaaagctagaatgaggccaacaggcagttcatgattatttgcctaacataggcaataattactatatgggttcagaggaaagaaaattcctattactgggttctgtgaaggctttgtggaagaggtagtatataaggtggattggtatttctgggctcttggagactaggggtagcatcatgcattatggaccaagtagaagacatggtgcttgcaaagaactgtagaagccatttagactattcagaatagagtgattaaaccaatatggctggagcaaaggtcactaggtaagagtggaaagtagggttgaaaggttaagaggaggccataggaccaacatagtgaaaccccgtctctactaaaaatagaaaaaaattagctgggtttggtggcaggcgcctgtaatcccagctacttgggaggctgaggcaggagaatcgcttgaaggcaggagacggaggttgcagtgagctgagattgtgccattgcactccagcctgggctacagtgcgagactctgtctcaaaaaaaaaaaaggaggccataggaaaaaggatctaaaatgcaagcctaagatgtttggcttttttgcttatggggtaaaagtccactgaaagctgttaagccagagctgttgtcaaagtggtgttttaggaagggctatgtggatagtgtagaatgcaaagagacgagcaaagttagcttatcatagtgatttagacctgaggtgatgcagact

SEQ ID NO: 22017 - DNA, 1049 bp, Homo sapiens
gttttctttccaggactctattggaccaattaaaataaagcttctgattttttgttttaatttcaacttttattttacctgtgggagtacatgtgcaggtttgttacgtgggtatattgcctgatgctgaggtttgggctactattgaatctgtcacctaggtagccagcatagcactcaggtagttttttaaccctttcccctccattctttccccctctaatagtccgcagcgtctattgtttccttctttacgtttgtgtttgcccagtgtttagctcccacttataagtggaattgtgcagtatttgattttatttttatgccttaattcacttaggatgatgaccttcagttgcatccacgttgctgcaaaaggcacaatttcattcctttttatggctgcatagtattccatggtgtatatataacacattttctgtattgaatccactgttgataggcacctaggttgtttctatgtctttgctgtcgtgaatactgctgtgatggacataagagtacacatgtctttttggtagaatgatcggttttcctttgggtatatacccagtaatgggattgttgggttgaatggtagttctatttttacccttttaagaaatgtccaaactgctttccaaagtggctgaactaatttacattcccaccaacagtgtataagcattcccttttctctgcatccttgccaacatctgttatttttttactttttaataatagccattatgactgctgcgagatggtatctcatagtggtttagatgtgcatttctctgaaacaatgttttagtccattatatgaaacaaaatgaaaactaataactctttttttctaattagaacatgctatatagtattttatgaatttctgctatctttgtgatacacatagaggctgaggtgggtggatcagctgaggtcaggagctcaagaccagcctcgccaacatggtgaaactccatctctactaaaaatacaaaaattagccaggtgtggtggtgcatgcttgtaatcccagctgcaag

SEQ ID NO: 22018 - DNA, 1051 bp, Homo sapiens
ggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaa

SEQ ID NO: 22019 - DNA, 1028 bp, Homo sapiens
cccatttttgtacccttaaaagtaccttgattccatggtgatagtttttcttccacaggaacccttcttaccaaaattcagaatcaattaaatgttctcttttaggagacagccagcctgggggaattgtgagtctatgtaaagtctacatattttacatttaaaatgttttccttgtcccaaaattcttatatgggaagtttacatgtatttacgttgttgtttaaatgaaaatcatcattgccattgccatttccaaaaggactgtttaaaatattggcaagcgtctttttacatgtgtctagatctgattgtaattcccactttaatatcagcaggcacagctgtttggtctagaaatggaggacaggcctcatcgtctcctaattatgaaggacccttacactctttggtatgtctcatttgctaatctctgtcccacccattttcaggtcatgttctttcttgttcagtctcctttactctccaagattttgattttccctgttagtaactttaagtcagcattaagcacacaggtttgcgggagccagagtcattagcctatgcttgctcctatttggagatgggaacccagatactactgtaatggcagccccagggctctaaatatctagtagcagataaaatcctggaagggcaatggccttctccccatctctaggaaagatccctgtcaatgattaaatcactttcctgctatcagagtgctggaactccagccaggtcctatacctggaacatttgattccctctacctctgctttactttccagaataacaggtttacaggagctttccttctcgtagaaacccagtggtatccttcgtggtagagaaatgcctactcttccaggagtgaattgctgaaaatttccatggatgtagttaattattataaatactcacatgatgattcagtgtctgacacttcagtctttctctcctcatgatggtgggggccagaaatatgcaggaaacaatgctggttgtgcagcatttaggct

SEQ ID NO: 22020 - DNA, 1044 bp, Homo sapiens
ctactcttagatatttgagcttgattataattcatagtcaaagtagcctccttgtaaataaccaaaattaaccaaagatttttccttatcttccaaaagcaatgccaagtaattctatccaaattggaaaaaaaaaaagaaaaaggataaaccttattaggtgtcatcaaatggtgttgacataatgatatatatgtttaaggataatgtaatagaatatgtaattaaaattaaagtatatatgaaaagaattgattttaattgttttaaaacataagatgatttaataatatgggtcggagattctttttagttttataataaatatattgatttctgaaatttgggtatattccatagtacacttagcttatgttaatactgaggccagattgctgtcaggctaatagcgtgtagatatattatagtcacactacaatcattccgtcagttttcagtttccctttttcctgtgatgtttctttcatcttgttagattattctcaagaccttctctaaataccttcagtagtaattcacaaactctttgttagttaatagttctcaagaaaattctgagatgtggttgacagaacttagatcattggtttgtttttggattcctagccaaagttttattctttgtttcttaaaaatactcaaaaaagttttttttccttattgtaagccctctggaaatagaagcaaatcactgtttatacatttaaaatgtgatgaaaattacaaaataaagtccagtgaaatatagggcttgtatccattagtgccttaagaaaaatccctgttttctgaagtgcgagtgggcttttctggtttgtttttgttttgttaaagctccaggacctcccaattttcaagggcactttggggcatgtgtagcatttatttgatgtatggatgtagatgcatattttcccacatctgtctctgtggacctatcctttgtgaaatcctaaaccttgtattaatgcttagtttatgattcatggtgttctgagagcaattatataatttttctggggt

SEQ ID NO: 22021 - DNA, 1049 bp, Homo sapiens
gcacacatatgtacccttaaatcatcattcagtgtgatagcttaagacaacatttctgtttgctgctcatgccactattagctacgtttgaagagtgatatactgagaagtttaatttgctggggtttttttctaaaaacattgctttcctgaaatatatagtattgggggctcatagcaaaaaaaccgtagtatatgggttgtgagcctgtcttcgaacatggtgggtcacttaacagcagctgtgctggagagatatttgatttgagaagactgttttgaatcttctcagccctaacaccattctggttttgaaatgggaaaatggaaaagagttttagggaatagagatatctcagccttgaaaggaagcataggtagaaatctttcagttctcactcagatgaaccagcattcctaatctggctaccctcacagaggacaaagagtctgctgggaaatgtgggtttatatttgtagagacacacttcagaggcatgagatagtgttagataccgactggatgcttcgtgcccaacatcaatttggtttgcagattgaaatttaggaaagcttgcagaggagccaatcttttttatatacagcacctttaaaaaaaagactgtccactactattaaaatctgattcagtcttctaaaatattactacattcaagacaacttttaaaatgatcaaatttagatagacatcaatgatgttaaaagataaaagccctcctacatgtaatatatagtgtcttaaaccttattttttaaaaaagggataccacttttgccaaaagtttcaatgtagggatactcaaactgtccttggaagtcctaaaaattgctagttttttttttgtttgcttctttttttgttgtttttgttttttgtttgtagttattcacaaatggagaaatatttataaaattatattataatttgtaatgcacgcaaacaaccatcagaccacacttgaatcagagagttacagttataaattgaggaaagaggatgccagcacaatgcctaatggagtgaaaaa

SEQ ID NO: 22022 - DNA, 1050 bp, Homo sapiens
aattttataatttaatcatccatttactcattacctaaaaaaatcccagctctattttcatagcaatttaacttagtttatgtaagctttgttgtaaatatcaattgcttattacttacaacaagatccacatggcttaccaccacacaaaatatttattttaacttgattccaaaaaaggtctgcagtagacatggtcacacttttctagtagcagatctgtatttctatatttttagacctctgccatgctttttttaaagctcaaataaaattatgactatttgataagagatacttcttaaattgtttcagtatgtatgagtatttgtataacagatactaaaagattggagataataaaaggtttcctttggagtgattatgactacataagacacttatatgttttctttgatacatatttaccatgacaaatagtaataaatctgtcacaatctgttgtggcaactcactttaccccccattttgaagtgggccctctctttcccttataataaaaggaagaaaacttaaacggtgacactgcatcatcaggtattatttgtgacacgcctgtggtacagagactggacttctgccgccattaggctgggtcttcctcccaggcaatcaggagagagaggggattgcctagccctgttttgaaaacactgcagcatctgtgggagagagaaaacgtaggcctggccagacatcatgccatggatctggcaggatccacgaatgtgtgtttgtactgtgtgctgcacctagagacctcacgtcactgtggaagtatgacacgatggtgggataacagaagacccaccaggcagggtctacaggacaagcacagcgtgtcggggggaagcctgtccctctagtgcacatagaccagtacttgctaaggtgattttttttttaaaggaaagcctgtgtgaaagacagctatctaattgcccacgagagctctgcttattactgcagtacatttttatcttctcggttcgtattttagtatgttgctctttttagtcacgtcccaat

SEQ ID NO: 22023 - DNA, 1046 bp, Homo sapiens
cctcttttttctgttctagtgtaaaaatggtgcctgtgtgtatccgagtctttaagaggaaatggacacattggcaaaccagtgcctcctttggctctgtgatgtggctgctgttactactcaactggagcaccccttatattccagtctccccagaaatgctcaggaacagtggagactcaatgacagagggttgagccctcctggtttttcaactggtgaaagagaaattcagatggttaaggagatagcagagtagccagcactccgggagctgctcttatctctgctatgaggctgtgcatggggaagagtagggctgcttggaatgacctccttacttttcatatattgaaacatatttctttttccttgatatgctcctgtattgtttgaattttattttattttattttttgtggtaagcattgttttcttaattaacaatgaaaggttgtagtcaataaactagtacttgatgagatttgagaaaaactacaaaactgtagattgcaagttggcatttgaccaagaaattatgattgtgctccttggatttttatgcttaggaaagagtgcacaagagggaaaaagctttcggtcagaagatacccattctagtactagctggaatggtggtaaagaatacgaaatggtctgaatgtccatggctgtgtgatattggcgtattttgctgtccatgggtctaagtggatggtattatagctttgaaagagtcatggcaaaggagggaacaggtgtgtcccaaaccctaatgaactcagcagattggcctggcattctggcaatgtagtcattcagcggagccgtggggactccctgggtggggacccagcatgcttctggaggtacctgggaggcgctgggagtagggcctgctgtactggtttgactaatgtggtgtaggtgttgatgttggagagttggtggccagtctcaggctctgttctggcactactccagcttgttggtcatgaatgcagattgagattgaatggctccttacatttcccttgaagaaaggc

SEQ ID NO: 22024 - DNA, 1031 bp, Homo sapiens
agtctgtctgtgtatgtgcagaacacagaccctcctttctccgtttgtggggaatacttccctcgggtgaaactgaagttaatttttttttttttccaaacacaaggtgagaagtggaaaggggcagagggtggaagagaggtggatggattggcatgtgatggctgaatttctgggccttgggaggttcgttttgaggcattaatgtccaggaaaattcttttgtatatagcactatgactgcatatgcttttcttaaaaagccttcgtaatgtagccgtggagtgtggagattccttcattcttaatttgtgcttcatggttgtgagtcttgcaagagtctactatctctgtgcttagcgtggtcgcagcaatctccataaacagtgtgattacttagggataaataaaagtgaaattttggaaatttgctgacagagggaaaatagggactgaagatgaaaaatgtacagagtatgaatttctgctttctgtgaaatttgagaatagaacagaccatagtgtgtcttccagtgaatcagtttctcttgtgccgtattgttatttgaatccctgtctacaacatcagctatgcaaaccaaagagaaaggcaaaatctcagtatcttgggcttcaagtctaaatagcagatcacagctgaaatgattccccactgtgtgacaaggtgagtgactcgtggaggggaggcttttgttttcttctgtttactacatgattgagatacggaataggaaaccttcagatggtgtgccctaaggagctccaaaagctgctttatcgtattataacagtgtatcctatggacttaaaggggtgagcagtgctatatggaaacatgcttcttccagtctcaatagccttttgtttggtgtagagacagagtggtggtaagcaacaggtagcaaagcgctgtcctggaggaatacattattattgtgagacgtgtgttgtttcagaaatatatcaagttaaaaatagatatatattttagatttctcctaaggatttaa

SEQ ID NO: 22025 - DNA, 1035 bp, Homo sapiens
taagacactttcattaatttcatatcaaattcatgagtgttttgagctctgggatttgagagtcttcagtgtcgggcctctagtttatttatacttttttttttttcccccagagtttaaacaccagcagcatagcatagtgctaagagcacagtctgggcaaacaaactgccagggtttgaatcctggctctgtcacttgtacctgtgtggctgtgggcaattttctagatctcagtttcctcatctgcaaaatggtgtttctattacctgccttatggggttgtgcagattgaatgaatcattttatgtagagctttgagcagtggttaatacatgataaggacacagctattcttatttggacagggaaggaaaaggcaggcatggaaacgatgaaggactgtaaataataacctcatgtatgtgttcagaactactaaaaagttcagttgttgtttaatgaactagtcctttctacatatatatagattcacagggtaatcagagatggatgggactggggatggggacagaaatttattctgagtcaaacatgtttatgatgagttccctagtctgatgccagggaacaaaaggctcattcttcagttcccagaatgaggattaacagtgaaacagccttgcttggtgttgtcctgcagcatcagataatttttcatcaaggcgtttcacgggatgatatattctcccatatagatgaatctatttcagcggtgggtgaaacacctaccatttatatataatttttaaagtggcattttacaaatgaaaggctacacaaccaaacatgaccctgttattatcctactggtcaaccacaagagggatcatctctgttagagcttatctctagaaatcattttattgataagttgctcgtctgtctctagctctttctaggtggtttagaactgtcatgtgtatccaggggcagtaatctaccaaaggtgatccttcttagaagtatccctatgagtggaatggatttatgagatcatttttttcccttcat

SEQ ID NO: 22026 - DNA, 1075 bp, Homo sapiens
agtctaagattccatgtatacattcatattttaacattgactgaaaatggagcttgtggtccactaaaatcattaagtgtttttaacattaattgctttacatccagggcttccacatctttgtgtagaatgggacttaatacgtatcctcgtctgatttcttcatgttggttttggtctgcaaatgtgcaataattctgtcctttcactctgttgatataggaagtgagatggtgtgatgcttaggaatgcaaactcttggatttatatcctggctctgcccaccctttactacctgggtgacatctaagttgctttctctgagtcacagtttcctcatctctgtgttgaagatattataaaatccatctgttgggattgttgggtgaagtaaatgaggtaatgcatgtataatgcatagaggaatccccagaacatcatcaacactcagtaatttttccctgttactattgtagggcatataaggagttaatggcgctatttttgtgattgtggatcctttctctcagtattctttctggaatactttcagtatctctttctggagagaaagtttaaggcaagtggttcatctgtgacgaatggaagaaggaaatgtggttcttgattttgagttgtgtgatgaacccaaatttaccaggcaatagataggatatgatgattactaaatttgccattgactgatagttaactggctaccttgttgggtctcttgagaaaagaactaaaacaagaacaacaacaacaaaagcttaaaattacctgaaaatatgtctctttacctacacctaattttaaggcagaaaattccaaagtgagccagctactcaatacaggtgctgaaggttatgtgaaaattcgggttaacactaatgatagattgagaggtaactgtttgctttacaaaccgcttgccaaggaatgcccatattagactatgaaaattagactcatggcaaattttcaggaacatgattcttgtgataaacaagctatctggagggtgatgtgtgagctcacaggggagttttaagaacaggtttccattgttgga

SEQ ID NO: 22027 - DNA, 1032 bp, Homo sapiens
gaataatttttttaagagaattgactcttatgctgcattaaaaacttcccatcgctataatttctcacacacccgatgccttcttgattggcttgcgtatctgaaggctagattcggggaacaaagattctcattgattttgcccaagctgctgtttatttaaaatgaaaccacttttcagatgagccatatttggtgttatgttacagctttacaaagaaaagatagatcattttcaagaaattaacgacaattaatttacaaatgataataaaaacaaagtaagatctattggtgtaggggacagtttgaactcatagcatatatgctgtgttctaaaccgcactttgtgtccagacccagagcccatgttgtgacctttgtggatattttccttctaccaaaagaaggtagtagactttagcataagtgtttgacaacactccagtctccactttcagaatgtttaactggtttttgttaaaactacaaagtatttgtttctgtctcaaaggcttaattctgctgtgatgtcgcatcagggtaaaagctatagcatcagaaataaatcagccactttattggagcagattctctattgtcaaatcaatcaagcctgtgactgaattaggcgtctgctacagaaataagtgacactaattttataggaaagagttattaactgcagatgacctgatttttttttttcctttttttggtgaactgttcatttagtaaggttttattttattgcaaagaaagaaaaaagtactggactactctttccttttgagagtggattatcattaattatgtattttgttctttatggcagtatacaattttagggaaatgataacaggcattgctagtatatttgtttataacctctatggtaatgaaacccattattacaactctgaacttcttgatttcacatgaatggttttgcattttacagatttttaaacataatacttctatttggcactgaaattccaaaacttagttcatttgtgtctctatttcaca

SEQ ID NO: 22028 - DNA, 1925 bp, Homo sapiens
tctcagtttgtgtgagggctcagccaagggttcttcctggactaggaaattagtaggagccacagatgtacgcagtctgtgagtctccataatggtgtagaggatatttaatagtgtctgttgttgcaggaagaaggttttgaggcagtgtagacttcattgtgtttcagaatgattatctttcctggaagaacttgacatcctatctctgaacgcattctgaatgtgttgaaatttttattaagaaatcaatatatttccacaagagcaggaatctgtagacttagagcaatgcaaaataccatttcaggcatttttctaatttcataaaactctagggtcctgggtgattggcatgttgtaggctcagagtatagaaaggacaactacacagctctacgtcaaatcaatctaggtaactttcatacttgtttatttcaaatcaagctgaaagttacatggtatttagtctgtgttcttagcttgggactctgatcagcatacataacttctgacaacatgtcatttgtgtattacacatagaagtacactgagatataaagagaatactctaatggtaaactaagccactgaataaatctaatgcttactgaattcttactctgatagtgttatacagggtcacggagaaggtaggattgtttaacctaaacgttttgggtgtttctaagatccaggagagtatttaaaaatcactgacctgtttagcagaacaaggagtcataaaaatgtaaggctcagattttcttagatattggagggtattattaaattaggcactcatgataaatactggtgactatggtagatatttactacggatcaagtactttcctaagtgtttaacaaatgttagttaattcatttactttaacaataactccttaatcttgcaaatactatcatccccttatcttctgttagaatactgactttggggtatgtcttgggttttcacttctgttctccttgactcaagaggccattacattttcaaggctgacagatgtccccagggcaaaaaatgtgttttcttcttccctgggttccagccttcactttgattttggctccctgattccttgttatcttgtctgctcagtattttaaaatttttcaaaaaactgttatccatcatttttagttttctgtgggagagttgtccaaatatactagcctgccctatttccaagaatggaaatcaaacttgcttatttcgtagttcacaaaaatgagtacggagaggccagtgacttgctcagaccagagaactggtcactgcagagtccctgctgaaatccagctctttatcccaactcccagtgctgtgttttctaaagtttgtctagtctgtctgatagttttgatcttgctgaccacaagagcaaagtggagctttgagtaatcggattacaagtgtaatgaatgtggatgggaaatcgcagaaggtaagaattatgtctgaacatctttcccctaaatagagtgtttggtcatagttctgcccaaactgttgtgttttggcactgatctgtcaaatactttatttattatttttttttttgagacagtctcgctctgtcacccaggctggagtacagtggctcgatcttggctcgcggcaacctccacctcctgggttcaagcagttctcctgcctcagcctcctgagtagctgggattacaggcgtccaccaccaggcccagctaatttttgtatgttcagtagagatggggtctcaccattttggccaggctggcttcaaactcctgacctcagctgatctgcccgcctcggcatctcaaagtgctgggattacaggcatgagccattgcacccgaccaatgtgtcagacactgtagaggggactcatgcagaatgaatcaaataagatgaaaatttg

SEQ ID NO: 22029 - DNA, 1028 bp, Homo sapiens
gctgagctataactgccatccaagtaagtgacgcagaatgcctaacccaatttgtatcttgctatcacctgatcacagaaagctgtttcactgtagaggtaacagttgttttctcctctgtcctgaggccaatgattatataatatgtatcaaatcactagggtgcatatcaaagtgagcataaagaggcaaatatttccctttacaatgaccatataagagattatttctgtcaggggataaggcatacatgaagtctgactgtttcactgcatttttactatagaaatcactgagcttgagacttgtacattaactccatctggtcatgtgactggcaagtgaagtgtttcaatgtgttaagaggactgatctgcatatttcttgctgaatcttaatctgtacttgcatatttgtgaaacgaatgagtatttaaattatggagaaaagatgtattgtgccaaactaacctttatagcatacctgtggttgtagtttctctagctaacagtggacaagatgaaaactcattatacattttcatcatgttaggtattcttctcaaagtcacaggagcactgcagaatggttcgtaactttatgaattcagctggcattttggatatatggacggcccctttgaggggctaaagacacagccatccatttcaccaagagtcgccgagggtgccttattgcccctaccccgtgctgggtactgagggtgggatagaaggcaaaccagacacatcccttgtgtttatgcagctttttcttcagtgggcaagacattacttgagaatcctaaaaatataaaattacgtctatgacaagtccaatgaaggagaaggacaagacacttgattgaggaggacatttattgctagtcaggggggacaaggaaagctgacccaaggaaatgatgattcagctgagttgatagaggagtgaaatagtcatagtaggaaagtggagtggtgggagttgggaggaaagtactgtatttgaagaaccacgtgttcaagttc

SEQ ID NO: 22030 - DNA, 1025 bp, Homo sapiens
tgagctgctttgttatgtagttaccaaggatgatgtaagcttctcatccaagttttcctttactatgctgcattgtcctttaaatgtcatgagaatacaaatattttcaaggtagcagtgaggaacaatctagatgagatgaccaaaaggacctctcatatgaaactgcagtgagcaaaggtttattggtctttggatctctaaatagagtgactttagatatctaaatttagtgaaaaccagaattcagtgactttagatttcagaccataaggggttgtaacacctactccttttctctgtaatgaagaaaaatgaccacaacaatgtggtggatatcagaaatagaaacttttcatcgtcatgcattcctggaaattccaggttagaaaggcataaaagagagagaaaacctgtcatagttagtatatctaccttggttagtgtttttcacttaggggattgcaaattcatatgagaattgctgagagaaacaattaatttagaacaaatattctccttccattgttacagcctgtaaaatgttacttctgagttgctacttatctatcaccatttctctttctccacttcattgttagtgtttgtatgattagggtgggcgggggtcttctggatggggttgctcacactccacaaagccttttccctcttctgttgaaagaagacacagctgaaatcagtctctttgccttttcatgatatggggatgcggtggaatcaaagcaggcaggatgaaagcccaaaagcttcctgtttccagctgttttcttcagcgaaggttttttttttttctcccaaagatgatgcttcctttcaaggggtttttaatctgctaactgtttcctcagtttatttcactacagtaaaatgtgttccctttaggtcatatctgtctcttttaaaacccaacctgtccttttcagccgtgttagttgctactcaaaagaacaaacgtgatttataaaagtccttttaatgaggtacaaagaccaataaacctt

SEQ ID NO: 22031 - DNA, 1048 bp, Homo sapiens
gcttttacatctcttcacaaatcttttgtgttgacacctattttatagaaatattctattttatataactgtcaaatgtgatgttttctagactccacttgtattttttatagggtgaaaatgtttttcaaagtataatttccctctgaattatgagtacatatttccctatattttattgtgcagatttttttctcactacacagtttttaacatgttaaactttaggacgctgcaaatctgcctttcttaatatattctgtgatgttgaggctaactacatatattttgtaaagaggtatgctggtctccatgtcagcctctaccaataggaggcgctggagggagagtagaaggctagaggaggaagaacttggcctttcctgttcttgttatcatcactctggtaacatcagtcttttccagtttttagttttgtctacattcctaaaattaacctccttggagataacagccccagtctgctggtgtctcttcctcatcacgtctctctgagcttacaggctctggaaacccaaccgcttccctgtttccccagccgtggggatggtagctgtttccatccgactgttcatgggtgcttcttctcaagtctaaagccagaggactgtaaatgtatgttgtttaagccacacatccaaccatactggttcaggaaggcagcggtcttccagtagttagttagctttctaaaaactccctttaaaaatgagactttagaaagaggatgacaaatcctgaggactcgtgtcttaagcaaattttctgtctagatatttattataaacctaattgcatctgataagtgctgtgtatgtcatactctatcaaaggtaaaagggttattaaagtaacctgcactttttagagcaatggtggatggccttgcagaaggcacatggcctttatcagtcaactcactgtggggaagctggagaaataaagttcaggtgagagtaagccgacagttctggtgtgattttcttgggaggataacgtataatgtaggtagcaaacacatgggaga

SEQ ID NO: 22032 - DNA, 1033 bp, Homo sapiens
tagtgacacctttgctttttctgttgttccaaagtacgcaaactgttttatgcacaaaattatcaaaaatattttgtaaaattacctttagcccatgtgtgtaaggtatacatgaagctgcatatgaaacataaaatacatttcatgttgaaacttggttctcaccccaaagttgcctcatgtatatgcaaatattcaaaaatcccaaaaaattagacatccaaaacacttctgatcctaagcctttgagataagggatacttaacctgtactgggtcctcagtgcctggcacagggtggatgctcagtaagtattttcttaaaagaaagaacaagggaaaggtagatgagacgataagaggtggaggtacagggaagaagaacacagaaacatggtgatgaaaagaacagtctgataccttatttgggccccagaaaatgattggtactgaagggattttattagtggtcatttaagaaacttgtgttgtactgtttttgtgtattggaaggaggctagacattgttacatggaaattcacagttacattttcactaaatgtttcattgtgaaaaacgtcaagaaaggttggagaaggtctaggaaaacttatctttgaagatactgtcttatgaatttccagctcagacttgcagcttttgggagctgaggctatgaggtgatcttgagagcagctgaggaggctctaatgggttccagctgtgtgcccagagaacccaccctctcaggataacattaaccaggtagaccctgccctgactgacttcctctgggctttatgggtccccgtggtctgttgcattgatcttgcattttcaggttttatagcaattctaaacatgtgagggtacatatttgctctttgatgtgccctttgatagaagccagagtgctttacctgagcctgcctgtaataatgggggaaggtgggttgcatgccctgcagccatacgctccctgggaggctggttttattgcggttgttgattggcagactttaatcaggggtgt

SEQ ID NO: 22033 - DNA, 1026 bp, Homo sapiens
gtttctagaactttcaagagtaattgttttctgtaatttatagtaggaaaatattgatttattaatagttaaaatgttctttgggatgcttgaagaccatgatgtgaaaaacttaaaaaaattagcattgatgttgtttctatatatttgccaatgggagtactataactttgaaatgtaggggattgtttgaaacatgaattgtgaaaaataacgcaactttagttattttatattgggtccaggctagtccgctgaagagtatgaagtacagttttatgtaaaatatatctcagattgagaatgtggaaacactgttctttaaaaaaataaaatcttcagtaagatccttttatgaatttactggtttgttctcatttgtcatcggactgtttccagatgtaaaatattactttcttgaaattgctgttgagtctactatcaagaccaggtgcatgttgttttacagctattttacttctgatttttaatgctgaaactcatagaatgccttgaactgataatttgtttaactctctacctactaattggaccaagaaataactttgtatctttatctcttttccatttcatgttttatttctgtttcaattagtgtgtgcctttggcaaaaaggagatgattttgctttctgttttaggatttgcctccaagaaaaaatatattttattgccacattttctcaattgatccagtagagttcacagacaatgaaaagagtaagaaaactaatttttaaagcttggtagtgttataattttcttccttataataatcagaaaaagaatttgtataacttttgtttctaatatagcagttctgaaaatctaggcttacacattttccttcccattactgctgtttatacttaagtaaaacaaaaatggtcgctgcaggtttttttctcattttagtgcagagtttgaattcttcaaagactgctaaggttttcccaccttaacaatttatgacagacccttatatcttcataggctgagtccgctg

SEQ ID NO: 22034 - DNA, 1055 bp, Homo sapiens
attatctctactcatttatatctccattgttttaggtgtctgatatctcaaaacaattctttataattttttagctgtaatttcgtaattatagttttataattttctccatgaagttttacattttctgatgatttattcttcagtaccttatttttctgtttctattattaccagtatatttttttaattattcaaattatttgttacttgtatatagaaagtcttttttaaaatttttatttattttttatttttagagatggaatctcactctgttgcccgggctggagtgcagtggcgtgatcttagctcactgcaacctctgcctcctgggttcaagtgattctcttgcctcagcctcccaagtagctgggactacagttgcccggcaccacacctggcattcaattgatttttgtatatcaattttcatattcagccatgttgctgagctctcttattagttctaaaaatgtctttgtgttttccttagagttttttctgtagatctgtcacatcatgtgtgactcaagacaattttattgttttttcctttcaaaccccaatacttggcctttttttttttttgtctttactgtgctatatatgaccttaagtacactgttaaataggaatggcaatactgattatcttgtcttattcctgattttcaccatgaatagtgatgttgatgttgatagatacttgattaagaaagtttcattctattcatatttcatgaagagtttttatcatgaacaggtattgaattttatcaaatactttttctacataaaattaaatgatgacttctttatttcctttaatctgttaatgtcgtgagtgacatccgtatattttcctgtggtaagccacctttgcattttgtggatgaaattaatgatgtagcttcattactcttttaaaaatattgtcctggactcaatttcaaatattttcttcagtatttttacatctatgcttacaagtaagattggcatataatatttttttcctcctactttctaagtctagttttgtctacaaagtta

SEQ ID NO: 22035 - DNA, 1033 bp, Homo sapiens
tgggaaagaagatatatcagttaaggctcattgagttgcaagtgccagaaaaacccaactgaagcttactttaaaaaaggaatttattggctgcattatagaagtccaggggcagttctgcctacaggggatagctgtatccagtgtgtcattaataaatggatttttgcatctttccattctgttcgcctccctgatagcttcattcttgaattgaatgtggtggtgtgatgactgacagtaccttcaggccaatggcattccagattcctgcctgctgcaaaagtagcctattttcttccaacagtttgaacaaaaaaaaaatcttgggcctaattttcctgggtttgaattgggtcatgtacttaaccttgagccaggagaatgtagtgtgctgattgcttaggtctgggttacacagcagccctagagctggcggtggagccagacgcagtaaagcacaaggacagtgtgtagacaggaatggacgctggaccaccaaaacacagcaatgggcactagagaagggaacctaaaatgtgttgagtgccacctatgaggtgtttggttcgttcaccttttctcatgcaaagttcacactcttccttggaggaggtcttgatttccaccattttgtgaatgagtgaactgcgatgcagagaggtgaagtaatgctcccaatgatgcacactagtaagtggcggagctggggtttgaacctatgccttctcaactctgctagtattctccatgcatctaactaacatccaaaaacagttatctggccaagcacagtgactcatgcttgtaatcccagcactttaggaggccgatgagggaggatggcttgaggccagaagtacaagaccagcctgggaaacaaagtgaaacaccaagtctacaaagaagaagaaaaataaaaagaatggggcgtggtgatgtgtgcctgcagtcccagttacttgggaggcttaggtgggaagatcacttgaccccaggagttcaagactgcagtgagctaagatcagtctgg

SEQ ID NO: 22036 - DNA, 1057 bp, Homo sapiens
caattcaaaaccacaatgagataccacttcatatccacagggtagctagaatcaaaaattcatacaacaacaagtgttggtgaggatgtggagcagtcacaaccctcctacactactggtggggatgtaaaatggttcagctcctttggaaaacagtttgacaattctttataggatgaaacatagatttaccatgtgacccaatcgttccatttctagttatatgcctaagagggaaaaaatagtatgcccacagaaatacttgtacctgaatgtttatagcagcattattcataatagccccaaagtggaaacaacccaaatgttcatcaatggacaaatgaataaacaagacatggtgtatccatccatgttggccaggctggtctcgatctcctgacctcagatgatccgcccacctcggccttccaaagtgctgggcttacaggcatgagccaccacgcccggccttggatttcttttaaatgtggtagaaatgttttaaaatttattgtgattgttgtgcgtatctgaatatactaaaaatcattgaattctacactttaaatggaggaactgtaagatatgtgaattttatctcagtaaggctatcaaaaagtaaataaaaataaaaacaatgcaaattatacatgattagcataatagtaaattagggagagaaagatttcatctgaatgtgaccctcagtttagagattgatatagtttggatttgtgtccccacccaaatctcatgtcaaattggaggaggggcctggtgggaggtgattggattatgagggcagacctcccctttgctgtcttgtgatacagttctcatgagatctgctttttttttttaagtgtgtagcacttccccctttgcccactctctcttccctgctgccacatgaagacatacttgcttccccttcacccttccgccatgattgtaagtttcctgaggcctccccagccatgacttctgtggaactgtgagtcaattaaacctcttttctttataaattacccagtctcagttagttctttatagcagt

SEQ ID NO: 22037 - DNA, 1042 bp, Homo sapiens
ttgttaatccagattaattccttctgtacattactggaacgacttctaatgggcaacagttccctagcgtcactcttaaatatacagccagagattatcaaagtgctactgagagctttatcagtacagagcgttagttgctatatactcagtttaaatgtggcagcacagaatacataggtatcccactgtctctaatgattgcatctggcaggcagtctagaacttgaggaagagtttccttaggcctggcaattcctagatgaagaggctcccaagagacccttgttgtggaattgaagatggagaacatcttgagcactctcattctttttggtgcatctacagatcttactttaattcaattatagaaaaatgtattagattgcataacagaggatgatcttacaaaattgtatgctgtttttaccaaattgcaaacctggacaataggtattttaactggttgttttccaattactattttcctgtctcatagcgtgattaccttttggggactgcaggaataattatgcactttagagctgttatgtctagatgtttcacatatgtattatgacaggtcagaagaagcagagattaagcatctacatttttacgatatgaaatatgttttattgggaaaatgtgtgagcaacaaagacgtcttggctgcctgctttacctttttgaattagatgccattggacttggctttaagtgtgccttgtgtggtttattcttaacttagttttttataagatctattactattatcttattattttctcatatcattcattaatttggctctagtttcctgtttcttacctcagtttatgctatttgattttcatttttttctgtaaccaccattctatcttgtttaccttcttaccagctagccattcagttaaagtttctctaatttgcatgaataattatccatctaactatctgcctccacctcgtgtttaacatccccctcacatcccttctagcctagtattttctcttttctgactgtcaaactacgtttttg

SEQ ID NO: 22038 - DNA, 1050 bp, Homo sapiens
ttctgtcatggttttccattttgaaagtctaaaccagcactggtctagtaatatggtagccactaggcacacttgtctattgaacattttgttatatgactagtgcaactgaggaacttaatatttaattttatctaattttaattaatttaattttaaattgccacatgtggctaatgagtatcatattgaatagcatgggtctaggctgttttatttaattaattttttttttttttttttttgagatggagtttcacacttttgtctaggctggcgtgaagtggcatgatctgcaacctccaccgtccccctggcccctgcccctgccgctcgtttgaagcagttctgcctcgggctcccaagtagctgggattataggtgcccaccaccacacccagctactttttgtatttttagtagagagggggtttcaccatgttggccaggctggtctcaaactcctgacctcaggtgatccacctgtctcagcctcccaaagtgctaggattacacgtgtgagccactgcacctagctaggatatctgttttatagactgttgcgtattctggattaacctgattattttcccatgattggcatgttgattataaaggtagcaacatttatttctcattgcaggttttcagaatatgtcagtttccagttatgtcaactatgcaatgtaataatgccagtttgtcccagacagtttttataacaaaatactttaatgcacccctttaaatatgttttgtgggctgggcgtgtggtggctcacgcctgtaatcccagcactttgggaggctgaggcgggtggatcacctgaggtcaggagttcaagaccagcctggccaacatcagaaaccccatctctaccaaaaatacaaaaattagccaggtgcagtggcacactgctgtagtcccagcaactcgggaggctgaagcagaattgcaggaggcggaggttgcattgagccaagattgcgccactgcaactccagcctgggcaacagagggagactttgtttcaaaaaaaaaaaaaaaaa

SEQ ID NO: 22039 - DNA, 1048 bp, Homo sapiens
tggacggtaggaggctctgaagataaattcctctcttctggaagcctgcctattttaatgggtttgcttttccttttctggtgtcatgcaatccttttcacatgtccatcctcctgccacttcatcctatgtaaggtgagacctcgcctgagatgccagaagggaagcccttgaaccagcctggagcaaacacatttgctttgctttttttttgagacgggtcttgctctgttgcccaggctggagtgcagtgatgcgatcacagctcaccgtagcctccacctcctgggttcaagcgattctcctgccacagcctcttgagtacctgggaccacaggcacacgcaaccacgcctggctaattttttgtatttttagtagagacggggtttccccatgttgcccaggttggtctcaacctcaagtgagccactcaccttggcctcccaaagtgctgggatcacaggcatgagccaccgtgcctggctgaaacccatttttgtatgtggggattccggtgctgccttgcctcctctgaccgtggcctcacttccttattctttcacctggggacggagcacgctgcttccaggtttggctgctggagcgtccttgtgggaccgggaaatgccacagtgtcataaggataagtcaggtatggggaggacattggagagttgagaaagaacactgatctagcacactcttctcttcccctgcgttcccttctgacaactttttaaactttattttgaagaaatttttagacttacagaaaactgattaaaagagtacagagttaaaagagtacatataccctctactcagcctctcccagtgttaacatcttacacaaccactgtacagttaccaacgctgagaaaccagcgctggtacaatactattaactgcactccaggcttcatgtggatgccacttgtgtttccaaaaatgtcctttttctctcccaggacccagtccagggtcccacactgtgtgtggctgtggggtttcctcagcatcctccaatctgtgacagtcctgatact

SEQ ID NO: 22040 - DNA, 1062 bp, Homo sapiens
tcccgaggggaagcagatccacagcgcgcatttgcagtgagccattagcgagctttagaagtttcccagcaaattccctaggcccctgaaactgttatgatccattttgatgataaaccaatgctgagaggctggactgtttgcaattttttaaaaaagagagttcggatttttgagggttgctctgagatttttggtgtaggcttcattttaaaattattttctttttccttccatttctttcttcccttcctctttatcctcctttcttgttactcactcagtgctttgcagatcatattctaaaggaactggaccattttccacttgagaagagaagcgaggtggtcattctgttttctgctcactcactgcccatgtctgtaagtaagaacattttctgggatgacctagtgatagaggattgggtgatttcattttctaaatgtgtaaaatgggtccagcttccattatgtcctaagcccagtgcaagaatgaattctcaaatctcagacttggtgctaactagcctcacttcttaaaacctcgtaacaatgaattcaaattataatgttgtaaatagatcttttcctcttttcttttttttgaaacagagtcttgctgtgtcacccaggctggagtgcaatggtgcagtctcggctcactgcaacctccacctcatgggctcaagcagttctcttgcctcagcctcccaagtagctgggattacaggcacccaccaccatgcctggctaattttttgtatttttagtagagactgggtttcaccatgttggccaggctggtctcaaactcctgaccttaggtgatccacccgcccaggcctcccaaagtactgggatttcaggtgtgagccaccacacccagctcctcttttctttaaaatgataacttgaagatatatataagactttctaataagtgggacagttaagagaaggctgcttttgcctgccctgtcagcagagctcagcttgatgtttctgtgtgttgagtgggggggtctccattcagacaagcgctctcaatcccatgcttttg

SEQ ID NO: 22041 - DNA, 1069 bp, Homo sapiens
ttggttcctcaggatatgcccagttggagagtaccttgctgctttttctccaatatgtgtttacaggttgtctttagaaagcatttagaaaacattatcagttctttccagggtattttactctgtctcactttaaaatgtggccacctgcccttgtctttatctgcaagggcagcctttctacctcttagtatgcatgatttgaggaactcccagaccctaggcatttagaccgtaaccttcagatactggacaggtgaaaagaaaatgcgagaagccggttgacctgcagcactggggatgtcattctgatcatcgtattgtttcaaagtagaatcgaaagcagtttctacttgcttgctaaacctcagctcaaatcaccaagagttgcttcaagggatttgatggtattgtaatagttggcggtttttagcacaaagcacataatctttgaacaatcagtcatttggagtttgcttatgggatcatgtcctgtgatatgttttaactgctagtgaccattttatgcaaggcagcacgaaattggtggccggaaaatggacagagcgctaaaaatgatctagttttacttccttcttcttttttgcagtacccaaccagagaatactgagtccgaccagcctttctgtgcacacatgtgcttctctcgcctaatggcattctgcttctcccttgggaatgtgttcccctggctcttagctctctgggtcaagttaggaggaatgtcgtccttgtatatatctaggtataaatgagataaactcccgtcttttccttcactttaacctaaatgtttcttgtggcaatttatgtcacattcatagttgcagcccctgctaatgctttggacagtaacattatcatggtcttattatttattacctgacactcatgtagtgattctcactatcatccctgagtgtaagttatgtgtaatcctatgaaaaggcaaggaaacaagactaagtaagtttaggaaacttgtagttttatgactttatacatgcttaaacaattatgtggtgtggatgtttttgaactacaagaa

SEQ ID NO: 22042 - DNA, 1049 bp, Homo sapiens
ttgctgagaatggtggtttccagcttcatccatgtccctacaaaggacatgaactcatccctttttatggctgcattagtattccacattttcttaatccagtctatcattgatggacatttgggttggttccaagtctttgctgttgtgaatgtgtaaacttaacactgtatcttgtttcataacgttatatcgatatataggtctggctcattttttgattactatttagaactgcatcatatggctgtaacttaatttgtttaatccatgcttcatggtggacaattagtttgtttacagtgttgcagtgaacattcttgtgcatacatctttgctcctatatgcaagtgtatctataagattaatagactttattttttaaattaagagaaatgtctacttcatttgtcttatatcctagttctcgttaggtgtgggatcaaaatgtgttacgctagtagctagcgcacatccaggtttctctgcatgggtgttgtgtgtcctgaatcttcaggtgtgctgctggaacagcttgtggagcacagctgggtattcctcagagagggtatagctttagctccttattctacaacaagagagctggctattgtcaatgacctcaagcttctgttttaaaggcttaatcttgttaggctctctaaaattttgctttttttcttttttattgagtagaaaacatttctcaggttgctaagctggaataaaatccacttacctgtatgttaaatgatttagtaagctggcaccattcatcgccaaacgccgaacccccaagattcaagagcagtaccgcaggattggaggcggatcccccatcaagatatggacttccaagcagggagagggcatggtgaagctgctggatgaattgtcccccaacacaggtatggtgtttcttcattaacatgtaactagattagttctttcgaagtagttatgaaattcaaaagagtagtagatgctaaatgcttcatatgtactggcaactcaatttgtggtgtttctacataatacatggtcactta

SEQ ID NO: 22043 - DNA, 1041 bp, Homo sapiens
atcacgtgactttctcctccctgaaactctctgcttttcataccaaaaacccctccacctttggcacttgtgtgacctgctcagttttggagacaaacaggaggctaattcaattgcttaaatatcaacttgccctcttaaatgtccttcagccatttcaagcgacccagtttcccaccttgccgttcagcccctgccaccttgctgcctcgtaatggttcctaaaaatgttgtccttaatacgtagagtagttcaactctgtgaaaagcaatcttggcagcacagtgggatcatttggggaccttaaaaataatggtgtttgggccttaccccaggccagttgaatctgaatttcagaaatgggaccagggtattttttaaaagctccccaggggaggttgttgcacagtgaggttgacagtcgccaggtggcttcctcctacttctaaactcaaccttaagcctctcttattattgctgtaggttctctattgattttgtattaatctctgtagttgaaatgggaacactgagggctgagaaacttcaaagcttgaattttgaattgccatagaataagtatatttcatccagcccttctgggaaaaaagggatgtcatgatatacaaatactgcaatttctagtatttggaaattgctggttaatgactcagtttcttatgctgaaaagtttccttctgccttatggatcataaccaatgtgatgatcaggtgaagaacatctttgaagagatattgataaactttgtttgtgggacaaagactagtttctacagtcaaaatcaagtttgtattggataaaacttgtcttagtaccccaacttacagaaatgaaggtgttcaaaagttttagctttttttcagtatttacctccaaattgctaaataacatgcttatattactttattgatttttcagttttaggcgttatttattgcccttctctggcatataaggatttcatttcttccttttcctatccccaccattcgtgttcacccttctcatctccccaagt

SEQ ID NO: 22044 - DNA, 2463 bp, Homo sapiens
taagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcaggtaaaaccaattttttaagtactcaacatttttttccactgtaatcgttctgtatatattgaaatttttaaaaggggagaattcagggtagtactttggtatttgaatgagctatattcagtttgcaggttataatgtggtgtgtgaatattgccagctttgttttggccaagttatatgttaatttcatttgaaaacctgtttaacggccggcttgttgattgcaactgagttttaaaaaattgatcctaccagtatctagtacccttcttcattttcctcttataaatagacattgacttattttaaaagtttttaaaaatctcttctttccagggtagtacttattccctggttgattttttcataccaaattatttctttatgcatggttcatgaaggcatagagattaagtgctgggattacaggcacgagccactgaatctggccatagttgaattcttaaccacagtgagctaactcctttcatggtggaaaattttaactgtcttagatgaaagttttaacttaagtatttactcctctttctttctttctttttttaaacagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacc

SEQ ID NO: 22045 - DNA, 1050 bp, Homo sapiens
cagttatataacaggctcatgttttccattttaggaatgtctacatagttttctagtctgaagttatatatatatatatatatatatatattttttttttgagacagagtctcactctgtcgccaggctgaagtacagtggcgcgatctctgctcactgcaacctctgcctcccagcttcaagcgattctgcctcagcctcctgagtagctgggactacaggagcccaccaccacccccagctaattgttgtatttttagtagagatggggttttaccgtgttggccaggctggtcccaaactcctgacctcaagtgatctgcccacctcagcctcccaaaatgctgggattacaggcatgagccaccacacctcactgaagtaatactttataatagttttttaatggaaattttagtgttaatgtttatatttatgtatatatacacattatatttttcctttcttctgtagaactttcagccccccaaacggcctttcaaacggatgaactattcagatgctatcgtttggctaaaagaacatgatgtaaagaaagaagatggaactttctatgaatttggagaagtatgtatccctttctctcattgtttccaaggtgggattgggctccaattctcttcttctggttaatgaactagtaacatgggtggcatctgcctgtcctcaaataaatggtaacagcaggacctgcttcttgggttgcctgcagattcgctgagttaacagagtcagccttaggacagtgcctgttctgtaccacccagtaagcgtaagtgagtttctttttttttcttttttttttttttttttgagacggagtctcgctctgtcgcctacggagtgcagtggcatgatctcagatctcggctcactgcaacctccgcctcctggattcaagcgattctcctgcctcagcctcccgagtagctgggactacaggcgcacaccaccatgcccagctaatttttttatttttagtagagacagggtttcaccatgttggccaggatggtctcgatctcttga

SEQ ID NO: 22046 - DNA, 1039 bp, Homo sapiens
aaaaaggaagtttacgcaacccgctgcgtcccctccaccgccgcgcaccccgtctcgcagctggcgcggtgtttgctggtgacatgaactcaaccagcctccaccatctggggatcggggcgacatccttggtctggtttgcaagaggacccgcacgcctccagctggggcggaattggaagattcagaaaggaaagttggggaggcggggaaggaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctaggtgggtgagactcagtgtatggcgcggtgttccctgcctggggcaggaactctgctccagtcgggtttcggcgctttccttagtgcctaccagagtgggcgccccgcgaatgtttggggaccgattgcagggagggagggagggagggtgctggcctttgctgggcccgggacttgaagggccaggccgggcttccccgagtccgtcgttcccccgggctgcgatggcggtggctccgggcccttcccctgccccgctgcgaaacctcccgattgcgctgagactcaggcgctgggacgggttcagacacagggtagcccctactcctgcagttcttcaaagtgatcgtcaggaaggggctttaggattctagttgtttttctcccaccctcatttttttattgaggtttccggggagaccatactgtgcagtaggaaaaaaaaaaaaaaaaagagagagacctggatggatgttaactgtt

SEQ ID NO: 22047 - DNA, 1056 bp, Homo sapiens
actgttgaatgcactcgtaggaaatcagaattgtgacccctgtcctcagggtcacaaagccattagcctcctactatatgctgtatgagtgaaatcatctatatgtgcagctacaaagcggacaagtctgtgtgtgtgtgagtgtgcctataggaaatgattgcgtttggcactagtcctttactgtacagctgaacacctagaaagatttattataacttcattaaaaatatcatccattatattcaatatccacttatactattggttttaacacagattacctagtagtattttctacatggtatttttagatgacctttagtaaaatataaaggcataatgtcgttttataaattattttccaattttgaacacaactcgatttttaaagatactttacctgtttttttttttaaatgatgtaatatattagacttgaaaagtaaaagtattggagatctgtgactgaaaaaaaaaaactttatagtgattttattgtatcaagagactttctgtttcagaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatggtaactttgtttccttttccttttataattataatctttaggaaaggaagaactcatactctactgcaagtattttaaccctttagttaatgctaatgcttatttttaatgtttaaggtagaattgtcccatttattgcagatctccatgtgtcctggttttctagttattgaaggtggaagaacagttcccatagcagtcatggttttttaatatgtaatatttatattatcatttcgtgaaaatattttctgatttccatgttaatgtcttctctgacccatggattgcttaaagtgtatttctttggcctatttttccgtcaaggttctaatctggtaatttcttgctatcttgttagcttcatttaccttcacc

SEQ ID NO: 22048 - DNA, 1086 bp, Homo sapiens
atttccctttgtggttagtattttggagaaggtactttgagactatgtaagtatccatttcaaccttctgctcattcattttagcatccattgatgtttcttgcctgtaacaagaaagtggtttttgccaaatgctgatttttttttaatttttatttttatgtatttatttatttatttttttgagacagggtctagctctgttgcccaggctggagtgcagtagtgcaatcacagctctctgcagcctcaacctcctgggctcaaatgatcctcccatctcagcctcctgagtagctgggactacaggtacatgccaccacacccagctaatttttctattttttttggagttgggattttgccatgttgcccaggctgatctcaaactcctgggctcaagcagtcctcctgcctctgcctcccatagtgttgggattacaggcgtgagccaccacgcctggccccgatgtttatatttcgaaataattccctccatatttgttcattggaattctgctgtcaggaccaactatcttttctctcccatttatttatttagttatttatttagatcagttcagactcatggatacttattccataggttacagtccaacactctccttatttattttgctgctcaaattgtttcaggtatggtcattctgagctccttcatgttggcatctttgttctctcaacaagccctcatctttttttgagcattttaaaaatttatggtactgctctatcttctagggtcatcttgtattttctctgccctcagtgagccctggttcctttttcttgagaaaggtatttgaaaaccaacctttgggcactaggtatgctcattactaccgcggtgccgttacctctaggcctcttactggacagagctagggaatatacatatgtataccaacccatgcatgtacatgagtctgtagttccgtgtctgtcaacctactcttgtgttaaaccatgagattatgcagatattttggattctggctggactgaacactacagagttaatttttaactttcccccttgtcttatttgaaaattcttcctccaac

SEQ ID NO: 22049 - DNA, 1050 bp, Homo sapiens
taaaacaataaatattgataaaatacatttacaatgataaaagtaatctcctatggaactttttcagacttttttttttttaatttgtagatgaccatgatgtcctttcttttctgactttccagttgactgaacctggaaaagagccggtaattttacacatattttcaaaaactttatcagtttagtttgccttttagctgaacgttttggaagactaacttaggtttggatcttgtttctgccagttactgctatatggtcttgtgcaagtcactgaacctctgtaatgcttcatttcttttttttttttttttttttttttttttttttttttttttgagacggagtctcgctctgtctcccaggctggagtgcagtggcgcgatatctgctctctgcaagctccgcctcccgggttcacacctgtagttccagctactcgggaggctgaggctggagaatcacttgaacctgggagcgagaggttgcggtaagctgagatcaagacactgcacttctcctgcctcagcctcctgagtagctgggactacaggcttccgccaccacacccggctaatttcttgtattttttgctagagacggggtttcaccatgttagccaggatggtctcgatctcctgaccttgtgatccgcctgccttggcctcccaaagtgctgggattacaggtgtgagccaccacgctcggccacgcttcatttcttaattgctaaaacagaaatgtttgtactggccacctcatgatattgaaggattgagacagtgcacgtatagcaagtgctcagtaaatggtagtggttattattagaggcaagagtaggccgggtgtggtggctcatgcctgtaatcctagcactttgggaggccaaggtgggcagatcacctgaggtcaggagtttgagaccagcctgaccaacatggcaaaaccccatctctacaaaaatacaaaaaatagctgggtgtggtggtgcacacctatagttccagctactcaggaggctgaggctggagaatcgcttgaacctgg

SEQ ID NO: 22050 - DNA, 1074 bp, Homo sapiens
agctgggattacaggtgcctaccaccatgccacgctaattttttttgtatttttagtggagacagggtttctctatgttggccaggatggtcttgaactcctgacctcatcatccacccgcctcggcctcccaaaggcctgggattacaggcatgagccactgtgcctggcctgtcagttgttttttaatgtcgtcttgctgctgctaatgccatttgttcacaaaagaacataggacatctgcccaaataaacattagccaagaaggagatgctagcagtcctagaccatggccaaccccacagcatgaaacggtgtttaaacaccttgaaccacaccacaaacatccagtcggcaacattccaaccatgggaaacacgacaggtcaaatgccctgggttccggcagtctgcaggcaacaggaaacttaaaggacctatcactttttaaatgagcaacactaaaccataatatctaggcatgcacaggtgggtaatacattattttttaaaacataggaagttattactatgaaaggaaagtggtgacttgttggggaagagaggagactgattgggatggggcacgtggaaggagggggtctggggtggctggcaaagttctgttggattgatttgggagttctttaaaagggtgcttactttttttatttttaatttctggggtacatatgcaggatgggcgggtttgttacacaggtaaatgtgtgccatggtggtttgctgcaactgaagaggtgcttgctttataacaatttgctaagttatatatttgtgttgtgaagtttccaggttctttgctttattttgcaataaaaacatgtttttaaatggtgtatagacctcagtgcctccacctccaccacttcttctgtggtgtgggaagaaaacaagtgatgtggtgagaaagggagagtgtggggatagattcgatgcctgtcatttaacttttagatgggtctctgtcccgcgagagcacttaaaattcagagccaactctcctgtccttttttttttttttttttttttaagttgcttgtgttctggcagcagg

SEQ ID NO: 22051 - DNA, 1050 bp, Homo sapiens
gccccaacaaaccactggccagtgatatgatctcggacctcagttgtcttactcataagacgagactgtcttggataaactcttggtctctctccagcactcttgaacatttcatccagcagatagttcacatcacgtgatggcactgtgaccacattttcggttctttaaagcacttcaattcactgagtgtctatttcttcattccaaccacaaggagaataaaagtgcagtgtgtgaaagtaaaattcttcaaaatcctggccaaaatgcccgtgtgttcttatttcggtcaggttgcactttcctgtgagaacaggatgatctcggttttctcctgctgaatcagctgtggcagccaagcaggaagagccttcctagtgccccagcactctgcttctgtcagcatgcttctgggccgcccagacgtagcccacaccactggaggtctcactgtttgcatacatttcctttgtctcgaccatttcatgaagtgtagccagaagtactgtcagcactcattagaccaaaattgtcttcagctcaaagcaaatattttgtgtgttgaaatctttatcaggtgtgtgatccacgtcccaggagtgcttttaatgagctgtgagatgttggtcatctgtcaccttcagttttttgtgctaatttaaattgctctgttcttgtggctgatgatgccctaatcagaatcttcaaagctgccctctccctggggccaattttctgtctgctattgccttctggacatgtcaactgctagttgacatcttgaaaacagggctctttgtcttatcccccaaatcaacttaacttgcccagttttaatttctgccaggagctctactgttttctctaaggtcaactcgaactccagatctatgactgctctgtcttattttttccacctccctgctcccctcagataaccctcccctcacctgacctcaggtgatctgcccgccttagcctcccaaagtgctgggattacaggcgtgagccattgtgcctctctctccctctccttttccctctccc

SEQ ID NO: 22052 - DNA, 1072 bp, Homo sapiens
gtgggttaagagagcttcatctgagggagaagggggaaggggctcatacccagaagacaaaccatctcaggagccatgtggaacttggtgatggcccttaactgagcccagctcattttcctattctcaaagtagaaagaaatttcacagatcacatttagaggtttgggtgaaggggtggggctgggggcagactttagcctacaactatggatgatttaaggtagtgcttggagctttttagtcatgtgtgcagaacactgcagtcccataaacagtaaaaacttggtctgtaagccatgtttttcggaagttgggttttattgagtgtagcatgcttagagttattcagatgtaactttgcaatggctttcttccattttctctatacccagcctaagccttataagggactgcggtgatgagtggcaactcatgaccttaaggcacaggatgtatgcgtggacagaagtcaaaattctagacttatttccatgactaccttgggcacgtcatttgaatttcttgggcctccattttccatcctgtaaaatggaaacatcctctgagctctaatgtctctgctgttcccccaaacaatggaatgtgctaccatcttactttgagatatgacctgtagatttatatttcaacagtttctgcagtggattgcattaaaattgtgaatctcatagggacaaaagaagctctgcaaaaaaacaaacaaaacaaaacaaaaaattcctttcctgtatttgatcaaatgccattgctaaaacagcactaaaaaggaaaaaaaaagttcaggaaaattcgctgaacttttcccttttgccctgtgcttgttttcatgtcttagtgtgtttcaatgtacaaccaagttgttaatgttttctgtttaataaacagaacatctataacttcctctcctgatgttctcgatcagtttggctattagctaacagggaactagtttgagccacaggactcaaggtcactttcactgttctttcatttgcattctccatataattcactgtgttaatgctctctctgaaaacaccctgcttta

SEQ ID NO: 22053 - DNA, 1037 bp, Homo sapiens
gtagcattttctgttaggatatgggctctagctagatgcactcattaagctgaaggcatcaagggagaaatttctaagtagtttatatgcccactcccccatctcacataaatgcgcattcttgccagatcactaacagataatatttgtaaatgatctgtcagggatgagaagcatagaataagtggcctggcagtactgccatgcggttggaaacccagcagtgttttcagcaattatttaggtcatagaatatttttactagaaggtgctttaggggaccatctaatccagagtcctcatttgtcaggggaggaaataggaggctcatctagaggttatttgcttaaggtaacctatctatgtaacgacagaataagagctagaatccttatctcctgattcctaatagtaatgattggcagatatacaaacaaaaaccagtagttatcatcactcactgcaatactgacatgtggctttaattcctaaaaatgtctagattccaatatactttgatttttaaatatgcatcatcaaaccatggaggggtcaaattcattcattgtttgttaatttgacataaacaaaatgcacctggggctgggtaaatacctctctggtgaccatggtgcttggttagttgagttttgtagcgacagaattggcacatgccctagcagagtcccctggcacaggatgcccttggctccacggcacatccagacagggacagcacctaggctgcagccaggccaattgggcccacagttgacctagtgggctgtgctggcagggccaggccttcagttgtgtggtgagtccctggggtgaccttggccttctggatggtgtgctgcttttgtctggttcaaccagtattattctctctgtcccatcctgcctgcctctgccacctgggccagttggcctccagcactgtcagcatcgcctgccctattccctgtttaaatatgtaaacatcttaaataaccaaaaggctgggcgtggtggctcacgcctgtgatcccagcact

SEQ ID NO: 22054 - DNA, 1026 bp, Homo sapiens
tagatcttttgtcacagtccacaggtccctgagactctgttcatttttttttaacatctatttttgtttttcaggctgggtaaattctgttgttttatcctcaggttcatggatcctttcctgtgccccctcagttctgctattgagcacttccatggaaatttttattttggttattgcattttttagttctagacttctttatttgcttcttatttacatcttctttgctgagaattcctatttcttagctcagattttctgtttttttgtgtgtttgtttctagtatgtacataattgctcattaaagtatttttataatgaccactttaaaatttttgccagataattctaacagctctgttatttaggttttgatatcagttaattgtcttttttcattctgcttgagatcttcctggttcttgatgtggtgagtgattttcttttgaaacctagacattttgggtatttggttatgagattctcagtcttatttaaacctgttttaactggcttctgacattcctatggcaggggaagaggggacactacctcatttctgcctgatgaggttagaaatccaggttccccttgcagcctccattggcacccgagagggagctccttactgctgcctgccagggaccagcgttacggcaccctgcaaggcctccactactgccttcatgactgggaaagacagaggtcccctttgcctcccatgcaacctccactaataacatggtcaggaaaggaatggcctttctacctctgagtggaggtggaattcctggctctccactaggcctcctctgacatgaccccattgaagagggggagggacctcattactgcttcatggaggtggaagtctaggctccccacgtgatgtccactgacatcctccaggtatggacagaagtaccagcttccctcctcagccttccctgacaccatgacagtggaggggagggcatagccggggagttagagtgccccattatagcctggtgaggatggaa

SEQ ID NO: 22055 - DNA, 1021 bp, Homo sapiens
agggactctgtaaaatacttgatataaatatgaagcttagcagttttgttattcttgaatcaagctagcatattcaatgctgaaagaaataactaatattagcataaatttgcatgttgttcttgatgagtataagctagaactgggtttagcatagtattatggatatgccataatgaaaaaagtttttcttccactgcttaagaatactagaaatctcatttctagttttagtatatttttgcaggatatttacatgaatttaatattgaaagtatttatgccttgtcaatatcacataagagatatttacttagatgcaataaaaactggtgaatgacatgtactttcctgcatctttgttggtggataagatttttagaagggattttaattaaggtttaaataagaagagctggggacatgtggaatgagaaatagaaggctcatcaaaatgtatgtgtgtatgtattcttatatttgtgcgtgtctatagtaatgctatctggaaactagtgcaatgaaaaacaaaacacaacaggagagaactgaggcaaaggtggctcagaaaggtctcttttgacctttaaactcagaagtcactgacatttcttcctggatatcacactgactcatcaaatttaatgtcacacattgaagccagtgatgccttttcttcctattgcaaactagcttctcatcctgttttctttatttaatacatcacacaagctgaagtccagccacccttactgccatactgcttaccaaataatcactgatatcatctctcctttctgttcaccttttaacagtcttattatttatattgctaatcattttcttacaactgttggaagcctacagttaagatgggggtggatatatatactaatgacttatttgtttattaggtctataatgccaaggacgagttcagtataacaaaccagtgaaatgattctgcttctcttccgactcactccttaaaatgtgtattgaacaaaagtgaagtagaaaa

SEQ ID NO: 22056 - DNA, 1032 bp, Homo sapiens
tgagagcctattataataagggtatccccaaggttggcttaacatgtgcatcgtgacactatgcataattttattctaatttttcttaactttagctttgactgcttcttccttcttttaaaacatgatgtattaaaaatatttcggagttggctgggtgcaagggctcacgcctgtaatcccagcactttgggaggccaaggcaggtggatcacttgaggtcaggagttcgagaccagcctgaccaacatggcaaaatgtttctactaaaaatacaaaaattagctgggcatggtggtatgcacctgtaattccagctactcaggaggctgaggcatgagaattgcttgaacccaggaggtggaggttgcagtgagccaagattgcaccactgcactccagcctgagcgacagagtgagactctgtctcaaaaaaaaaaattaacttaaaaatatcaaaaattaatattaatattaaaatgcttaaaatattaactataaggcaaaaagacactgatcaaataacatattgttacctctccatttgaaaggaatagggttgttgcatacgcatatttaactcagatttttaaaaatgtcatttagtctggtttttaaacttttagaacaaaaggttttgtctttgcagaaaattgtatctagtacagaacccctcctgaattattaaatgtcctaattatgaagaaaacatatatatttaaattttaagggaaaacatgattttgaaagtatgttgtgtcctatctttatctttttgatagattgtataggaaaaagacataaaaattcacagtcttctaaatgattttacaaaatcatctgttgatcctctgtgcttattcattgttaagaataaaagaaacattccccttttgactggtgttagcttttctttcctacatggcaccttcctcattttgatgaaattctgcagctgttgctttcagtcagagaaaggtcataaaccaaatgatactgaccttctaaaattacctacttaataatgcacta

SEQ ID NO: 22057 - DNA, 1032 bp, Homo sapiens
ttgtgtagtgtttgatttttaaaaaatatgtgcatatattgctttgataaaacttatttttaaaagtatgtttatcaaaataaatagatattctaatcattggcacaaattcagtagaatatgtaattggaaaaggatactattcataatagaaataaaatacccagcaataaaataatgagaaatgtatattgtaaagaaaactgtcaaattttattaaggacataacaggcaatataaacaaacaaatgttggataatactgttcaatactgtaaaaatgtcggtcctctccaaattacttactgaatatggtattataacaaaaggatttttgtataactcaaaaacataattttaaaatttatatcaaaaataaattctcaagaatagcttaattagttttgagaaagaagaacaagataagagatttgctctgctagataacagaacacattctaaagctattataactctaaaaaatgtagtattgatgcaggccaaacatatagatttagtggaactgattcgtgagtacataaagagataagattcacttgtctacaacgtgcaccttgacttatgatggggttacatccctaagttgcaaataatgtaagtgcaaaatggatttaatacacctaacctactgaacatcatagcttagtctagcctacctttaatgtgctgagaacacttaacattagcctacagttggtcagaatcatctaacataaagccgactgtataataaagtattgaatatctcatgtaatttattgaatactgcattgaaagtgaagaacaaaatgattgtgtgggtactcaaagtatgctttctactgaatgcatatcacttccatgttagctgaaaaatcctaagtcaaactctcataagtttgggacaatctgtatatgggatttggttttgactgaaggtagtgtttcaaatcagtaggagaaagatttgtactaagaaaattgaccatttggaaaaaataaggctagctcttgtaacctcatttcattcaca

SEQ ID NO: 22058 - DNA, 1062 bp, Homo sapiens
aatcatataaaattgattaccctaaatatatcattaggatattatgttatttacatctcttatgctaattctaattttcttttattgtagtatagtagaattgagatttgttaatggaattggttctgaggaatatataaatgttcatatgtttttcaagaaatattgattgactagtatgtgttttgcggatatagcagtgaacaggatagacaaaggctttgcattcatagagtttatttgtacagtagtgtcacaggcaaactataaccaaatgaagaagtgaataaggaatacattatcaattccttttatgaagaaaatacaccggctgttgagagtgagaataagtgagggttactttagaccagccactttagaaaggctggttaggagcctggccagtgtggtgaaaccctgtctctaccaaaaaatataaaaatgagccaggcatggtggcacctgcttgtaatcccagctactcgggaggctgaggcatgagaatcacttgaaccagagaggcagaggttgcagcagtgagccaagatcccaccactgcactccagcctgagcaacagagtgagaccctgtctgaaaaaaaaaaaaaaaaaaaaaagacaaagaaaaaacaaaagaaaagaaagaaaggctagttagggaaggactcttcgtcaagggttcaggtgcacactgctacccctttttccacgtggcatggtaactgatcatagacttcccctattttgatgttcagtgtctgcctgcacatacatattcaaagccactgtgtcctctgggggtctggcgggatggctgattcccatgtactggttcacccactctagagcatagtgaccagccctgcctgtagacctgtctggctaaaaatcaccacttgctaaaagcctgcaatatggtcaaaaaaatctaagataacatgagaaatggactcttgaggtcatatgaaattcaaggaacagaaccaaacctaaaaacattaaaattctcagaaatatttaagaaactattgcatccataaaacaaaagcagcattaactttgc

SEQ ID NO: 22059 - DNA, 1029 bp, Homo sapiens
tagaaagttgtacacatacctatccgaggctttctttccttttctggtggagtgccccctgacaggcatactatgccatttggtctattaatgcacatacctgagaagttgcatctctctggtgcttgcattcagttaacactttagtgcagcaagtgtagaccatcaggaaatggcctctccctggtgccagctgccaatctaccacttttagagaggcagtgtgataattgctgaatcatcacccgacattcctagtggtcggggaagacccctcccttgccccactcatgcctgtctaactacctgtaacaggtatattacatgcatttttgacctacaatagtttcaatttaggatgggtttattgggatataaccccattgcaagtgaggagcatctgtaatttagtagtgttaagtatgttcatgttgttatgcagctaataatctctagaatatttcatcttgcaaaacaaactctgtacccattaaacaataactccggccaggcgctgtggctcacacctgtaatcccagcactttgggaggccgaggcgggtggatcacgttctcaagagattgagaccatcctggccaacatggtgaaaccctgtctctactaaaaatacaaaaattagccgggcatggtggcacgtgcctgtagtcccagctactcaggaggctgagaggcaggagaatcgcttgaacccgggaggtggaggttgcagtgagccgagattgcgccattgcactccagcctggcgacagagtgagactccgtctcaaaaacaaacaaacaaacaaaaaaaataactcttcatttccccctcccccaacgcctggcaaccaccattctactttctatttctatgcatttgactactctaggcaccttatatcataactggaatcatacagtctatgtctttttgtgattggcttatttcacttagtataatggcctcaaaggttcgcctgggttgaatctatttactttaaaaaactcagttcatgcatcttcttctct

SEQ ID NO: 22060 - DNA, 1032 bp, Homo sapiens
caagaagatttaggagtagcactctgtatgtatgttgattgtttggctttgtacacaaatgttagaaaattaaagaatagatttggtcattgtcatgtctgtttgccctcaccagacttgacttagatatggttctttaaagtctcaggcattttagaataactttggggaaggtatttacgaattaatttttaaaaaaactctttcattttagaattttcttaaaagagatatgtttttaaaatttcaaatacctagaattgggcaaacgaggtgttgccaagtagaggctctgctgagcaaataatgaccacatcaaaacaccagccccaaggaagcaggctccgattctgctcccagagcagcacattggtgtggtgtcaaatgcatgtttctaaagaactcaaacattgttttctcttagttagataaacaaactccttgatgtctatttatgactagttgttagtgagtctcttggaagtcatacaaagcagtgagaacaagaaggtgttttgcaggttggctttgagtaaagaccctctgttttgatcagggtcttggatgccctgctcaatcccctactcgaagttctgagggcatttctctgattgtcctccaaaactgtcctgccaactgctatagattaaataggtaaggagcagctactaagtttccttcttccctcccatgaaggagcccggccatgagatttagccaatgagcccatttaactctctgttttctagctcatttatccaagggttcagtgcaccactggaaaccttcatataacagaaagccagtgtttggggggcatttggtttcaacttgcttgtgtttgagcatttatatttataatagtgctaatctctaagggactcacatcgcattaagagctttatcttaggctgccacggaaactagcatgtaccaacatgactgagaactatgagaaattgggctgggcctacagaaaattaataagctccgattttcatttaaattatcttttccatgagattttgtttt

SEQ ID NO: 22061 - DNA, 1049 bp, Homo sapiens
cttgacattgatcccattgtacagtggagccaagattagatccaggggacctggtttcccagccccatcacctcagtcctattgcattaccctctggaaatgctcagtccagtaaaggagagagtgatgatgcaatgatgtgactgcttccagtgaagagtaaaagtaatgaactagaaacgggagaaacagattgacacccttgagttgtctttctggttagggcttttgggtttttgttctgtaatacagtccaatgtggtggccattcaagggagaagggccactcatcagccctcctgctccctcacccccatcttaattaaataagtctccttaggatctcacacacctgcatgtaacaaaacaggttttaaaaatctgtagtcaaggagcactgcttgtttctttctggcaacaatcccagtggaagtaaaattacactggactgcctgaaactctgagcccaaagcgttaatttttgaaaaacgtttgaggttcctgagttcccgtggtatgctactagaatattctgtagctttaacaactcccagccttcattctgcactgcaccccccgcacacccaatacctattccacatgtctggggataggtcagctcaccgtccaccctcgctgccccctaggctgaggttccctgatgagcacagttttccgggaaggatttcagcccctctgtgaaagtcttcagttatctcctctcttgtttccagaagtagcttctttactccaacttgaaatcttgctgtattccttagtgttttggaaacaaaatgtgcagtaggagaattctggctttgtggatattggatcactttgttccctggcacaacaatctctcctttgtattaaacatctgagaacagaagtcctaaataacatttttatattccttgttgatgtaagttctttatttggggacagcagtttggtacttgttcctctgtcaaattctgatgtactttccctttttcctatgatgaggacaccactgacccctagcctggaattttactttgggtagtggt

SEQ ID NO: 22062 - DNA, 1070 bp, Homo sapiens
ggaattgagtttcagaagaatttttgaattggtacagatcagtaatttacaaaatggaatggaatcactgaatgttctaaaatctgttcagctaaaatgggataataaatttagcttacatggaccctgcacattcaacttgtgctattatgatatatatatctatatatatttactgctatttattaagcattttctgtgaaccagggcctatattttgacatacatgatcttactttgtctaattacaaagattcagtgcctttcacagaagtcattagtagattttgggagggtcgtgttgatgactttttggtgttttgagtaagtaaaatgtgtaatggcatttgagatattgaatgcttgttaaagctgaccttgaaaataagattttcattccattgccgtgctttacaaatcaaactgccatttaggagggaaaaaagacaaataaatgaagtcaactttctttatttcttaaaccatgggttaaactgggtatttggacagatcgttttcaaggccactataggatacttcaggcaagtattttgaaacttgaaagcatttctgataaacttccagggaaaattctgatcttttggtccatgagagaaataactgctagttacaactctggattggaatcgcagtttgaagataatcagaactgcagcttaaacatcatcaaagagtgacctgtagcttagctttcttaattacatgtgtcaagaacttgtgataacagacctaattgaaatgacttattgagtcaggtaacatttatgcccttttaattaactataatttttaatttacctgatcagcattaagctcactttagccgacaaaaggctatgggctacagtcaaattgcaaatagaatacttagtaaatgtgatagtattagctcctactatggactaatattagtttggtcttgaccagaagaaatccttgtgcgtatttatgttgaaagatgaaataacttactgaaattgttaatgaagtattggataagctactttaaaaataacaaacccgactaccagcaacaacacaaataaaca

SEQ ID NO: 22063 - DNA, 1070 bp, Homo sapiens
attataaccctaagactgcaagcaatatatattttattctgcttatggtttgaatttattaattggacaaatattttgttatgtatctgggctgtccagcggtgcagagcacacacattctgttctcacagcttactgacatttacagagttttcattatattcatccttagagcagactagaagatttgtcttagaaactgtttgttagagacctaggtaccttgaaatagtcttgtaccgttggatgcactaaaagctctctctttatcttgcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacg

SEQ ID NO: 22064 - DNA, 1102 bp, Homo sapiens
tagaattttttagtctgtcagatttgtcatatctaatattggactcaacttttcttcttttagacgctttattgactccatattagtgagtagcctcctgaaaactgattgtataccttaatctgaggaacaggtttactagaaggatgtctggaaacaccggttctttaaaaagaaaatgagactttcctatgagtgtaaacgatatatactatgtcccatatacacctggctgctttctctcccattcctgcttcccagtatcattttcccaaaagttagctaacgagaaagtgccaccagccccgtgggcctgtcctcctgtcttccctgttgatatgttttttaattcagaatcaaaaatggtattttaagaaatgatgtgctgttttgtagaagaacaacatatgtgcctcatgctttttgacaacatttctgttaatgcggaaaaatgcacatttatgagggatgtctgtaaaccacagacccacactgaatttggaaaatctataggaccattggaatgagaggtgtcagcacatggtggacagccttgaagtggcctaaatgctgtcacattagactgaactgagcagaatgagaatagtgaattctgttgaaatatatacatgtgtgaagaactttgtcctgagtgcattaaaaggctcaggaagatggcacaagtgagactttatttttcctgcttatctcgggtcaaagcaaatgcatttggtgttttttgttgttgttgttgttttgtttgtttgtttgttttgagacggagttttgctcttgttgcccaggctggagtgcagtggcacgatcttggctcactgcaacctctgcctcctgggtttaagtgattctcctgcctcggccttctgagtagctgggattacaggtgctcacaaccacacctggctaattttttgtatttgtagtagaaatggggcttcaccatgttggccaggctggtctcgaactcctgatttcgggtaatccgcacgcctcagcctcttggccaaagtgctgggattacaggcgtgagctccgtgcccagcccattcagtgtttctaatgatgctaaatagctcttagtatt

SEQ ID NO: 22065 - DNA, 1075 bp, Homo sapiens
atcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacgatgctattttaatattttcaaataaataatctgaggatgtgtttcatactttagcatcaacgctgagttgtgccttgtagaattgcattgtctatacatgcaaaagactattaa

SEQ ID NO: 22066 - DNA, 1034 bp, Homo sapiens
tgcccagccatagttttttaaatgtatgtttgatagtttactgccagctgtaacccacctgttttattttaggcaggattataattgctcattagcaaaattgaggctcgaagagttgatgtattcactggttatattttggcaaaactaggatttaaagtagtatcacctttttgttacccaaccatgaaagtctgctacctagctggaggctgaggtgggcagatcacctgaggtcagaagatcgagaccagcctgaccaacatggtaaaaccccgtctctactaaaatacaaaaactagccaggcgtaatggcgggcacctataatctcagctacctgggaggctgaggcgggagaattgcttgaaaccaggaggcagaggttgcagtgagccgagatcgcaccactgccctccagcctgggcaacaagagtgagactctgtctcaaaaaaaataaaataaaagaaagtctgctacctataacactaacctgtgctttcctgtggaatcaagaattcagcagaaactcacaagtcatccaaactttgttaggttcacttttccaaagagcataaatattcaaagaaaatctcttccagctgcccattttttatggatataatttttgtacaatattctggtatcaagcagtgtacacagtagatgatcagaaagtaccttttaactgaactcttttcccctactagactccacgcagggcagaaatccttttgcctgtgcacatgttacggttttgatacatattggttgaatgaatgagcaaacaaatgtacttcctgttagaaggcttatgttatgcaagtctctttttgataaagtagtctctagaagaaacaaaatatatttaagacataccttagattgatttatttttaaaatattgttttgatccttagaggtttagagtgaaaatctttccagagtattcctcagtatagatgatacaattaagtgttaaaattctcatgacatttttctaaatctaaattttaggcaagagaacaccttgga

SEQ ID NO: 22067 - DNA, 1010 bp, Homo sapiens
tcttcagtcagtactagggagtatctgctggttctcaactcccgactcaaccttgacctagttttgtctgactccctcggctcctgactttgtggacctcaggaagggcacactcctaggctagtctcaggttgagctaccaccgtctccaaattagacttccacttgtcaagaaggaagtagagtccaggcataattggagcttcctggggtgattcgaggtctctgtactccttgctgtaaaatgcacaaatactccaccttaaagaatctcacggggcagggcacagtggctcatgcctgtaatcccagcacttttggaggccgaggcgggcggatcacctgaggtcaggagttccagaccagcctggccaacgtggtgaaaccccgtctctgctaaaaatacaaaaatgagccaggcgtggtggcaggtgcctgtaaccccagctactagggggcactgaagcaggagaactgcttgaacctcgggaggttgcagtgagttgagattgtgccactgcactccagcctgggcaacagagcgagactgtctcaaacaaacaaacaaaaaacaaagagtctcaccggagttccaaaatatccttcagtgactgaccatatactctagcaaaagttacttcatatatgcccggccacagctctcaatctcccatgagattcccagcaatcttccctggttttgagaaagtgtaaaaaaacacaaaaagcaaaaacaaaacacacttgcttcagctaattaatgctagagaaacaaacatagcatcataaaatgtaagcatttgaaagaaccatattgttgacgctgttccttatattttgcaggagaggatggtgaaatagaggtagtttgtgtgatttgcccagagtcccatgaagaattcacagaagaattgagactacagtcagtatggccacattcccagagaactgctttttctgccataccctgtggtaataatattgtcacaagacaattggacagtgtttca

SEQ ID NO: 22068 - DNA, 1033 bp, Homo sapiens
agatagctggattttactgatattctaagaatcattgtcttttatctggagtgtttatatccatgtgattattgatattcatggatttatttataattagcatgtactttctgtctatacctcttttaactattaatatattccttttcaacttctgttttgaattattttgagatgattaatgcctcccttccttttactagaagcaatgcatcctatttctattatttcagggcttattagagaaaaatgaaaagtgattattactcttttatacaaccactatttgtatatttattcatatgtttatgtttttctttctgtaccatcaaactgctcaagcctttattctgtgctcatttttttctgccttaagtgcatctttaatattttctcaatttttgtttgcctaaaatgtctttttatgacattcattcttgcaacgtaagttggctgtacatacagtcctaggtttacagcattttgaatatattattctacttaactctttttactacttctgttttctcaatgaaatagaaagcagaatcaatagatgagaaaaaagatggggaaagaagtcttggaggctggataagagaaaaggaggtataaaaatagtcatctagaagagtgaaagagtaaagggtatggagaggggaaattttgtaccattgctagacagctctaatggccttcttgaaagtaatggctgttcacgttctgtaagaaacctgctttaccccagctctgttcagctgcacacatgcaagtgtagaaaaaaatggaaagctagattagccagattgtgttttccccaggagtgagtgagatgacagaagaaaaaaaaaataagagataaggttgcatgcaagggactgattatagagggtaaagtggctatgagaatatgaggcttaggaaacactgtaaaagggattttaaatcgtggcatccaagattgttggaattgaggtactagctggtaagataaactaaataaactagtttttgtcattttcaaaattgcctc

SEQ ID NO: 22069 - DNA, 1050 bp, Homo sapiens
aatgttaatggagtgcttctaacatttcactactttccaaaacggacattatatgtatttcataggttcaccttatcaggacgtgatattcccttctattcttagttcgataagtgacatcttatcataaatccatgatgaaatttattgaatgtttttcctccatcttatgaatattctcctgtgtttcttgcctttatctgttaatgtaatgcattttgtgaaagtcttttcttatttgagattaaattcaacttggtttgctatgataaagtgagcctgggaatgattcattatatttgtatagtttgctgaattttctttgttaataattagtttaagatgtttacatcaacaatcgtaattgtgatttgcctgtaatcatcttttctcatattgtacttgcctaatcttgaagtcaacattatacttgtcacataaaataagttggaaatctttcagttttatgttctttagaagagtttgcataagatcgaaatgatttaatgctagaatgttccttagaacctatctgtaaagctgtctgaccattgtattttctttgtgggaagctttttaacaatgcgtaaaattgtattttgtgcttatagacttattctatttagctcatatagttattttgtaagtctgttttggcaagttgtggttttaagaatttgtctttttggtctcattctgttacataggctgcattgcatggcgtgaccttgaccgcctgggcacaagcaatctcccacctcaccctcccaaataactggaactactgctgcacaccaccgcacctggctagttttttttttttttttttttaattatttttgtagagatggagtcttactctattgcccagtctgtgtccttttctttttcacatttattgacccaagtttactcaaaatgcagattctgttgcctctctattcatcccctacatattttttctatccttaatattgagcatgtgtgctttatttccttttattacttaattggagtttcccttttataatgtgtctttttgaagattaa

SEQ ID NO: 22070 - DNA, 1884 bp, Homo sapiens
ccatggccagtatacaggaagcagagcaagctgctgaatttaaaaaacgatggactcaatttgttaatgttacttttcagatggaacccacaatcacaagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttcccctttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacagaacttgcctagagatgaaattaaactaattgaaaacatctgctggactctgatggatcgcctaggatatccaaagtttatggactaaatgctgcaggtcagcagaaatttgcactaataatacttaccaacccactttgtggatatgaatcagaagagtttgtttattctttagtgtgtgtgtgtgtgtgcacgcgtgtatgtgttcagtgttgtttgcacagagagattgttttaaaaaatggcaccatatttggcctagc

SEQ ID NO: 22071 - DNA, 1034 bp, Homo sapiens
gctcagtgtttcagatacattctcccacgcttaaggaagacaggaatatgatatgttaagtttctgtaggtattgtaaaggccccatttctctaacctgcagtagtatttagaacctgcctgaaacattcagacaaagcaaaggctttactttgaatccttatttaaatatttaattgttgctaatgtttagaagcattggaatagggacttgggagtatatttcctttcttacatatataatttcagcttttattttagattcagagtctacatgtgcaggtttgttacatgggtgtattggatgatgctgaggtttggggtacaaatgatcccgtcacccaggtaataagcatagtacccaacaggtagtttttttagcccttgtcctcctccccatctccctagtgtctgttattcccatctttatgtccgtatgtacccaatgtttaccgcccacttataaatgagaacttgcgatatttgggatagtttattttcgaatgaaattcaaattgatcactgtatgcaatctcgtagaaaatttgcttttagcatgcagtggacattgtggcccagtaatcaatttctagttttatgtttattttcctaatttataaatttaaatcaataaattctttgagatttgcattgcatcacttattttatgggtttgataacttgaaaatgttttgtttagcaatgcaagaaaaagcatacctttgaagaggtcattaaaatccattcttcaaccagatgtattggtaggcttttatagacatttgctttacatcaccaccttttttatgcaattgtaataattttgaacaattacttgagaattacatttctaattaggatgtaatatttctcttagatattatattttctatctgcttagcagaggaattattttatattggaaaaaagctaaggtactatgattttatatgtgtttgtgttagttgtacctttgagaaagagttgtaaactaggaagactatcataaagagaggagagcaaagaaattgtaat

SEQ ID NO: 22072 - DNA, 1035 bp, Homo sapiens
ctaattcaataaaatttaaagttcaatttcttgttctcacgaactgtgtttcagtgctcggtgggctcctgtggcttgtggttaccatgttggaggccagatagggaacacccattcattcagaaatattctagaatgtgtttttcttactgaattctatgtgacagaaaggaacctaggactagatgagagcagtagagttttaattgctgaaataattcaaatgagtagaagacttttcaataaaaaggaacaatttgttttattataagtagcattttaattgttttgacagtcataagactacatttctgatttttattgtctttaaataaatgtgagagctgaattttatttgtttctatagataataactacacacttatgctgtcatataaaaggtactatctacatacttgacattttcattttatttacaaagtaatctgtgaggtaggtaataaggcagatagattaataccccaggattacaaaggatatagctaagaatgttagataaggagacaggtgtgtaattaaatagcaggtttatcatatgcttattcagccatccattaattggatgtttattgaatgtctgtattagacgttgggcttataaaagaacttcagagaaacttgtgtatttgaaaatatgagaaggaaaataatttgtagccacacctagtctattcacctgctctttgcttgcagtactcctcatataataagtacttaatgtatgtgatcttatatttgatcattacaacattcccttaaaatcactattcttaccattttacagataaagaaacaggattaaagagattttttttccacgataaaataatcaatgatatcaaaattcagtcttcaaatctcatgttcttattccactatgtgtttcttagcaattcagagaggcactttgtttcttcctttaaaaaaaaaaaaacactgatcatatctgtttaaatataaacatatttaaatataaacagatatcaggtttttgagcctgcctaggaaagcatc

SEQ ID NO: 22073 - DNA, 1028 bp, Homo sapiens
ggattatctgtctaatactgtcaatggggtgttgaagtctcccacgttaccctatgggagtctaaatctctttgaagatctcttaagaacttgctttatgaatctggatgtttctgtgtttagtgcatatatatttaggatagctaggttgccttgttgaattgagtcctttactatttgtaatgcccttctttgtcttttttatctttgttggtttaaagtctattttgtctgaaattagaattgcaatccctgcttttttctgtttttcattgcttggtagcctttttccatccctttattttgagcctatgtgtgtcattgcatgagatgggtgagtgcctgcaggcaaggcggcatgaaggaggctgcagtgggggaagaatgctggtgcgtgtccactggggtcactctgctagagcactctgctagtcaggcagtctgccagtgcaggagctaccgtatgggcccgtacctgggagcttcactccaagcaggtgtggctaggctcgggctctgggagaagccagcagaccaaagggtggaccagattggccccatctcatgggcaagaccaccctgcagagttgaggtcccacagttcccctagggataaagtctcctatgggagcaagtctagcctaaggggatgggcatccttggccatgctccgctatagacactcccataccaaactctctgggctctgccccagctggagttctgcttccactgcttccctaagcagctttccctgacaactcaaatgtccatggtggtccaggggttccttcctaccaggattccagcggcctgtggggagagcgaattttgttccttgccttttcaacttccccctctgcaggagttgttgggggccaggaacaagttgtggtgcttggtagccccgagcagggtccccagcttcctcccccttcagccccagctctgtgttttccctccatctgctctcgatgccctccctctgaagatctgctaggagtgtgccagtcttcctggtgtcccag

SEQ ID NO: 22074 - DNA, 1049 bp, Homo sapiens
gcagtcgctacctgcttacctgtgttcactcaaggccctaggacttcataatcagtaggtgacaaagccagccaggtttctgtccttcccttcagagcagtaagttcccccagaccctgagcaggtccagagatgctatctgtgagccagggattagagtcaaaaaccttagaattttacctgatgttctattctaatgtgactaacctggcactcaaaccacaatactgggtcctttctgctcttctctcccctttccacaggaaaaggagactctccttttggccaccaataccacggtcccatgggagttctaccacgctgctgccaatgttcacttagagcccaagggcacttctgtcattctgtgacgaatgttgccagacctggggctcacccttcaggacaatcagttcccctctggcccagagatggtccagaaatactgtccaagaggctcggcctggattcagggagcccaagagcctacttgttgctctacccactgtggctgagctgatacctaagatgcaagacaaagtcccctttactttcccctctgcttttctcaaacaaaaggagtcttttgttgtagccaccacagctgcgaatgtgctgggtcatacctaaagtcagcacgtcccagagcccaaggcctgtggtgtactatctggatattgctgctggttattcagggcctgagggctctttagtcagcaagtaatgaatcctgccaggactggtttcttcccttcaaggcagtgggttcccttggcccacattttgtctattttgtcatccaggaatgggcctggaatggaggtctcacaactctgcccagtgccctgttctattgtgactgagctggtatctaagatgcaagacaaagtcttgtttactctcttcctcaagtagaaggaaggagtcacttttgttgctgcgagccgcactgcctgggattgagggagaaatggtgtaaggcctcccttagctgccctggctgttgtctccctgtgtcacatgccaccatagtccagtggctctaagcc

SEQ ID NO: 22075 - DNA, 1025 bp, Homo sapiens
atttttcaagtttataaaatgtaaaacaacacatgtaattttgattaaacaaaatcagttctcacaacaggaaattaataatgactgtttcagtgtaaattcctttcagtttggtctgttctttccactctgtattaagtttgtgaatcagttcatgaccactcatgtgctgtctgaactgctatgaaatatttgtttgtacattgtgccaacactgcatactaagtcttgcttttaagttctggttggcaccagctcctttaacagttgcaacacaatcacacaagttggtaatctagatgatccagagtatagttactttaaaatcaacttgatttcctttttgttgaattttgaagaaattttcaaacattcacatctgaaattattcctttagatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcaggtacgtcatttcttggtttttcaaaaactttatttagcgtttaaataaattgactttcagtcatggtcttgttaaaaactgtctcagtcatttaaattaagaaatagtaatgcttattatgactgtttaaatgatacaaaagtttataaagttaaattaactatctcctccttagccccacccgcttatgttgaccagtttcttcagtgaatatgatgtaaagatttgaagtgaaatattactaatctaaatctaacagttgatcaaaacagtgtttcatatcatgaccaaaatggatatatttcagaaatgcagttatggttcaaaatttattgtaattttaaagatatatctacgtctctgaaaatatattctaagtgacatttgatttctagaaatggaccacagat

SEQ ID NO: 22076 - DNA, 1068 bp, Homo sapiens
tttttctattttatatgataaatatgtttttcttttgttgagaatatattaaacatcttttgaatttagaacatctctactaatgcagtaaaggcccacacctactagttaggtaatatagctcttactagaacttgcttagcaaccaaaccctttataggaaacaatatatagttcaattagtaaatacattttttacaaatttcattttttagagtgcaaacccactgttagacctcttggttctgacagagtcacaggcacgagaagaaacagatgatatccggactgctgtcaggcaacaacttcagaaagaactgattgctctttttgataccttgctgctcaatttcatggaagttactgacaggtaccatttgtaatattgcaggtttaggtgcatttatatagaacccaagttttctttgattttcaaagttttactttgtacttctttcaaattaagaaatacttctttcaaatacttaaataataatcagttatagtgttctgtttgtttttgtttcagtttaatctgttacagcctgattgtacctgcttggtctctttcactacacacatgcactcacatatgcacacacacagttttgttctctagggtttaattcctggttctctcttaattatctacaaatctacttgagcagtcatacctatgcctatgactttatgattatctttacactgatgactttcaaatacatatctctagttatgaattctgttttttaaaaataaaaatattaagatgaaagtcactattttaaccattttaaaatgtacatttgaatggttttagtatatccgcaatgtttgcaactgtcaccactacctaattccagaactttatcatcaccccaagagaagccttgtatccatgaaaaagtctctccctattcacacattcctctgggccctggcagccactagtcttctttctatgtctgtggatttgcctattctggatatatcacataaatgaaatcaaacaataatgtgacctttagcgtctagcttcttcacttagcatcatgtttccaagctcct

SEQ ID NO: 22077 - DNA, 1033 bp, Homo sapiens
tttttctgcctccatctgagaatttgtttttttaagagttttttattatttaatgtagtgcacttatattagcaatgatttctgtcaggttttttttttttttaatctaaaaattctttctgttttaaaaaatgttatcactaggtatagaattctaggttggcagttggagtccatttttttgtaggaacattggctgtcagttttattgttgcttctttgaaggaactgtgttccccattctcttaggagttccttcagctatatcccacagcactttgcttgcttgcttatttatttgggggagtttattttatttttatgggtatataatagtacatatttatggagtacatgtgatattttgatataagcatacaatgtataatgatcaaatcagagtaattaggatgtccattacctctaacatttattgattctctgtgttaggaacatttcagatctgctcttctagttattttgaaatatacaacaaattactgttaactatttttaccctattgtgctactgaacactagatcttattccttctatctaaatttttatgtacccattagccatcccttcttaattccccccttccccaccatcctttacagcctgtggtaatcatcattctactctttatctccatgagatcatttttttttttttttagctcccacatataaaggagaacatgtgatgtttgtttttctgtgcctggattatttcagttaacgtaatgacttccagttccatccatgttgtttcaagtgacaggatttcattcttttttacatctgaatgatactccattgtgtatttataccacattttaaaaaatccattcatctattgatggacacttaggtagattccatatcttggttattgtgaatagtgctacaataaacatgggagtgcatatatctctttgacataccaatttcctttcttttggatatatacccagcagtgggattgttggatcatatgtaggttctgtttttagttttttgaggaactcca

SEQ ID NO: 22078 - DNA, 1052 bp, Homo sapiens
ttattttattattaatatttagctaaatattgacattagaaaatattttctatgattttaattctttagagtttgttgaattttactttatggcccagcatatggtcagctttttaaaatgttccatgtgtacttgaaaataataatgtatatgtagtagttgttggatatactgttctataagtctcaaaatatatcaggtttattgatagtgttcagatcttccctgtgtctactttattatatgtgtgtgaagttctttcaggtagcagagaggcatgttaaaatctccactatgacattgtcattctggctgacaatgtattttgaggccatgtaatttagtttgtaaacatgctggtgggttgtctctatcattatgaaattatttctttatctctagcagtgcttcatcatatagaattcactcgatctcttatgactgtagcttccccagcttttatttggttagtggttagcatgatatgtatttttccatccttgtagttttagctgttctgtgtccttaaatgtactttttttttttaagaagtatatagttgagtttttttgtccaatctgacattatttacagttttaatggaatattttaatgcattttacatttactataattactaatatttttggatacagattattagcttgctattttctatttgtccaatgtggtttttttctttctttttcctctctggcttttcttgattaatttttaaaattagtccatgttttccagctgttaacttgtagttacatatacattaagtattttatttatttatttatttgtagcgattgggatcttgctttgttgcccaggctagtcttgaactcctggcttcaagcaattctcccacctcagcctcccaaaagtgttgggattacaggcatgagtcactgtgcccagctaagtattcttctatatacattatttctatatattttatacagatgattattcttttataatatagagattataatttacttccttgactgtgaactagtatttttaccacatcccagac

SEQ ID NO: 22079 - DNA, 1031 bp, Homo sapiens
ctttatttctgtttgcctgtgatgattcaaaggagtagtctttgagctctgagatttttttcctcagttatgttattaatgcttccaattgcattatgaaattcctatcatgaaatttttgtttccagaagttcagttttgttcttacttaaaatgtttgtgtcagatccaatcatggatcaaaccaccattttactggtttccatgggtggggcttcagccttcttctatatcttgtcgagcttccttgccttccagcttctgaattctgtcattttagccatttcagtttggttaagaacgattgctggggagctagtgtggttatttgaaaataagaagacattctggcttttagaattgccagaattcttacactgtttttttcttacctgtgtgggcagatgttcctttaatctttgaagttgctgtactttggatggggccttttgcttttatattatttgatgccattgaggattttactgtggtataagttgggattagtcaattggcttggtttctgtgtgctttcagggccagagctcagctcagcacccctgggctgtgtgctctaaccctgggggtgcactgaacaggccagtggctttgatttctggtcccttgaggtcaagcatctgctgcactggaggagccgagatgttcccagactgctggcaacaactttccgatggtgactgcccgagaaagtgctctgggggggcgtggggcggtgctttgggagagtgcacttgtggtgggggtaaccatgggcaagtgcgcactggcaggggaggctgcaggcaagtgcacaccagtaggtattggctgtgggtgggtgtgtgcttgcaaaagcgctctgacaggaaggcagaggctgttggcaaaagacctatggggtggctgttggggagcatttcggcagggcagctgaggctgtgttgcaagctagtgagacagacaggaccctttgagaggctggcagacagggtggcattcagatcaggttggcccagtcttgtgggaaagat

SEQ ID NO: 22080 - DNA, 1034 bp, Homo sapiens
tgccacgagtgaaagctgaaacttaccactgctgtctggaaatcacgaaggtgaggttttgttttttcgtatgttttgtttttgagaacaaatagtagactctcttgttataccttcaaacttaatttacttgaccttttgtatgagatataagaactatatcccataaaagtagatgataattactagtcaattctggaaaatttgtactattaaattctcttaacttagtaagtccagcaattgaattgctttatttgaagttttattaagaattacatttatgttgtattaatgatggaaaaattataaggaaaattgatttccaggtattcaaaagtgatttctatgcccaggaaaccttttaggttgttgtggcctagattttatggttttaattctgttttttttaatgttattttttatttttcttttcttttgaaatatttatttttctgtcttcttaaatgataaaatatttcagcatagaatattaaatatttcaatattgaaaagaacactgtacataggacaatatttaaaagtatatatattactgcgtactcttgaaagtgtccttttgtatttaacactcttgtaagtactatttggttataataagtgtttacattttgccatttttacttctgattcatttttattcaaagaaaaatactagttatagaggaagcttctttgctttctcttctcccaccagcatagcctagccactcttacacagctggtgtatattcttcccatccagttgttgtatattatttataaagctgtatctttatatataaatattatctttaaataatttaaagaattttatatatagcatgattagtatatatagcaggatttgagatttgcctagttcattcaccttaactgctattaagtttgaatatacttccttttattgaatgataaatatttaggttcagtctcctttttattgaagtaagtttttcagtattttcagtgacagtctgtgactgtgtgcatacgtttgaaaatgtcatgat

SEQ ID NO: 22081 - DNA, 1050 bp, Homo sapiens
aaaggactaaatagttatttattgattgaataagaattaaaagtttataaatataaaatactagaaagctgatgtggaatggctgctgggtgacattgaataattttctgataccttattttatttctcctttgtctcacctgcatatttcaacccagtttattatgattaaacatgaaagagaggcctagttatttggcattgagaggaaaaaaaacaaaagagagagatgggcacatgccactgtcaatcctgctttctttccacctctgggctgagcgtaggctattctattatctcttttgttttttatttatttttatttattatttatttatttttgagacggagtctcactctgtcgcccaggctggagtgcagtggcacgatctcaactcactgcaacttctgcctcccgggttcaagcagttctccctgcctcagcttcctgagtagctgggattacaggtggctgacaccatgcctggctaatttttgtattttttagtagagacagagttttgccttgttggccaggctgatctcaaactcctgacctcaggtgatccgcctgccttggcctcccagagtgctggggttataggcgtgagccaccgcgcccggccttgtctcatcttttggccattccagcttaagatagatcgtagttagagtaacagcctctcttaggtcatcactcatctaccactgggcccccagttttggtggcttgcatattcctctgaggacatcgggttgcattgggttacaaagcaggaggtaagctgtggcagctctgggcctggcaggactggtgccacagtgccctcctgctcttgtccctcagaagcaggcctgtccctggtccttccctgtaccccaaggtcatcatgtcagaattggtggcttatgtactcttcagagattagaggaagaattagcacacctgctttattttatccaatgagacaagtgtagtaatggtagaagttgaaatactggtcagggcatagtgaccaaaatttggttaccagtacgttttagaccaaa

SEQ ID NO: 22082 - DNA, 1032 bp, Homo sapiens
gccagtcccatgaaacctggggttttggctgcagctctctgctctctgctgtggtgcccttgaggtgggagttgagactcaacatgtagggcagggcttagacactggaccaagttgaggactagctaaaactggaatggggttgaagcagctttccataagacataaccaccagtgtgccatgtcagtttaccattgccacggcaatacccgggagttactgcctttttctatggcaatgacctgacaaccccaaagttactgccttttacctggaaatttctccataaaccacctcttagtccacatgtaattaaaagtaggtataaatatgactgagcagtgacgtgacatgcagcccgcggtctgtacggacgcgccctcgcttcttcctctttctcgactccatcttcgcagtagtggcagctgggaccgcggttcagtcaccaatatgcagctctttgtccgcgcccaggagctacacacccttgaggtgactggccaggaaatggtcgcccagatcaaggctcatgtagcctcactggagggcattgccccggaagatcaagtcgtgctcctggcaggtgcaccgctggaggatgaggccactctgggccagtgcggcgtggaggccttgactgccctggaagtagcaggccgcatgcttggaggtaaagtccatggttccctggcccgtgctggaaaagtgagaggtcagactcctaaggtggccaaacaggagaagaagaagaagaagaggaagaagaagacaggtcaggctacgcggcggatgcagtacaaccggcgctttgtcaatgtcgtgcccacctttagcaagaagaagggacccaatgccaactcttaagtcctttgtaattctagctttctctaataaaaaaaaagccacttagttcagtcaaaaaaaaataataataaaataaataaataagactgcagaactgccttgaactgctaacctctgtctctgcaggaacagtcacgaagctgtcacactgctgcttcagttaagct

SEQ ID NO: 22083 - DNA, 1056 bp, Homo sapiens
ataagcacttccacttaggcactccccagagtccagcacagactggaggcagaacaaggaaggactggaggcggccggtgatgacctcagaaaattaggggcagcagggcaggtaggagccagggtggggagaatgggagtagaaagcttttggaaagctgggctgagctgggctggggacaggaaggctggacctcttgtgcatgtcagcttcttggggcctttgtagaccatacatgagatctgaggagccctggggtctctggctgccaggtgggacctttgctttgaccagcaaatcttaaaaagatgtggctatcatttaataatgggactggtgggtgacagtataggcagtttgtcacttgcctaacttcagtgagtttattttcataactttcccagtcctgtggaggcaaatatcttctcactgctgggttccacaagcacttcattcagatctcatctctaacactttctgcagtgtctccctggagactgcgggctccttgaaggcaggacccatctcacctcactgtcatctctgtattcccgggactttactgtggggttggagcatagtacctgctgataagtgttagattaaggtatgcttttcactttcattttaaaatggaacaaaagtccacacccagtgcctcacaagtgtatactattgcaggatttcaggacaggcactccagttttttccagttgtaaatgagaccctagagagctggtgctggttcctttcagtcccacaccacagcctcaggcaaatcacgggccttcactgcctgaggctgctcacctggaaaaccaggtgaaccgatctgtgcaactgggaaggcgaaagaagatagatagcacaggtctcgggtgtccacctgatggtgcaaacaaatacatatttgattcttcagaccagtttgaatgttctgttgccagcaaacccatgtgcttccttagcactgcccagaataaacccaagtgctggatttttcaaaagtctcagtagtgcctaatacttgggcattggaattggagtctctggac

SEQ ID NO: 22084 - DNA, 1057 bp, Homo sapiens
atgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaactgataaaaaagaccaagcactatcaactttggacagtaatttcctaggtgttaaacaagttttctgaatacaatctggatgcaaaacggcctgatttgatgaattcataattttcttctgtatactttcattttattaaatattttattacttggttaaacacaagaattatctatgtaaacttcatgggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagcgggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtcttgaaacaggcatgcaatgtgaaataaataagcacatcatggagaatggggtgtctacctcctcaagcatttatccattgagttgcaa

SEQ ID NO: 22085 - DNA, 1111 bp, Homo sapiens
caactggcagtgggtcggctcctgtccccccacttccagagcaaaccctaccgtcacttccacccccacgggcacctttcctggagtttgctttacagcctaaggcagaggcactgagacgggctccagctggctctgccctgggctgctgctgtgaagtccagaagcaagctcccagggaagtgggccctttttaaaacgccaggccttgagaattatgtaaatttaaaggaaagatggcaggttctttcccttctctaaaaatagaatgtaggaaaaaaaaaatagaacgtaggcatcttgatattaaattccaaataagaaaccagcaaaactcatcttcccccttctcatgattgtgtatcttccacgggtatggaattgtgtggggtgttattgaggctgtgtggtgtgctggcgtctgaatgcagcttgacataacagaaagcagttgctccctgcgttcttatttctacaatatacagagacttttctgtcctgtagatacatgggggatgatcataagtgagcttttataagcgcagagtattacctatatcaccgtgaaagtgtatcgcatacaggacagttttggcttattaagttaaattaaaagtgaattccttttaaatgacctgcttaacggctttcctcctccaccagttactattaccttttcattctattacaggtggaaatgacatttttagggtcttccattatgtgtctaagccaccttctgacattcttagtagatggcttttttcctcctatgtatcaggatatttttgttaggaggtatactgagatgaaaaaagctgggaaaaatactggcctcgcaattaaattgactccggataccaagatgaaaataatcatctggtattaatcaagttatgtctctgcttcttgttgaggaaaaatatagtaacgatttgctttccttttcatttgaaaaggactgtgaaatgttgaatgtttcataaaaatcgctctacccaatttttgttcaattaatcaaaatgcgtattttcacactggatgtagttacatcagaaagaaaatttgcgacagccactctaacagtgcttcaaacaacccctgcaggaac

SEQ ID NO: 22086 - DNA, 1028 bp, Homo sapiens
gggcagtttccatggagtggtggatagaattcagattgcagcgtgcacctatcacagcaccagacatcataggatgtctaccgctcagctgcccttgcacctcagggaagcccacagaagtcaggccctttgctggacacctgctgggtttgtgattaaccaaaatagcaattccctttctgcaatgtctgatggagaaccagaatttaaatttgcactattaatagaaagaatttagcagccactgtaaatcagttatgcaattttaaaatggcttcttggaagaaaattgtcattggggatttccagactatttcttttataatagtactactttaggaaatgatgaagaagcttgttaaatgtaagattgcagaggagaaaaaatagtgaactcttcagttgtgatgaacttacaatgtcactgaaatattttcttagaaacataattgcaaggcaaataagtgattataatataagatgtctggcatagatagggctgtttattacctttagatacattctggattatataaccatgagttgatttgttgaaaatgcttcttgaggacagggccatgtttatgtgcctaataccttacactatgtctggcattttgatgaaggatggagggaagcgaggtgaaaaaggagggagggaaagaaaaggtagcagaaggaattgcaacggagtctccaggatgtttgaagttcattttaatgtcctatactgcatcacttccagctgaagacatggaaacaacaggcaaatgagagcacgtcagtgacctttgagggattgggaaaactgaggaagtgccagaaagtagacagatgtgttgctcttgttttaaaagtaataagatggtggattcacacgctatataccggtttgtttgagcagtcttctggaagacattattaaagaaatggtctgagagcacctggaaggaaaagcaattcaccaagaacaatgccagtgtgccctgccatgtcttcatctcttagcccaaagctcatgtagaatt

SEQ ID NO: 22087 - DNA, 1051 bp, Homo sapiens
cacctccacgccaaccccaccacggccctgccaccaccaccacctcgccaccgcagggacactccggacgcaggcccggccaggagagttcgtctgcatcgagtgcggaaagagcttccaccagcccggccacctcagggcccacatgcgggcacactcaggtatcgccctcccgcccagctatccccaaggggagcagaggaagaggggtctcttctgtcagtggcttgaccatccgcagcgagggagatactgagatttcagcccctaccaggcggcggggggcctgccatctgcctccgggatcgtatacaggccgcccccactccacacctgaaatgggtttttttggtgtccatgtgccatgtggtttaatttgagataagcctgtttgcaaatgttccattttaattagagagtaactgactcctcagaaatgaatatgctaatgaatggcattgccaccagcacacatttaatcaaagcacccttttagcacagcgtaggcttggttttgtgtcctcactggcactgactggactctgtgggatacacccgggcccctttggaccatgcaggatgtactgcaaaatccctcagcccttatgtagagagcttgcacccgatcgggctggaaactgtcaggacagcgcaggggcattagagagacagggagacggggttctctatcaggagtgtgaaggatgcacacagaagctggtctgatgcaagatgacacaggccgagtggtaagtaatgcaagaagagggtcccttacacacacaccgataattaatgttgtcagtgattgctttcttcagcagcgaggtctgaattaaaaagggcagtggccccaggcagccattatcacagtctcttactgtaagtgttacggtaaattggtattttccagccacaggctaggcgctggtgtctttttttgtggaagtacttaatctgtaatggactcatttaatgtgcacgtccggaagctcacacgctgatctgttaacaaaccccttgttcccacagtggtgtttgagtccgatgg

SEQ ID NO: 22088 - DNA, 1006 bp, Homo sapiens
aattctgctgcctcagcctctccagtggctgggactgcaggcatgtaccactacacttggctaatttttgtatttttagtagaaatggggtttcaccaggttggccaggctgctcttgaactcctgacctcaggtgatctgcccacctcggcctcccaaagtgctgagattacaggcgtgagccaccgcatccagtgtaaactactatttttttgtattagaacccagagctgatccattgtggtgagacatttaagaatgtgtggtgtctgtgtgtgcacacacgtatcacttgatttgaaaaatagattaaaagccagattctctatgtgtttaatatcacatagttggtgcgaacatgattggcccattcttctcatgacttatgtcattttaagaaatttaagaccaaattttagaatttattggtttatctttcacataattattcttaattgagcctttaaacaactacagtgctaatgaagtaggtaaccttcttcgggtgaagaaagttaaagaaaacctgaaaagagaattttgatcgacagtagtatgtagattcaaatagcagtttgtggtttactgtgtaactcttgaaaatcaccagagacacgaaaactgtgtacattcagcattgcctgtattgccagctggtatacatagtgacagagggcatttgttctgtgatcagctaaattgtaagacattatattacattttagggatgaaaacccttaaaataaactgaaacccagctgaggaaaataacacgtggaactggtatcccaactttaaataagattatttttcagtgaaatcgtacttcaggatatgctagtatgctgttcaagaaagtaggaaaatggcttgtttcagaataagtaggcttttttaaacaactggattgtaaacaattggtaatgctgaaagccaaacaacaatgaaggatttcactaatttaatgtaaatacataggaatctatatatgtacatgttagtcttt

SEQ ID NO: 22089 - DNA, 1035 bp, Homo sapiens
gacttcctggtatgacttaggctcagtcagttcttaaaggaatctgtggcttgccatttgatttgcatcattcttagtctgcattttcatcatgggcacactgaattatttcataagtttagactttcttttaaatgcttgaagcatttaagttttatttgataagtgtttttgtgtgtgtgtgtgtgtgtcctcgtctctggcacaagttcgtaatttttcatttgtgtgtatgtggtttttctttttgtggttcttagataattttctgtgtgctggacctaatctgaggctagtttttcatgagggatttgtcggctattgataggatccagtatttgcatatataatttgcataagcctttgcatattaaaatggattgccattttaggtctgtattttactagaattttaaaaagctagggatatttgtctctggattaaaggttagaaagtaagactccagttactgagattttacctgattctgtatgcatggttcacatagcgatatccatttacaggaggccttgtctcctgctttctttacaaaggaagccattgatttgaaagaagtattttcacagattagtaagacatttgggcgaactgttagctgccaaatatgttcctgtatagatgtgccaaatctgagtgttactcatgttctttctcttaactccagaatagttacgttcagcactatgaataaattctcttccaaatttaatacaattactgttttatttaataacctacttggttactgaaatgtatcacttaaaatgataattccacggtgccatttgttgagctggccatcctatagaaaacttacatacatgcttgaatctcatatctgaaacctgatggagaatggcagctgccttcaaagtcatgaaattaggttgttggtacctatgataatccagtgattgattccaatatagacattattgggatagtttgttcattggactggacaattagagaacatttttgatattgaaatgatggccaggtttccagtctga

SEQ ID NO: 22090 - DNA, 1117 bp, Homo sapiens
caaagaataagaccactctcctatattaccagcttaacacaagtaacagtagttctcaaatatcctgtaatatccagtccatattgaggtttaatttctacgaagagttctggagctacaatatgtttgaatgtgctcgttgtagatgattataggtgttggtcaaagactttttaattgtgttaaataacctgttgttgtataaaccataagggcccagtgaatatagaggtgttcctatttagctattttgaatccagctttctagctgctattttgtccttttgcatttattaaaccatgtattgtcattgccagtgaccaagtacctttgcactgatatttcattcacttattgaacaattacttattaatcccgtctaagatggattgaagatttacagtgtagtaaacattgtggcttgtatgcattaatttaaattttactggagtatgataaaatagatatcattgctatcatttacattttaaagatgaagaaatggactgaggaatagagaggctaagacacttgctcagggtcacacagctgacctcaggtagtggcagaactgggttttaatcccaggtagtctggctgcctctcacaacttgttgggtcaccagactcttatcattggctgaaggaggtcaggaaggctgtactgtacctgggtggtggttggtcagcctcatgacaggtggggcagggacgcaggcctgagggccagaggagagcatgagcatgggtacttgggaggctgttgggccggagtagggctcagggctctagacaccggggtccagggcagctatggggttcagaccctgagaagccaaggtgaagagtttggcttcatcttgcagacttggggagcctctgaagggctgggagactggtggagaccggccccatctgtgctctggaacgatggctttggcttgacttgggcacatggattcaagagtgagttgggaggtgcagccgacaggatgtggggttattactgggcactgctgagatggggagggaggagccagggaggacctggtgttttgtgcttgggtcatgaaaagtacttagaattcaagccacaccagtgtggttcccaggtga

SEQ ID NO: 22091 - DNA, 1085 bp, Homo sapiens
tgcgtgttgtcttactggcaggctgcataacccttctcctgtgctgtcagcttaatttagcctgatgacaaatctgaagcctgtggtcttccctttctgtggcttccactgttgcagataaaacaggtggtacctgtgcgtgatttacccagcctcacagcacaatataacagatgcatatttaatgcagcaaagtgattttggaaaacaacaaaactcagagtaaacgtaaaacaagaaattgaaagcagtattatatgtttgcatgaatagcttggaaaaaggattttaagtgtaaagctgagaaagtatttgtgtttaggatggagccactggcccccccccaccccccagcccccatgtgaatcagtgagttttgccttctgagttacgttacccagataaagatgcagcagcagagtctcgacctgcgccttcattctgaccgtcggggttgactgtgtggcccagtgaggatgagccacacacacattcccgggaggaagcctgggctgtggatggcaggctaaagttacaaagcacattgagggcgtcctgatgctctggacttgggtggactccttagcttgaagctgtgggtcccagaaggctggccgggataggctaatccctgagccgacttttaacacactagtttatgtgacttaacaccagctaagtggatgacagtctccttagttattgatggataaaatggaagcaagattttggggcctttagttgagcaaggtctccagcgtgcttatctctcttgcctccaattcttagtcatccagattttgttttgcagcaaggtccctgaataggcactactgctcatcgccccagagttagcaaggcagaaaaaggttctgcttgagcagtttaagctgccaaagaagtcaggccaggagcgtgagctaaagtgagcatctattgtttcacgttcgccagggctcctgagaagaggggcgagcactgatgctgtctttatctggagtgacaaaggaaggagtgagtttggtggcatctcattattgatgggtcctaccatcctccttgagttacagacgatacctgactgt

SEQ ID NO: 22092 - DNA, 1029 bp, Homo sapiens
cagggcatatgcatagcaggtgttccctggtgacattttgataggctggattgacaactaaatgcagattgttccgctgctacagttaggcggcgtcctggttaccttcgctgctgcgtttgtgctgtgactgttgaatgcttctcctgctcctggctgcccctcacagatgtgggaagtcctattagaaaccacactgtgtgggattttcccagcagccccacttggggtgatttaattcattctgaaaatacctacggtagccccaaaacgtccttgggcattgttttaatttttcttaaagagaagcagtggcaaatggttcttaaaaacataattagatgaatactaaacttttcctcatttcagaatctgagagaggccgagtggagttcggtccttctctgaacacttttagctgagagtaccagcatccaactgggagcgttgtcattgcatttccacattcccaggaaagcccaggtaggtgcagttggatcaccttcctgtcaatccgtctgacttctgtttcacaaacctggaatttcaatcaagcttaaaacaacagttattactttatggtgtagggtcgcttttcttggcatagctagaaaaatgtaaaatgatggtaaatagaagaaaaataattaaaccagagcacataactgggaagccgcctctgtgggctactttgatgaggacatagggatcacagtgtgaatgaggttttctgctgaaaaacagccagtgtaagctgatcgtagaacttggtgctcctggggtggggggtccattcctttttatgatctggaaaactattggctcgaggatattagcttgcatatgagtaagacccactttcttttcttgcccaagtttgcacagcttattacagttgggcgatgtttttgggcagacagctctcttctcttctgggaggtgccggagcagagctgcctaacgcagtgatggaattgtgtggtgcaggcttcatctgcgtccgcacgggggcaggtttcggttgttacc

SEQ ID NO: 22093 - DNA, 1036 bp, Homo sapiens
tttttccccggacagaacgaatctcgccttttgtcccatgtgtctcaagactgctgtccaactcagttttgtcacattttcaaggctaaggcagagttaaattgcttcctcattgtggggctgggtcccgttcttggaggtgacacttcaggttacctgttactcctgcttatggatctgatgttcagagcagcaagtttattactttcacggagggtcagttttcgtgcttgctatattagtcactgaaatgcttcttttgataggtcagatgatattgaaacaaactagaattctgtttcctgtctgacttgtggaattgcagtatcagtgttcagaaaacttaccagacttttgaacgtaagatcgactagcattcaagtagaattacaaagtccaaacgatatgactcagctgggataaaaagtgctgttttatcttttttctgttccagtgactcagcaaaaacagtgctttggacatacggaaatgtaggcaaacgaatatttctgcataaagggaaaatgtagacctttacttttaggacgactgtttgttagtggaccagcccaaaattcttttcagagttttgcaaatccacctgagtctccacaagtgcaatttcatctgtgggttcttctcttgaaagtgatttaagcctccgtagcaagtcaccccgcaccggcatacatctggggggctcaagagcttaggctgtttctatccagtcatgtgaaatttatagttgttcagttgcctacggttcacctagtcaggtgggacctcagtattacaataaatgaaggtgttctgattaaaacatccctttcttagacaaaccatgactggttttggaggttagtggaaaactgacacaaaactacaagcttacgtttaatcgcttggcagaatttctttcatattcatttgaccactgtttaatatgctttaagatgtctgaagttggagcttagaatgtacactgtgtcctacttttaaatgagaggaattccagtagctaagaccaatcctattc

SEQ ID NO: 22094 - DNA, 1044 bp, Homo sapiens
ggacaagatggccacaaagaggaggtgttggggaccccagagagctgaacccaggaaagtgtgcattctcctcctttctttccaatggtcaggttggctggcttgagctgtgtctgccccgggttgctgtctggacctttgcagattattaaacacctcctggaggagtctccaccccgcctgccttctccagcaaagcaggcagctgggccagggagcaggtagtttttctttgttgtgcaagagccgcttaagaaacagtggccttttgcattctcaacatgagcaaacgtagccaacaccctagatttcttttcttaagaggaaaaaaattagtaaattcagaattttttttcttttcttaagaagatagtactgagtactcttcattatttacccgaacctatatactaggtgattttgctacctttctagacatttctcaaaataggaccaatataaatgaagaaatgcaaagacttatttaatcagtgtagtcatttatggacttcatcctgtaggccgtggtgtgaggatttttgcaggctcgtttgagtatctggtcattgaaatctcactatttgtatgttggtaataatagtttgcttgtttctgcctatttcattgcatgagagaatgaagtgtgcacgtaaggtcacacgtttgatacagacagatactctctaatttacgacagggctgccttcccagaaacccatcctaagttgaagatacttttaagtcggaaatgcgtttaatacccttcagtctactgaacatggtaacatagcctcacctaccttaagtgcgcttggaatgggtaaatgttagccgacagttgggcaggagcacctggcagtgcaggttgccatgaagtaccgacgtccaccctggagatcgcggggctgccgctgccgggcctgtggagggagcagctcactgctttctgctgactgcctgtggcttcctcacctggtaaagttgaaaaagtgtaagtcaaactttcctaagttggggaccatctacagtaaaatacaaacaaaa

SEQ ID NO: 22095 - DNA, 1057 bp, Homo sapiens
acgaacacagacccccacccccacctccaccccacccacagctcccagtcaggagggcttcttccctagaaagggctgacatcagcatctcacattccgccctcagctcctggggctacgtccttggggagtccggtggaggggtggggctccctcctcctgcccagtccccactctcgtgggtgggaggctggccttgggtgtggcacactgagaaggcagggcctgactgcccttgctgcagtgattccaggccaggagaggccaatggggtctcagggtgctatcaagctctcagctcctagagagggagggtgtcattcacactgaggctcgcagctgtccccatcccccaaatccctggctcagagattcctgcctggagggagatgaaggaagtaatctcttctcaaaggaactgacttcctttgcaatggaacatgaagaagtttacaccgaagggcactctcaacgctattggaggtggtggtgaagggaattaggattcatgcgtgtgctgaccacgtagcctagactgcacgctggctaaggtgccggggaatgaggggagaagacagctggcaggagccctcctggggtcagagcaatgtcaggcactctcagaaagcaatgagaaggagctgcgatatgagcaggttgtaaaggaataacagagctttcagctggctgctaggagtttaactactgggtgtggtcagtgagacagagaagaggttgctccccaagccctgtcatcccagggtgacggtggcacactggtgcttcgacaccgagactgttgctggggaggaagaggggcacacaggcatcacaacagtaagccagccagtcaccaaagactaaaccagtgaataacaggcccaggatggggactaccaaaagggctagaatatcttgtctaaaatgtccagtttctaacaaagaatgacagggtatgtggaggaggaggagggaaggaagaaaaagaaaaagaaggaaagtatgactcatacattaggaagaaagcaacaaaaactgctgtgagagtgaccaaatg

SEQ ID NO: 22096 - DNA, 1050 bp, Homo sapiens
ttaggaatgtgttaacttccacatatttgtgaatatcccaaaatgtcttctgttatcgatttcaaatttatttccattataattgtagaatatactctgtattattccagtacttttatttatttatttttaatatttggagacagaatcttgctctgttggctgtggtgtgatcttggctcactgcaacctctgcctcctgagttcaagcaattcctgtgcctcagcctcccaagtagctgggactataggtgtgtgccaccgtccctggccaattttttttgtattttttgtagagacagggttttcaccatgtttaccaggctggtctcaaactccagagctcagggcacccacccaccacagcctcccaaagagctaggattataggcatgagcaaccacgcccagccagattccagtacttttaaatagaggcacatcttatggcctagcatatgatctgtcctggagaatattcaatgtgcattttgctgtggttgggtgaaggtggagggttgtctgttaggtcaagtctatgatttattgttcttctgtgtagttgttacgtccattactaaatgtgggtgtggaagtctgtaactatttttgaattatctttttctcttttcacttctgtcagtttttgtttgatgtattttggggcactgttgtttgttagggacgtatatgcatattttctcttttgacatctgtgtcttctgacgttagtgtcatcacatgcatgtctcctgtggttgccatttgatatattctttccattgttttacttttaacttttttatgtctttgaatttaaaatgagtcttctgtatacatacgatggatctttaaaaaaaatccattctggcaattctgccctttgatttgattgtttatttcattcacacttaatgttataatatgttcagatttacatctgctactttactttctggtttctgtatatcctatgccttttccccttagctgttgctcctttacagctttcttttgtattaagtaaatattttctaatgtaacattttaa

SEQ ID NO: 22097 - DNA, 1102 bp, Homo sapiens
tcaaaggctagggctgcagcccttgaagctcattctcttgctttttctctctctctctctctccctcactcgctctttggcatggctggtgctagccatctatctgctgggacctccacccaggctctgctgggacacccaccaaggcctcctcatgagacctgggcttcctcacaacatggcggccaggtcccaagggggagctacctgagaaagcaggtggaagctgtatcttttttatgacctaagtcttggaaatcacagcattgcttctgtggactggagtggtcacaagcccacccatgatcaaggggagaagacactgacaccacctcctgatgccgagtgtggaggaaaaggaaaatgttgctgggccctttttggatcctgagtgcctggtctggaggacgtgttcagcacagatctgtggaagtgtgtgactgttgaaaatgttcctggcagctctctcagcatcagaactctgcattccatcctacacaaacgtggatctgatcacactgctttccaggcaaggagcctcaggtagcttgaggctgtgcctaggacacagcctggtgtgggatgtgactctgcagcctgaaccatgtcttcttccccagcctgccggctggctgcctcccaccattgcctgttcacagtcacacctggatgtgagaagggaaacagtgtggactgagcagtcctgccttgggtggtccctccctcccaccccttgaggatcttggtctttagaagaggcgcccgtggagagggatgttgtctaaatcaaagcaacagagaggacgagctgagggacccatagaatccaagaggcagtgctgggggaggctgagggaggagagaagactgcactttgtatgctgcattggtttataaaaccctcaaatttggtagagatattgcagttcctgccttgtgagtggaacaacaccctaagtccaagtagcagagggcagaggtcagaggtcacctcgtatttgcttttagctgttcacttgcaaaatttccattttaagtctacattgcctggggcaggcaaacacaacctttgatcctacttctgctttctgatcccaggact

SEQ ID NO: 22098 - DNA, 1049 bp, Homo sapiens
cacaattcttggcagaccgatgaggacatgaaaataacttatgaggaaacgtttgaatagctgcatttcactgtgctcatggatggtcagacgacctaatgaaataaaagcggaaatgttttccagctatcttttatagggattttaagttttgaaggtcacaaattcagtttgaaagttaatataaaagaaacataaatggtattaagaaagagtaggttacttaaaaaattagatacataatttgttgtctgattataaagaacagtgcatgctcatggtagacatttggggaagacagaatataaagtaaaacagcttctggccggtcgcagcggctcatgcctgtaatcccagcactttgggaggccgaggtgggcggatcacgaggtcgggagttcgagaccatcctggccaacatggtgaaaccccgtctctactaaagatacaaaaagttagctgggcgtggtggcgcatgcctgtaatcccagctactcagaaggctgaggtgggagaatcacttgaaccctggaggtggaggttgcagtgagccaagattgggccattgcattccagcctgggccacagggtgagactccatcttaaaaaacaaaacaaagcaaaacaaaaaaacagcctccaccccaccctccagaggtgactactttgaacctcgtggcatgctttccaagtctcttccttttttcttctacagtcgcctttcacaaaattggcataattttcaaaattatgatcagactttaaaaagaaaccctcattccactgagatgttttcccaagccctttttgctgtgagtcagggtcagagcccctcactggagggagatgtcccacagggccccgagtgcccagcctgaggaaggcagggctggcatcagcacggtgcaacccctgggcggagctgagcctcttcggccaggccatggctgactgcggttgggagtgagtgcacacctgtctctcgtgtgctgggttatttctttttacctttcactttgcattatggagaatttcaagcgtttaccaag

SEQ ID NO: 22099 - DNA, 1030 bp, Homo sapiens
gagaccccatctcaaaaagaaacttcaacaaaccaggataaatttatgccagtacaacaaagggttaatatccttatcttgtaaagtgcacatgagtattcatgaggaaaagaactagtctcttgaaagataagtaaagaattatctacttccctaaccataaacatgcaaaatgtcatcttcatttcatagttgaagggcttttaatacaatttatgtcattgctcataagagcactgtgaaaaacttacacattgcttttatcaggtaaattagtacaaattagatgggggtctcattttgttatccatgttgatctcggactccgggcctcaagtgatcctcctgcctcagcctcccatagagttgggattacaggcatgagccactgcgcctgccctcctttgaccttttaatttccccttagaataactgtcctaaataaatacagaaaaatgcaggaaagagcatggtggacaatgcattgcatctttaaaaacacatttagctgcttcctgtattctcctgcatcatggcatacactctcgattttatgcgttcttcagtgatgttaacaagagcttgtcacagtgggaaaaatacggcattgttttcaaggaattcttttttaaagagacttctatgagaatggatgcccttgtttctcgttgcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctactt

SEQ ID NO: 22100 - DNA, 1052 bp, Homo sapiens
atagtgaccttgttttatttatttattgagatggagtctcactctcacccagggtggagtgcagtggcaccatcacagcaagcttgaactcctggcttcgagccatcctcccgcctcaggctgccaaagcgtgaggcactgccgtggttctgggcgtcgggatacgctcccctggacacgcccttggcttcctaggtgcctcctgttaggttgagaagatctgtgaggtgcaccctgcatttcttgtgaacttttcatctttcctaggtttcagcaaaggttgcgtggctgaccctcatccttttctctactgtgtgttcagcagccatttctgaatttcagcccctttggccatccggagaggctaaagaatttattccttttgttaacagttcttacactaatttgcctctttcctctcttgaaggcagcacctccgagactttgcttggaagtttccgcagctaaatatcccgagtgtgttgcttttgagctctgacttcctataactgcggaccccgtgtccctgttcctcggccactctgtaacgggggtccccttttctccgtttcccagtaacacactcctcacttccttccaagcccacaccaggtgttcctgaagtccatatttctgttaacagcctgttcgaggcaatagaggccttttctattttgcccctcagaattcttcaggtgagaacagggagggccgtcttaggtctctgccccccacagcgtgcagtggaggccagcctggggctggagatgctgtgaggggcaaggaggctgcaggcaacagccttgggtggcgggagcagcctacttagtgtagtttgatatttttaggactgatgctgtactcagaaaaggagatgaaacttccttctgctgtttctgtgatttagaattttaagacaaacggtactttagttaacttatgcaccaaacatatatcttgagcccccaccaggtttgtggtctagtggtggagcctaatgtcagataagacaggattcccactctcataggacgttgtctgatagaaacagc

SEQ ID NO: 22101 - DNA, 1401 bp, Homo sapiens
taacttgttacctgagtgaaatttaattcctgggcgattctgggagatggtaaagtgaggcggaaggagccagcggccaattcctgaactattctgggaaacggtggcgtgaggcggaaggagccggtggccaaggtcccagtagtgtcacatgatcttcccgcgtgtttgctgcactgggaaaaaatgttgaagaattagtttgaaaattgccccgttggccaggagtgatggctcactcctataatcccagcactttgggaggctgaggtgggaggatagcttgagcctgggaggtcgaggctgcagtgagctgattgcaccattgcactctaggatgacagagtgagaccctgtctcaaaaaaacaaaacaaaaattgccctgatccacacaaattcttggttttgtttttataaatgtgcttctataaaatgaaagccaaagtgttctgttatttcagtttttttttttaatctccttttaggttaaaaattttgcagttatttatcttgtggatattacagaagtgcctgacttcaacaaaatgtatgagttatacgatccatgtactgtcatgtttttcttcaggtacgttatcttaaagttgttactgaaattgaatattgtcagtttggaagcttaatgtaatcaagatctctttagattattttattttgaaggaagttggttgtacagtcatgtcccaaaatcgtttgtatcaccaggcaatcagtgtgaatctttgaaataattttcaaagtaacaattctagttttagcatttactcagtaacaaattacccttttgaaataactttgcggggaaacctaggtgaagtgtaattcaatgaaagatgttgttactgacattttagatacctggaactataatctgttcatcaaaaatgttgtaaaatcacaaatttaggccgggcacagtggctcaaagcgcctgtaatcccagcactttgggaggccgaggtgggtggatcacaaggtcaggagttcgagaccagctgggctaagatggtgaaaccgagtctctactaaaaatacaaaattagccgggcgtggtggtgcatacctgtaatcccagctactgggaggctgaggcaggagaatcacttgtacccaggaggtggaggttgcagttagccgagatcatgccattgcactccagcctaggcaacaagagcaaaactccgtctcaaaaaaaaaaatcaaaaacctaatttattaaatatgttatcatcaacttcggtgtccttttttatatccaagaggaacacctgaactactttgcttataaatacaagattattttatcagctcaaaaatttcattatggaaatttaatggggaaagaaatcaccatctgatgctgtttttacttgtttagt

SEQ ID NO: 22102 - DNA, 1451 bp, Homo sapiens
ctgagcaaggcattgaagggagaataatgaaatattattttgactttcctaatgcctgtgaccatttattttgttggtgtatttattttagcttctgtagggaagtattttgtgtttaagtcaaatcaaaagacagtttattagtttaccatgaaaataaagctggattctggcaacctgaccaacacattctcactgtggacgctgcgggaaactagagtttcagaaatgggcgttgtcagagtgaccggactcagaggggcccatgtctaatgcaaacatcactttggggttttgaaagcacatggacggggagtcgcatgcccctgcagtgggccgtgtgctcactttggggttttgaaagcacatggatggcgagttgcatgctcctgcagtgggccgtgtgctcaccttggggttttgaaagcacatggatggcgaggcgcacgctcctgcagtgggccctgtgctggagttctgatacggtttttttcaccaaagctgaagggcagtggagtctttgtgaagtgtgggctttccccctccccctctccccaccctgctccatggtttacatttccatcttaatttttaaaaaatatttcccaaagtagagaatatagtgaacccgtctgttcctattgttccacttcaacaattgctggtattttgctggtcttgtgttacctaacccctcatttttttaggctgtgtgtttcatggaaatcccagatataattatttcacctgtaagttacagtcaggttgtaaagatttagttttatatgaagaaatgttgtgcatatcccattgatttcccgtgactgctgtgagaggatgctgcaagctgaggggcttaaaacaacagaaacttctctcacaattctggataccagaagtccagaatcgaggtgttttccaggctgggctctctctgaaacctgccaaggagagtcctcatgcttctcccagcttctggtgctgccagcagcctcttggagctcctaggcttgtagacgcctctgcagtcctcgatgcccccagagcctcctgtccctgtgtctttatgtggccattttcctctaaggacaccagtcacaccagattaggggcccacctactccagtatgacctcatcttaccttaactgattacgcctgcagtaccgtttccaaataagctgcgctgtcactttgggggtttaggacttcaactgttttggggacacagtttaactcataacacatgtaagtggctacaagcttctaaagggcattgagttagtatttataaagagcctttaaaatgtcatatcctttgttccagaattttaggaatttgtctttaggaaataatgaagtatgtatacaaatttaagggggaaaatgttcacagatgaataatattaatgaacaatcagagagtaacagaagaatggtgtaggaggctct

SEQ ID NO: 22103 - DNA, 1059 bp, Homo sapiens
tggtgttgagcggcggttgagggtgcagactctagctaggctcttggcacttcataactgcatgagcgttacgaacttggccccgtgggtcatcttacctgtaaaaagggcatacttgtgcctcactcatagggttgtggtgggattaataaaggtttctagagcactcctgtcacatgggcagtaatgccactgttattactgtgattacttctctcacattactaagtttgcaagttattgtgagagctgattaaggcaaacattaattttagaaagtcaagtttttcagttttttttatggctttgacatgaattacctaaaaatgtaaaaataaacacttcaaaaatttgttgtgctaatcaactgcccagaacactttttccggaattttaggtgttttcttagctggttgagggactccatacaaaagtgtagaacagtggttggtatcatgtgccagtttggtcatgtgttttgcagagttatgtcattgtaacttggcaggtggacttagaggcatgcggaagaactgctgagcactttaattgctgacttgcctaaagaaaaagcatgcttatgaggtgtataggcaacagagttggaaaagatacttacaattcaaggcaatcaaagaatttaaaaacaatttgaggccagcgccgtggcttaaacctgtaattccagcagtttgggaagccgaggcaggcgaatcatctgaggtcaagagttcgagaccagcttggccaacatgttgaaaccccatctctactaaaaatacaaaacttagccagatgtggtggtgggcgcttgtaatcccagctactcgggaggctgaggtgggaggatctcttgaggctgggaaacagaggttgcagtgagccgagatcacgccactctgctccagcctgggtgacaaagtgagatcccatctaaaaaagaaaagaaaaagctgcctttgttgaggaagtcacaggatgacttggcagagcagtgtggctgcactcacccagctcctcctccaagcgcttggttaccgtggaaatgtcgccaccagc

SEQ ID NO: 22104 - DNA, 1064 bp, Homo sapiens
atctgggcactgtgtctcacgcctgtggtcccagcattttgggaggccgaggtgggtggttcccttgagcccaggagttcgagaacagcccgggcaacatggtgaaaccttgtctgtacaaaaaatgcaaacattagctaggcgttgtggcatgtgcctgtggtcccaactacttggtaggccgaggtgggaggatatgagtccaggagttcaaggctgtgacaagccgtgatcgcgccactgcatgccagcctgggtgacagagcgagaccctgtctcaaaaaaaaaaagttttctatttagcagctgattttatgcagttttgaagcgagacaatttcatgtacgagctgtctttccattttgtaggaacactgtcacaggagacaatttcatggacctttgagctgtctttccattttgtaggaacaccatcacaggagacaatttcatgtacctttgagctatctttccattttgtaggaacaccgtcacaggagacaatttcatggacctttgagctgtctttccattttgtgggaacgccgtcacaggagacaatttcatgtgcctttgagctgtctttctattttgtaggaacgctctcagaggggacaatttcatgtgcctttgagctgtctttccattttgtaggaacactcacagcagtgcttggggttcactgttacctaaatcccatgatgggtgagaagactgaatgggacgtttattttttgtgttaaaaagcccacgcaaatagagtttaaaatagtctcagtgagctgggcattgtagcatgtgcctgtaaccccactactcaggaggctaagacagagtatgagctcaggaggtcaaggctgcagtaagctatcatcgtgccgttgcactccaccctgggtgatagagcgagaccccatctctaaaaacaaaacaaaaaaattcctcagtaatattattgactcatgatagtacattttttttgtttgtttgagacaagagtcttcttgtgttgtccaggctagagtgcagtggcacgatcttggctcactgcaacctcagcctcct

SEQ ID NO: 22105 - DNA, 1170 bp, Homo sapiens
atactggaaatccagcgaagaattgactaagagcagtttcccaataagtaaatcactgctgtattgactttgagttatgaattctagaatctttcactgttctacattgcaggtggtggcataaacatcgggtggtgttcagatcctgctgccggcagctcgaggctaggatggctggagatgtgagggcctttgtctcatcacatccgagcacagctcagcaagatgctcttagctagaaaacagattttatgtgttaatgtaagtgtttagggtctttgccagatttgctcttttccaactcctttatgtccaatttctttgttattacagaatgaatcactgtatcactagtggacacacatagtggacacacacttaaggacagttgaaatgggctcactttggggtattttttttggtcttttaaaatagtctgatttttgtttttgtccaaaaatttggatagctttattaataaacttttaatgcgaatattataatatagttattaaaagggcaaacctaggccaggcgcggtagttcatgtctgtaatcccagcactttgggaggccagcgtaggcgatcacttgagcccagggattcgagaccagcctggacaatatggtgaaaccccttctctactaaaagtacaaatgccgggcgtggtggcacgtgcctgtagtcccagctacttgggaggctgaggtgggagaatcacctgagcccgggaagtcaagactgcagtgagccatgattacaccactgaactccagcctgggcaacaggagtgagactctgtctccaaaaaaaaaaaaagtgcacacctgaaatgcattaaaagaatattcatgttttattttcttcttagtctatgggcaaatatgacttcctaattctggaagcccttttttggagaagctcaacagaaatttttgaaatataaggttttagtataaagaacaatataactatttaaaaatttccctgtgcagaaatggcagataatggggactcttccttaccttgttccgagttctgtctggatattccagctgttttaaagtgagtaacagttgcaaatgttcaggctggacttgatatgatttttcctagatgtgttgtattgatttgctgcttccacagggcccacttgacttcatgctgga

SEQ ID NO: 22106 - DNA, 1048 bp, Homo sapiens
tagccttgggagttttaacttaggctcaaggtccaccccagcagccatttggttacctaagcaaaaagcttaacttggtggctaaaaaatggccagcttgcctctgagcagttgcagttgcatggttgagttagccatgaggaataagttaactgtttacacaccccataatgtagcagcactgctatcctctaaaggaagtctgtggctaacaggtaatcacctcctcaaatatcaagctttgctgctggaaaaacctgcagttcagttaaagacctgtcctggcctgaacccagccactttcctcccagaggaaactggagaacctgaacaggagtgtaaacaaatggtggtgcaaatctatgcagccaaaaaaacctcaaggaaataggaggaggaagtcacatcttacgtggatggtggtgggcaaagagagagcctgtgctggcaaactcccgtttttaaagccatcagatttcctgagactcattcactatcatgagaacagtgcaggaaagacccgcccccacaattcaatcacctttcaccgggttcctcccacaacacaagggaattgtgggagttacaattcaagatgagatttgggtggggacacagccaaaccatatcactatcttggggttccctctgctggctttacctttaaccattaaaaatggatataaataaagcatggtatgggagcatttttaacgctacgcaaaaaaacacacaccctgagggtaagacttactcctttagactaggtaaagttaataagatagcaaatgccttcttctgctttaaaagcagaggaaaagaaccatacttgggaaacctttaaatattccaaaagtatgctcataattgctaagagtacagagatctggagactaagaaggaacaagggtgacaccaaactgggagagactatagaaaaattttaatctagccagacctcctaggtggaattcccaatgggaatagctatccctgggcagaaatgccaccccttgccaaccttattatcaggtaataaataacacat

SEQ ID NO: 22107 - DNA, 1051 bp, Homo sapiens
gtcagtggcagaactgtcctgacttcgtgaacatggaactgctaagagggaaaactgcatctcagcattttcattttttctgaatattaagtgaaaagcaagttctatttttaagaaatagcttttgctgaggagttgtgaattcctgcacctgtgtttgatgttatttgtatgcaatggattgctggccctttgttcctaagcaagagaagaccaaagatgcttccccatgacctctccggtgaggatccgcaccccccggacttgctctctgatgaagggcatgtcgttcagtgccccagcagtcagaagcagtttttgtggaactaaaactaataatgttaccctcacaaaggaaatgttcttttactaagttattgctgattcttgaatgtctgttatataactgggtcggctatcaagaaggaaggttatatttcttatcacattttaagttgttaagcaaatgtgagtttttttttaagaaatgaggctttcactgagatttgtgtgctattcataattttaggaattactgcttagaacagctgcttgggtgtatttttctacacaggtctgtacttctgccactttctccttttaaaaaaacaaaactatgcatattatgtattaaagttttcttggttttatatatcagagaataaaaacttttttgacttttgagtaaacaaaatgcatgaatatttcacctgtgttctaagtggaagagaataccagagataaagtaatccctcaaagagaatgacagatttatcaagtgcttatcatgtaccatctttcacggaatccgcacatactctctgagggacgcagatgagaaaatgggcccaagctcatcagatagacagatgacagtccagaaccctctctcgaagtctttttgaaaaagcttttctgaatatttatacagcacacagtccttcctaaatgtgccctggttggcacggttttcattaacactgtcgttctggcagccatcaagagtcaaattacaattacaaattcagttactcagcaaattacagatgtg

SEQ ID NO: 22108 - DNA, 1064 bp, Homo sapiens
tgtgggttttcctaaacgcccctcatctggttgaagccctagtgtttctttctcacatcagaggcaaatgcattggggtgggtctggtttggacaataaatttcctctggtttggaccaagaaaaacagagttctttgaccgctaacatatatgtaaaaagaaagtttgtaaaaacaagagttaaaatgcttctaacagtgtggtcatcactgcacaggacactggaattggcattcggggttgtgtctgtccatgtggtttcgttgtatgtcatgtgctctcagctcagacagagacatccaattgacttctgacttggggcatttaaacttcataccacagctttatttagaggacttatttattgtattttccactgtttttatttaaaagttgtataaaaattgttagggctggttttgatatagaaaaatcattatgactggttttgctaagtccatacacctttgtggtctggggagcggtgagtgctgaagcaaaggaatgtctgcagaaacaaacaagggtgttctctcagcttcagagactgatgaagcaggatgaagtgggctcccgggcagagagtacttggagagagagtggccgcacagtgctcgagctggggctgtgtgtacgaccggcaggatcacgtgctgagccttgggggactcagctgggaccattagaagctctggggcctgctccacccattctgactggtgctgccctcaggaaaccatctctgcctgaaacccattagggccagggagagttgtctggctggaaaggaagaagacggatgctggtggttttttgtctttcgcttgttgttttagagccactgagaaggtcagcgtacttttccactatgcctgtatgcggctttgctcttctccatgcctatctgcagcttgttttgcagaagtctctctggctttctctctcccaccctttcacattgcaaggccctccacttcttcactaattttcctgcagatgacggagccctgcgaccaggaacctgactcttcagctcaaatcttggtttgaaagggggacttct

SEQ ID NO: 22109 - DNA, 1025 bp, Homo sapiens
ttgaacccaggaggcagaggttgcagtgagccaagattgcaccactgccctccagcctgggtgacagagcgaaactccgtctcagaaaaaaagaaaaattaatctgttgcttaaaataatctcttcctccaaaccatacaaagacacagtgataaactacagaacagcattcctttatgaatgtagatgtaaaaacccttcagcaaaatactagcacatggaaaaatgcacccacacaaaaagtacacgaatgttcatagtaacattattcacaatatccataaggcgagaacagcccacgcgtccatcagctgataaatggataaaaaagtgtgcgcatgtgcgtgtgtgtctagtcatgcagtggaatgttatcgagccatgaaaaatgatgcgctgacacatgctacagatggatgaacctcagaaaccgtatgtttaagagtgagagaagccggacataaaagttcccatattgtatgatgactttggaagttgattctcattattcaaggactgtgtattgatgaaatgttgtgaccagaggctaacaggaacctaaccctgtgtcccccggaagcaatggttctatgctcagtaattcagtgaccatgtcaactttagagaacaaactactacacgtgacaagaatcctctgtaatgtgaaaagtccagaatgggcaaatccatagactcatggttgccaggggctgagaggtggggagaattgggagggagggggtttctttctggagtgatagaaatgttctagaactagagatttgcataaataccaacaaccattgaattctacactttaaatgggtgaagtttatgtgaattatttcggaataaagctgttaaaaatagaaaggactgtctaccttaccagggcggacaggctgatgatcagacccctggatctgagccatggccctgggtaaggttttctgggtttatctccagcctttatttccaaaattcagccattctccatatgtgaatactttgactttttaataaac

SEQ ID NO: 22110 - DNA, 1808 bp, Homo sapiens
tgagccacctgccttctgcccctgcaggcgcgcctcaagttccccatcgactacccatactctccaccagcctttcggttcctgaccaagatgtggcaccctaacatctacgaggtgagcgcggcccccacgggcctcaagtcctcatcctccgggacccagggtgctgggagcctcacgtcctcatccttccgggacccggggcgctgggagcctcacgtcctcgtcctccgggacccggggcgctgggagcctcacgtcctcgtccttccgggacccgaggcgctgggagcctcatgtcctcgtccttccgggacccggggcgctgggagcctcacgtcctcgtcctccacgtcctcatcctccgggacctggggcactgggagcccgtgctgacctctgacctgttctgacctgtcttcttcttgtgcagacgggggacgtgtgtatctccatcctccacccgccggtggacgacccccagagcggggagctgccctcagagaggtggaaccccacgcagaacgtcaggtaagccggcccaaccccctgtgtccacccagaacatcaggtaggccgggctccgtcccgtatccacccagaccatcaggtaggccgggctcccccacaggctgtggcgccaaggcctgattcgggacctgccagctggcggtcctgggcctcgctgtacctgcacggtaggtgctttcacggggcctgcggcaccgtgtgtcggtgcagactcccaccaggaccccaggccggccccaccgtctggaaccacctagaggtgtcccgccatcctcagtcctggggccttctccttacccagccgtctctgggttggtcacctcgtgccacgtgtgccgcctgggcctcgtccccaggtacaagcactgggccgtgttgcccgtgtgtcctggagtgtagtctaggcaggacgtgcgggtgtgagggcagccccgggtctgacggaggggtctgcaccttgctgccctccctggtcttggcgtgggagggaggagactgatgcaggtccagcccctgctgttctgggggcctgagacagaagcagaggccatgaggccaggtgaaggtcacctgctgggtgggtccaggcgtccccgtgaccctcagggccagagaagagccggaaggctggggtgccccgggccgccccactccgacccactctccccacaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggtgagggcgggcgggggcgtcacgggaggagagactcagatccggcctgcaccccggcccctggtcccacggccgcccagccccaccttcctggtgagggtggcggagcttcctggtgcccatttacagggtgccagtcacagatggaggccgggccgagtggcggagggtccagccaggttcaagcccagcttcttgccccttttcctctttttttttgtttgagacagagtctctctctgtcacccaggctggagtgcagtggcgcgatctcggctcactgcaagctccgcctcccgggttcacgccattctcctgcctcagcctcccaagtagctgggactacaggcgcccgtcaccacgcccggctaattttttgtatttttagtagagacggggtttcagcgtgttagccaggatggtctcgatctcctgacctcgtgatccatctgcctcggcctcccaaagtg

SEQ ID NO: 22111 - DNA, 2073 bp, Homo sapiens
gacctggggaaagcggcctgggcgtggaatctggagacgggtccaccctgcctgcgagtgttagggtcagagaccctcccctgagactctctggggcccccgcaagggcccgtgcggcctggagcgatcatcttggcgctcccttctggaaaaggggcttttgtcctccaagagcacatggaggctctgagtgggtcagccctccggatcgggaagggattaccgttcttcacgggatttagccctggcgtcttgcctagggcgtgcacctgcccccgggtgttctcccagactcttaagacctcgcaggctccctcgaggggccctgcgtggaagggaaggcggaatctccctctgattctgcctggattcagcacccagaatgaggtggtctctgaacgcccctcctcctttacaggcgaggaaacagccctgtgggaagtcgaggttccaaggtcacagtgagggggccctggccacccgattcagcgcaggaaatagtgagaaagtcgtttttagccgactctgacccgcattcggtttccagtgctgtcttaggagggccgtgtgttgagggtgggcaaacgtggtttggagagcgcatttgggaaatggattgaggtgtgtttttccgggagaaaagcatgacatcctttcttgcttcatagaaaatttcttcctttgttgagacccccatttggttctgggttaaagatttatagtgaggccgggcgtggtggctcacacctgtaatcccagcactttgggaggctgaggcgggtggatcacctgaggtcaggagttcaagaccagcctggccaacatggtgaaaccccatctctactaaaaatacaaaaattagctgggcgtgttggcgcacgcctgtaatcccagccactcaggaagctgaggcaagagaatcgcttgaacctgggaggtgaaggttgcagtgagctgatatcatgccactgcactccagcctgggtaacagggagactctgtctttaaaaaaaaaaaaaaaagaggtcgggcatggtggctcacgcctgtaatcccagcactttgggaggccgaggcgggcggatcacgaggtcaagagatcaagaccatcgtggctaacacggtgaaaccccgtctctactaaaaatacaaaaaattagcctggcgtggtggcgggcgcctgtagtcccagctgctagggagtctgaggcaggagaatggtgtgaaccagggaggcggagcttgcagtgagccgagatcgcgccattgcactccagcctgggcgacagagcgagaccccgtctcaaaaaaaaacaaaaaaaaaatttattgtgaccgatgtgttgggaacaaggtgcagagctggagggtctggcctcctgaagggtcaagagcaagggcttcgagcctctgtcctgggcattgagccgtagggggccttgggcagaggctggggagggggctccttcttccagaggctttgccagctaactcctgacctacgtctgagatttcgtcttcctggtaaccaaagtggccctttatcgaatgtctcctgggcaagggcctggccccagcactgcggccagctctctggggagacacagataggagcccatgggtgaggtgagcgcggaagataagccgcccccgccagccctgtggaaacccagccaggcctgactgggtttcaagcacagcacgaggttcccacattgagctaatttggacagccaagtgggtgaaagacctttggtctctccctgctgggtagggtggttcacagttttgttccttttgtgcatttgtgcaggagactgagaagggtttcttctgagcagaaagcttagcctggggcttactggccagagctgcctgcagcctgggaagcaggtggagtctgcagtgctggcagcgccgccgtgcagcggtgtagccgtgtgtgcgcgtgtgtgtgtgtggtgagaaaccccacttttgctggggactgactcgtgaagaccacaaggtctgggcaacacagccttggcccgtgtggggtggacactgctgtttgctctgtgaattcgtgac

SEQ ID NO: 22112 - DNA, 1057 bp, Homo sapiens
tgggtccgcgcccaggcagtcgtgctagtcctggaacgtgagtggcgggcacctccctccccgcctccctcagtttccctcctgtgccgctcgcctcccggctcctgctcagtagaacccagacgcctcctcccctctccgtcccgctgtgccccgttgggcccaccgcctggacggaggggcccggacctgaagggggtgggctcgccgcctgaccaccagcgctgggcggcctggctcggggcaggcagggctctgccctccagcaggtgggtcctcgtcctcccctcgaccctcgtgccatccgttccgtcgtttctgcttccccgggcgcctgcccggctccctccctgagcgtccatactgcaagcctgaggggccctccaagctcagcccaggcttgcaggtctcagaaccttctgtgtccttcgcagcatctcgttctaagggattttcaaatttcaattcctagcgggaatattgtaaactaaccaagaaccaagagatttgcttggttggggattggcagaagaaccggggtgctcccagcactgctggagtgccgtcagcctggggctggggggatgtggggccacctgagtgcctcctagagaagggcacgggagccttggccgggggtgctgtggctattttttttttttttcctggagatggagtcttgctgttcccaggtggagtgtggtggcacaatctcggctcactgcaacttccgcctcccgggttcaagcgattcttctgcctcagcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttg

SEQ ID NO: 22113 - DNA, 4247 bp, Homo sapiens
cgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcctggacccagccctcaggactgggtgagaggcctagactgggggtcccggacccagccctcaggactgggtgaggggcctagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggtgagccgtctgccctcctgcccacatgccctgctctcggggtggcccagggccactcctggtccgtccctgccagccccaccgctgacccagagcttggaactgaggagccccaggcagggagttgatgggaccccgaaagaaagtgtgggatggagggtctagccccgggcagctgcggctcagtgggcagcgggaccccgggaggaggaggcggcacctccgccccacagcctcacccggcccttccctcccgctcacttggctgcaagccagtgtcctccgtggtgagccggcccttgctgctctgcatgatcaggctcgggaacctgaggtcagccatgctgtgctccggcagcccctgcctgcctcctcgcggagcccttctgccccttgggctgcgtgtgccggggcgaggcctgtgtggggcctgtgatggcagctcctggaaaacgctgtggggcaggggtgaggcccacgaggccatggggacagctcaccatggggagcacacctgcaggtggggagggctgcctttccccacagcactcagaagatgcacgtggccggggctgatgagctgccccgagccacccctgggggtcactgagggcagggctggcagcacagatgcccctgctcggggcctgagtggggccagtgctgacaggctgtcctctcgtcctctttttcatggcggcggtccttcttcagatgacgacgccggctctgcacccctgtaagttccagctgtgggggtcgggggtcccaaggagcggcctgctgccccaggcctttaaaacacaaaggcagagcccctgggcttcagtattcgggggtcctgggggccggggtgggcaggggtgacttggagagagtgacttgcgggggacaccctctcacccggcccctcgtgccccaggaagagcagcgggcagcaccagaatgacaaaggcaagaacgtccgccagaggaactcttcctgaggcaggtgcggtgggcgggagctcctcctgagccaggtgtggtgggtgggtgggcgggaactcctgagccaggtgtggtgggcgggatctgctagccaggtgtgggctcctgggtcccgcctgtgggtcgctgggaggtgggtccagtctgagcgcccctccctgtccacaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaccctctcctggctcctgtctgtgcctgacggggttgggttttccgagagcaggtgcaccctgggctctggtggtcacagcaggggtgcgtccagtactgggatttcacatgcgaggacgggtctgctgagaccgcagtgggtgttgggtggctcggggcatgggctggacagggcctgaggctgtcagccggactgggaacttggaaggtggctggggccgaccccgtgcctcagagc

SEQ ID NO: 22114 - DNA, 1073 bp, Homo sapiens
cccactactggggtcacctgcctggccctgaatcagccaggcctggtgtgccaagacctacagacaccccctgcacccctgcaggctggcagagccagaaacttgggtggaaaccgacttctgaactatttcaccattccttatgcgttagtcttttcttttatttgatgagatcccagcactttgggaggccgaggcgggcggatcacgtgaggtcaggagtttgagaccagcctggccaacatggtgaaaccccgtctctactaaaaatacgaaaattagccgggcatggtggcctgtgcctgtaatcccagctactcaggaggccaagggaggaaaatcacttgaacctgagaggtggaggttacagtgagccaagatcgcaccactgcactccagccttgggcaatgtagccaaaccccatcactacaaataatacaaaaaaattttgttggctgtgatggtgcctgcctgtggccccatctacttgggaggctgaggtgggaagatgtagaattgcttgagccaggaggcagaggctgcagtgagctgtgattgagccactgcactccagcctgggcgacagagcgagaccctgtctcaaaaaaaaaagaacataatctgggttttggaataagacagcagtttctgaaacagctcattgcccaaattccagcctcgcaactctgtagccgccaccaccccccagccccaccatttattttaactacatctgtctccaccactcctgtattaagtaaatgcaatattggctggtcatggtggctcatgcctgtaattccagcactttgggaggctgaggcaggcagatcccctgaggtcaggagttcgagactggcctggccaacgtggtgaaaccctgtctccactaaaaattcaaaaattagccggacgtggtagtgggtggtgcctgtaatcccagctacttgggaggctgaggtaagagaaatgcttgaatccaagagactgaggttgcagtgagctgagatctcgccgctgcactccagcctgaacgacagagcgagactccgtctcaaaaataaattaataa

SEQ ID NO: 22115 - DNA, 1027 bp, Homo sapiens
gggtctggggaggggcgaggggggcgccgggtctggggaggggcgaggggggcgcccgtgactgcgggggccaggggggcgcgtcctggggaggggcctgcgccctggggctgcttcccgcgcgttccctgcccgcccgcctgacattcccccgccctggccggccgggcagggacaggctgccccagacactaccgccttgtctccagcctgggaggcggccacacagccacactctgtccccgggtccggtctgagcggccacctgcctgccgggtggggacctgggcagtcggcgaccagcctgatcctggggcccaggagttccgccgttttgtggacctcccgccccagctctgctccctccggggtggccccgagcccacttagagctggaaaccaggactgtggggtggcccggggctgggcggttgttgttccaatctggctgtgcccagggccacgctgtgccctccctggacgtggcttccagccatgggaagaaggtgccgggcagggggaaccgtgtgtgagaggccctggggtaggaggcttggtgcatagccagggggccctgcaggagtagaccaacgggggaagtgaaggggccgacctgagggttcctctaagggctgatgggagccagggagcctctagagctggagagggacagggtctgattaattattattattattattgttattttgagatagggtttcactctgtcccccaggctagagtgcggtggcacgatctcggctcactgcaacctccacctcccgggttcaagtgatcctcctgcctcagcctcccgagtagctgggattacaggcgcctggcaccacccccagctaatttttgtatttttagtagagactgggttttgccttgttggccaggatggtctcaaactcctaacctcaagtgacctgcccaccttggcctcccgaagtgctaggattacaggcatgagccaccgtgcctggccttctttttttaattttaaaaaaattttttgtttgtt

SEQ ID NO: 22116 - DNA, 1018 bp, Homo sapiens
ttggggagggccgcgtcgagaaggtgcccaggcatccccggctccgcctgccccatcgctgcttggctctgcgctgctggctcccccctccctggcttggccgcagcccggcgggggggtgcgggggcgggcaggccgtggtgtaaccccgtgactctcgtgccagccatgtactcggttgagatcactgtggagaaggacaaggtgacaggggagaccagggtgctgtccagcaccacgctgctccctcggcagccgctccctctgggcatcaaagtctacgaggacgagaccaaaggtacgagcaccccggcccctgccctccctccacctgggccagagccccgaacacgtgtgctcccagcgtgtgggtctggcgtctgccccggaatcaggaccccgattcgatgtgaagcagatgacgctgttcaggccagggcctcaccccctgtggcccacagctgggctcagaggtcgttcagccctgggctcactgcccaatcattcatccactccagaaagctgcctgaaagctgagccgggcaccaggtacccagctgggctctggagggaaatccggaggtagattcagcttctgtccttgccgggtggcaaaccgggcccttccatctggagctcctaaataattcgtttaaataattactgctagcccaagggctcacgcctttagtcccagcactttgggaggccgagggaggaggatcgcttgagcccagaagtttgagaccagcctgggcagcatagcaaggctccgtctctaccaaaaaaaaaaaaaaaaaaaaattaccctggcatggtggtgcgtgcctgtggtcccagctacttgggaggctgagatgggaggatcacttgggcccaggaggttgaggctgtagtgagccgtgatcgcaccactgcactccaacctgggcaacagagtgagaccctgtctcttaagaataaaaaataataataaagaattgctagcgtgacagaagccacagaaaatgcacatcca

SEQ ID NO: 22117 - DNA, 1004 bp, Homo sapiens
gggacagccagccctcgctggaccagaccatggccgcggccttcggtaagaggctgcccgacgcggcgccagtgtgcagagtggtctattagggccgctcagtccggagccccggcggcacgggcccggccctgcaccagggtgatgcacctgctgctctctgcacggccagcacagcacggtccagtgtcccccacgtcgggaccacggccccccctggagcagcggatctgcccgcgaaggctctgccggggccgcccgccggccgggttggggcccatcccgcagcacagcgcccgctcgcggtggaggttgtgggtgcgatgattagtgtctcatttatttctaggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttc

SEQ ID NO: 22118 - DNA, 1525 bp, Homo sapiens
ttttatttggtcccgtagatacgtacgcatggtttatcgccctgcatgcttttcagagttagacctgtcggtggcatatgccaccgtggccacccgctggcagcttacctgtcctggatgctatgactttgctgaacggagctgctcctgttagcgcgccctgtggctgcgagacgcagctccgcagtggccgataaagcaaacccggccgggctgagccgggccttgtgggggtgcgcggggccggggctgacggggagatgggcggggcaggcagcaggagactcaggccccatccctgggcttttgaaggcgtctacggtgacgtgcagcgcgtgaagatcctgttcaataagaaggagaacgccctagtgcagatggcggacggcaaccaggcccagctgggtaagaggccggggcggccccggggtggagggggcaggggcgggggctgcgttccctctcgggcgcctggtcacgcgggtgctgctcccccagccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgtgagtgctgggccggggggctcatggggccgggggcgggcaagggctctgcttggctgtcctaccgcgtcggtgtgtggacttctggcgtttccagagtgcaggtcgggcacctcttaccccaaacctgaagtactgcaaggcctggagcttgagccgagggctgctcaagggagggggtcgttggacactttggaggttttggctcaggggatgctccctgtgagaatgtataatgcacacatttatttatttatattttttgaggcgaagtcttgctttgtcacccaggctggagtacagtggaacgatctcggttcactgcaacctccgcctcttgggttcaagtgattgtgccacctcagcttcccgagtagctgggactgtaggcacccacaaccacacctggctaatttttgtatttttagtagagacggggtttcaccatattggccaggctgatcttgatctcctgaccttgtgatccgcctgcttcggcctcccaaagtgctgggatacaggcgtgagccaccgcgcctagccacatttatttatttatttatttattttacttattttgagatggagtcacgctctgtcgcccaggctggagtgcagtggcgggatctctgcaagttctgcctcctgggttcatgccactctgctgcctcagcctcccgagtagctgggagggactataggtgcccgccagcacgcccggctaattttttgtatttttagtggaaacggggtttcactgtgttagccaggatggtgtcgatctcctgactttgtgatcaacccgcctcg

SEQ ID NO: 22119 - DNA, 1183 bp, Homo sapiens
cattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgt

SEQ ID NO: 22120 - DNA, 1050 bp, Homo sapiens
tcatctatccattcatccatccatcatccacccatgcagccatccatctatccacccacccaactgtccatccatccacccatccacccacccacccatccacctatccatccacccatccatccattgatcacccatccatccatccatctatccaccctcccacccacccatctaccaacctacccatctatccacctactcatccatctacccatctgtccatccacaacagtcttgctctgttgcccaggctgcagtgcagtggtgccatctcaactcactgcaacctctgcctcctgggtttttgtatttttagtagagacagggtatcgtcatgttgcccaggctggtctcgaactcctaggctcaagtgatacacccgccttggcctcccaaagtgctgggattagaggcgtgaggcaccgcacccagccatggcctcaagcctttttttttcccccactctgtcacgcagcctggagtgcagtggtgcaatctcggctcactgcaaactccgcctccaggttcaagagatcctcccacctcagccctccaagtagctggaattacaagcgtgcactaccacacctggctaattttttgtatttttagtagaggcggggtttcaccatgttccccaggctgccctcgaacttctgacctcaagtaatccacctgcctcggcctcctgaagtgctgggattacaggcatgagtgaccttgctcaggcatggccccagtcgtaatttctgccttgttatggcatcttagcaggggttcagccctcagtccagtcctggggagggcacaggtcagggctgggggctccaggaagggaaaagccatcactgaacatcccagggcagaattggatcgagggagctgagttcatgtccagtgagcattcattgagtgcctgttgcatgcaggcacgaggcccggggcagacgcggaaagtgggtagcagcgtttgtttgcacctgacacccggtttgaaaaccacccactttaacctgtgggcggccagcagaccccctgtgcctcagt

SEQ ID NO: 22121 - DNA, 1090 bp, Homo sapiens
ggctgcgccgcgttccctcgggtccgtggacacggtcaggggtccgtccgccctcgccgggcccccgcagccccgcactcacctggtcggcccgtgcgccaagctcagcgggcgtccgcggtgcgatcttccctagcgcctcgggtctggcgccgccatcttcctcggtaacaaccagtcgcctgaggcgtggggccgcctcccaaagacttctgggagggcggtgcggctcaggctctgccccgcctccggggctatttgcatacgaccatttccagtaattcccagcagccaccgtagctatatttggtagaacaacgagcactttctcaactccagtcaataactacgttagttgcattacacattgggctaatataaatagaggttaaatctctaggtcatttaagagaagtcggcctatgtgtacagacatttgttccaggggctttaaatagctggtggtggaactcaatattcgtgctcgcttcggcagcacatatactaaaattggaacgatacagagaagattagcatggcccctgcgcaaggatgacacgcaaattcgtgaagcgttccatatttttttttttttttccattttccctcccagaaacggaatcttgctctgttgcccaggctggaatgcaatggcgcgatcttagcttgttgcaacctccgcctcccgggttgaagcgattctcctgcctcagcctcccgagtagctgggattataaacatgcgccaccacgcccggctaatttttgtattttggtagagacggggtttcgccatgttggccagggtggtctctatctactgacctcctgatccgcccgcctcggcctcccagagtactgggattacaggtgtgagccaccgcgcccggcctttcttccattttctaatgtccaagagtggggaaactgtaagcgaagtcaccgaccccgttgagtattcctacttccaaccctattcccacctcctcctccaaaagccagtttaatgcaatggatgtggtgctcttctatttttatttttattttttttgagacagggtctcgctctgtggcccaggctggagtgcagt

SEQ ID NO: 22122 - DNA, 1050 bp, Homo sapiens
ggtggggagggaagatatccagaaaggagccacagctgacgccaaaaagaaaagaaaaaagatatatatatatatatatatatatacacgtatatatataaagagaatttaataaaacaggggaaaaccaaggaacacttgaatttctcaggttttggacattcagagagatgaattgtgagaacagcaaagaaatccatcagaaaaacagaaagaggcagacgtttcccagggcgttcaggcagccctgatggaccgaaggctctggtgtctggtttggccccacagcagtgtgggccgatcctgtttacctcatacatccctgcactgtgtgttttcatttttgtctgctttagttctcttttattttctattcaccacacactcaccactcccagcttctcgtgtccagtgaaacccctgaaccaagatcactgaatttttgtttttttcttgttgctttgggaaatttttttttctctgtagggtttttaagaggtttcgggggttttgttgtgtaaatattctattttattcttggggggatcaaaccttaggaaaaggatatctatatatctatatagctatatatttgtgttccttcagggaaactggtcttgaaaaagcaagaaaaaaaagcaaaaaaaaaaaaaaaaaaaaaaaaaaaaaactcacctttttatttttcccatgaccaatttgggtccctttgtccatttctgggggtgcgttgggcagctgtgagcccagcacatcggatccctggggctagagccgcggagccaatgaactcaggtgctatgggccgggctggggcagagggtgcatgctggggtcccaccggccaggggcccctgacagtgaattgctgactgtgatattccacgatgcttttgcttgtgccgtgcttgtctgctgggctctcgagtcaggggcctggaaatttttttttttttttttttttgagacggagttttgctcttgtcgcccaggctggagtgagtgcaatggtgcgatcttggctcactgcaacctgcacctcccaggtgc

SEQ ID NO: 22123 - DNA, 1067 bp, Homo sapiens
tgagccagtgcacccagtgaaggtcccctcttctctccaccatgacctgctccacccctccttcctctccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccag

SEQ ID NO: 22124 - DNA, 1058 bp, Homo sapiens
gtgtgaaatgtccagcactgccaatattcgttgctgttatcttcggagaacagtgaggggaaaggaatccttgcctgggctgggccaggcaggaggctgggggtcaggacctggaagaggcttccaggtgaggcttggggtggagcctggtgacgaaagcgttaagcccaaactcggtccctggaggattagaggatgatctttaagtccccagctgtcagccctgctcagagcgacagtcctggcagccaatcagatgcgaggacggctgcgggttgcgctcccattggtttactccacccctggggtagcggagcctctttatcgagtgactactgtttgcctcgctctaatcagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtaacgccccagtgtgagaccagggccgggtgggcaggcagcccccactgtcccccaccgtctcccacctattctcccccaggtccagctcctggtcgaattgctgtggcctctcttcctcttcttcatcctggtggctgttcgccactcccacccgcccctggagcaccatgaatgtgagcccccccagggaccaggcactttgtgtgtgtaggggaaggcagatggctcacccgtgcacaggaatcccccgtgcatgtcagggagccttcaccaggccgccaatacatggcatgggagtgagctctccatcgctggaggcatgcaagcggtgccgggcgacccgatgggggtggagtcaggcagagtccacagggcctcagcaccaggcgtctccccgcaggccacttcccaaacaagccactgccatcggcgggcaccgtgccctggctccagggtctcatctgtaatgtgaacaacacctgctttccgcagctg

SEQ ID NO: 22125 - DNA, 2059 bp, Homo sapiens
aggagtttgctacatgtggaccccacttgttgctatggcatttaggggctactgctcaaataccgagacagtaagagttggggatagacagaggttcccctggattctgcctgaagggccagaaaaggtttccaacaaggaggttctggggatgaggttttgagggatgaataggagtttgcttcatggggcagacaactcctggcagaggccccagctcgggcaaagacgcggcggcctgatggtagttgtgggttggtcccccgtgcctaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggtggggaccggccttctcctgacccctgacccccgggactctgttcagccctgaaggccaagccacttggtgcctctctgcccgcaggctgacactgacatggagggcagtgtggacaccaggcaggaaaagaagaatggcagccagggcagcagagtcggtgagggccggggtgggagacccaaggcgggtgggcagtggggtggctgtgccttaacttgaggaggaggagggggagggggaagaggaggaggagggggaggaagcggcagaggaggttgaggcggaggaggagggggaggaggagggggaggagtaagaggtggaaggggaggcgaaggggaggagtaggagggagaggaggagggggagggagaggaggagggggaggagaaggggggaggaggaggggaagggagaggaggagggggagaagaaggggaggagtaggaggggagcagaaggggaggaataggagggggaggaggagggggagggaaagggggaggagaagggggagaagtaggaggaagaggagggggaggagaagggggaggagtaggagggagaggaggaggagggagaggagggggaggagaaggagaggaggaggagagcacttgagaacctgagatgatgcccccatccctgggctgagccggaaccatgagactaacttgaacactgaccccacctttaacccaaccagggctgagcccagagacaaacctacccctgacctccaacactaggtccagcactgccctcaagatctctttttgtttgtttctgagtcttgctctgtcgcccaggctgtagtgcagtggtgtgatctcagctcactgcaacctctgcctcctgggttcaagcatttctcctccctcagcctctcgagtaactgggattacaggtgggttccaccatgcctggctaatttttgcatttttggtagaaatggggtttcaccatgttggtcaggctggtctcaaactcctgacctcaggtgatctgcctgcttcaaccctcaaagtgctgggattacaggcgtgagccactgcgcccggccgcacctggcctacgttcttaaccctgatctctgtctgccgggacagtcccctcacaggtcaccaatgcctcttccccagggagactggggtggggcgtgagccggggctccctgaagcacccctttgtccacacaggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggaggtgtgaggcctgggtggtggtgaggtggggccaggaggagggcttcctggaggaggtggtgttttgaaggatgaatagcgtgtttatgagcagcaaggacattcagggaggaggcatggcacatgaggagctctggtggctcagatgtcccttgggaaggcctgggggacccatggtgtaggaggggtggggggct

SEQ ID NO: 22126 - DNA, 1166 bp, Homo sapiens
gaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactc

SEQ ID NO: 22127 - DNA, 1059 bp, Homo sapiens
cacaggcagggctgctgccaacctcccgcctccatctttgctgggcctgctgcctgaggccagtggcctgcttccagcccatcgctggcagccgcctgccctgaccagatctcctggatgcaggtctgtggcctcagagtcagggccccttgctgctgcaggaccacaggggcagggaggggcctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcagctgcaaaggggacccctgtgaggggcagggaggcctcggccccaggacgggtgtgtgctgcccgcaggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcc

SEQ ID NO: 22128 - DNA, 1034 bp, Homo sapiens
tggccggcttcccgggcctccctggccccgaggcccgcacccccttccgctttcccagcggcatgtagagtcctgccctttccctacatcgcgggggcagggcgggggccgggagctgggtggtctgccatgggggtggccacagcagcagcagcagtggcgtgggggcagagccggggtcccgagccagggcgggggctgcaggtgatttcctggggcgagtgtgagcagagctccccgccgctggggggctgcggttggcagggggcccagggcgtgttggcttcacaccctcctccctgggcgcctgcgtcaggaaggagctgggttggggggggctggagggggtgctgggcggagacactgggctccccagggttgcttccctgcctggcaccgagtcatgcccgcccattagccttccccagggaggaagttgcagggcgggtggtggtggggactccagctgctctcgggaagccaccccgggcccttcctgcaaaggctgtcttggggcaggggggtagggggccgggcaggctgggccgcagggtgggggcttcaccctgccctcctccctgcctccctccccatgggccccaagcagagaaggttacgccagctactgccagtggagaggagagccgggagggagagctgggaggcggtcggttctgagtcatcccagcctatgtcacttctcagaaacctccgccacccccccccccatcccggccactggggagagcagggctctggcccatacccagagcagggggcttggcgaggacagggtgagattcaacccacacccaccctgaacgggggcagattgagggtttctgtgcttggagcaggttgtgccctccgggactccagccccagggcggtcagggccccttcctgcagccttgccacagccccctaggcctccgccccgcccaggacagataaatatttatcttgagaaagcaaaggttaggacagaagaattcgtgcaggaattccacccacttgctggccctggtgactta

SEQ ID NO: 22129 - DNA, 1028 bp, Homo sapiens
gggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaacacacattgactcccgcctgctcgcctagtggggggatctggccttggttgggagggttcctggggt

SEQ ID NO: 22130 - DNA, 1026 bp, Homo sapiens
tcgcgcggcccaggccccgcccaccagcggggaagcctcattggtgatcgcaccgctcgctcatcggcgtgccccagtagcagcgcgacgaagcctccagaaggcgggacttcagcccggcagcgccgagtgcgcaggcgcaagcgcggaggcgctgcagccccgcctctctccccgcgcgtctgcaaagttgggggcgggaggcgcagccgagggtctgacggctgcggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcaggtgagggggagcggcggccaggacatctgggaggtggctagacccgtggcctggactttggggggcggtcgagttggatcgatgatcgatggggaccctggcggcctcaccctgggggaggtagagacgaaaaaggaactacggtgtgcccggaaggtggtggctttaggtccacagggaggtggttggcaaggcgggggtaacagggggaaggagaaaatctgaaatgccggtgtgagctccgggccaagagagttgaggactcaggaggcaggaatcccccgtggccgcccgctgcttggctgtgggctccaacttggtgtgtgctcag

SEQ ID NO: 22131 - DNA, 1031 bp, Homo sapiens
caccagggctgggggaggcggcggcatgagatgactcctgggcgaggagcaagtggtggccatagagggccccccagaggctttggggccgccgaagagtagtgagtgagggtccttgtaaagctggttctccagatggcggcggctttaagactcccctccgccaaccaggctcagtaggggaggcctgtggaaggagagaaaaggcctgggtggaggagcagagtgggcctggccccgcgtggggagcgagtgcgccgttgctgtgcagcacggtgggaggggaggccgagggccgggcggagtgctggggtgcagtggggactcggggtgtccgcctgcacccgacagcagggacgcacaacactatccggccaggcgagtgtgggggtgtgggccacgcacccagccgtgataatcgcggttccagtgggagttaggcttgggtgcgggttggagtttgtaggcaaactgggttgcgtaaagttggggtgcaccaaagtgtggcgatgtaggaagaattgggattgcgaatattggggttcgcatgaatggggttgtctctgttggggttttggtgggcatggggttgatggcaggaatggagtgctggggtgctgggaaaactgggacgtcggttgtattggcaagaatatcacgacaggtgtcggggttcagatgaagttgggatgtctgacagccgggtcttggttgggtaggggatctgggctaggttgttatgtcgggactgctggagcacaggcaaagtcggggtcccagtgacacccagaagtccccatgaggcctgaggcctgggaatcggggctagaggcccatttgttccccgccgcaggccagggagcaggcacgcgtaactgggtcagccccgccccgccccgccgcgcgctggtcacgccccctcgagcgcgggtggaggactgcggactgcaaacgtctcggccaatagtcgagcccgacaccagtccgcgggagggggcggaaccgagatagactcggcccccagctcatga

SEQ ID NO: 22132 - DNA, 1387 bp, Homo sapiens
ttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccatggcgggcgcctttcggtgtgtgttgggtgcagggcagcgcctcccgggagcgccgggtc

SEQ ID NO: 22133 - DNA, 1061 bp, Homo sapiens
ggggttttggtctagtgcttccaaggttacacttccagaaatgtcttttttttttcacactaaaaaaaaaaaaagaatcagctgtaaaaaggcatgtaaggctgtaactcaaggaaagatctggcaagcagccctgtgatagtaaattatggtcgtgttcagggaatgctttccagcaattcagtagacagtgctcagctgcaatgcaaaagcccaggtccttgtctttgtctgccactggcctctcatgcctcagtttccccatctgtgaaacaatggggattggaccaaatatctgaaatcccatggttataggccttcaggattacctgctgcatttgtgctaaagtttgccactgtttctcactgtcagctgttgtaataacaaggattttcttttgttttaaatgtaggttttggcccgaaccgcgacttcaacaaaaaataagagaagaaaggaatattttctagctgtgcaaatcctctctctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatga

SEQ ID NO: 22134 - DNA, 1029 bp, Homo sapiens
ttgctttaaatggtttactttgtgattagtaaatatgtcctctgtgtgtagctcttgaaatccatggctgcggtgtacgcgtgtgaatgattgtgggaagtagcagagccaggctgcgctctggccgttagagttagatcgtgggctcagtcactgcgctgaattctcacaactgtcctgggaagttgcggccccatttccccgctttacgggtaaggaagctggggctccggcgaggacagtttacccagggccaccaggcaaggctacagcagagagcctctgcgcaaggccaccgccttccctggccgactgtctcagtccaccccatgtcacggtggcctcggtagccagccccttgcggccgggggcgtccctagctcagcgtcgggagccctgtgggcgctcaagtgctgcagtgagcctggccgataccacgtggcagacgtcttgctgcagagtggcttcctgctccctggatctgcagccagctttcatcatgtgctgtcgatgaactgcaagggatttgtctaactcagaaatgtctatttcccctctggaaatactcattttgttgtggcgacttccagcaccaacacgtcaactcagtgcagttatttttactcctctggaaaaaaagaaaaagtggttgtgtcttttccactctcagggatctgagttactttcttttgttttttttgagacggagtctcactctgttgcccaggctggagtgcagcggtgcgatctcagctcactgcaacctccacctcctgggttcatgcgattctgctgcctcagccttccgagtagctgggactacaggcaggcaccagcacacccggctaatttttgtatttttagtagagacggggtttcatcatattggccaggttggtctcgaactcctgacctcatgatccgcctgcctcagcctctcaaagtgctgggattacaggtgtgagccactgcgcccggctggaactgagttactttctaaaaatggatgaaggtgtggggtgaggagaa

SEQ ID NO: 22135 - DNA, 1073 bp, Homo sapiens
tggtgaaaccccgtttctactaaaaatacaaaaattagctgggcgtggtggcgcgtacctataatcccagctactcgggaggctgaggcaggagaatcacctgaacccgggaggcagaggttgcagtgagctgagattatgccattgcgctccagcctgggcgacagggcgagactctgtaccagaaaaaaccgccaccaaaaaaaaaacttaaaatttttgagaaatgctcttgtgggtttgggtcttgccttttcttctctgcttttagtgatctgagctattgtgtctagtccgaaagatagtactgatttaattaagaaacatcattacaagcagggattcatggactaggtttgcaccttctgaaccatgagctagaccatgtctggaggctggaacctggtgacccaggctccctgcggccttcttaaccgcaggccacttggggccagttgggcagtgcctgctgctattgagccccgtgccctctcacaggccatcatctgtgcgatctctgcggtggacgaggtggactacaagacggctgaggagaagtacatcaaggggccttcgctgagctaccggtaggccgctcccggcgctatctccagccacttgcgtctctgccttgcagtttctatttccacacccacaggcagtttgactccaggctgccgcagcccctctccctcatgaggtggcccaggtgctgggtggtgagctgatcacatacgctgaactcaccctgtgggtcactcctgccccccaggaaggctgtgcccgggtctcccagctggtcgctgtgggcagcacggggccacgggcacgtgcctgggccgtgtctgttcttaatctctttttgcaggggctgatgtttgctttttgcactttcctcccctctttccacagccccatggctgtgtgagaaatacagcaagattaagcagcagcacggcccggtgctttccagcagccagaagaatgctgtgatcaagatgtttctctcacatccgtgtgcttagctgcccttggatgtttggcccccagagcgcctaatcctgtctctgggc

SEQ ID NO: 22136 - DNA, 1083 bp, Homo sapiens
ccctgggaatccacacctggaaggtgggttagggagccatccttgggggaagctctgcttttgagtctgagaagtcgtcccaagttttgagggtccctgtgctggcttagaagtccatgtaaagcttgatgggggatgaaagtcagctgaggcctgccggtgataacggatgccttacacacaccgacttccagtcagcttgaggggggcttcatgcaggaggaagcgcatacgtgtggtggggtgtggggagtccctctctggatcctggtgggtttggcacgcggaccctacatggtggatgtgatggacagtgtcctcctttgggagcggggcctgtcctggtcctcttgtgaagggtgggggacaggcactgacctgtcaggagggttagagggttggcaccagcaggtggcctggagcgctcagagcacgcgcgatcaggaaggcccgagtctccagtgtgccctccctggccttgtgaagtcatcttaaagtctggcttgagcgcctctgacttggattctgggaagctgacacagcgcggccggggtcgccacatcctgttgagtagccgctgggtgctaggcgcctgggtggtagaccaggtgtcagggatagggcccatgcctggcctactggggagaggacagaggctcagaggggtcacctcgagcgcccaggccattgtgttctgctggcttccaaggcagcacacggtcatggaactggagagagaggtttatggaagattttatctggtacactggggaatggtaagacagggacacctggaaatattgtaggaaagtcacagagggaggaaggactcagcggagagaggagaaagccgcctctgggcagcttcgaggatacccaggactgtggccgggggccatgcagctcagagccaggcccatggcaggtctctgggtttattgggtggctgtggaaggagacatcctgagtggggctcctggctgggcccctagaggccgtgactacttgtacctgtgcagagtgagcacaaggcacctggcaagattgttggtcaggccagagagggccgtgatctgggggagg

SEQ ID NO: 22137 - DNA, 1942 bp, Homo sapiens
tccttctgcctcagcctcccaagtagctgggactacaggtgcctgccaccacctggagtctcgttacgttgcccaggctggtcttgaactcctggcctcccgtaatgctgtgattataggcgtgatctgcgcccagctgagaaagacagtactgataccaggttatctaacccccccggccctgtttcaggtttctcagctgagcgtttctagcccttcccccttaatacacaatttttgaaatttaaatgaagaccgaaactggactggtctgacgagttccttctgccagtgaggtgggggtggagggggtactgggctgcttggaggacacctgcctgttacctggctgttgggtgggtgcagtgctgactacaggctgctgtttcttcaagtgacttggatttggtttggttttcagggttttatgtgtgtgtgtgtgtgtgtgtgtgtgtgtgtgtgtgttttgtttttttttttttttttgagaactgcttgaactttaattccaaaggattgtgtaaatgagcatttttccggtcggttccagccaggcttgggggcccttccttcatggggtgggggctgctgctggctcctgctgggtgccgggccctgctggcagggatgtgggcggggctggccctgactcagcgcgggcacagcctatggagagtgaggcacagcctatggagagtgaggcacgcggaggcctcgctcctcccacggtctctaggcctgacctcaacgctccctggcctgattgcgaagggtgcgtgggagacgtaggattttaagttaatgaggcctcaacctaagcctgttgctgttgcgtgatcagcatggttttccctgaaatttgccttttcagatctcgtctctaagggtcaggaagcacagggcggctggcacaccccgcctctaattcttcccgcctcagccctccccaccgaagaacggggctggggggttgcttgttgacgttttgaagacggcagtgggtgcctttcctgtggtgggaacatgctttgtttttcacacactaaatttaaatcagtcgttcttagggaaaaaagaaggaacagggacaagctcctggcggttggctgtggcagacacttcaccaggggctgactcgcgggggctgagtgtacaggccccaggtggtggttgatgagaggtgatgagtgtgccagccaccttgcaggggtctttcctggcgagctggcaggagcagggaggagcacgttgctcctgctgctggtggggcagtaacgtgttcaacctgacagcgacgtttttgctgaaagccgaagccaagggtggtgtggttggccgtcagggatacagggccccgcgtgggaatggtgctttcagtgaggctggcaggattcttgcggctcaggtgggagctttggcctgcacggtgttttgctctctggagaccaagggtgatgatggtgctggcactgagtcacagctgagattcagctcagggacttcatttctgaatgcgtgtcctctttcccagggaaagcaggcaggatgggagagtcgccgatagaaccacctcttccctgcctcctgggcttgggggaagcttgaatgacatctaaggccccgtgcctgggtaagccttgtggtgtctcagacatgcccagtgggtgccatggctgactcaaggtggcacagtccccattgggagttggcacagtccccattgggagttggcacagccaaggccctggggccacctggagcggcagtgaggtggaaaggtgagtgggcccttgggcgtcgctgcagggtcgatggcggacgccttgggagagctccagctcttctgcccggaggagacagccccaggacgggggtggcgcgggtctttggtgggggcaggcaggaagtgccagtgctgagactgaatttcaggcccttctca

SEQ ID NO: 22138 - DNA, 1937 bp, Homo sapiens
tcatctttcatgtctgcagacagcatgggcgaggctgactcgccattgctgtgagctttgtatgccgtcacgtgcacaaggacgtttgcgtcagctgcttctgtggtttgaattaagacctcagcttggcttggatgggggcatttctaaggcgagcgctgtcttgatcctgaatgttttctcattgaatcgcaggaagctcttcgtgggcggtcttgactggagcacgacccaaggtaggtggggaaggggtgtcaggtgggtactgcagatgggctctaggacctcggccttcaagttgtgtctgcccgcctcttgctactgtcttggatattttaaagtccttttgacgttgttctgatttctgggcaggggacagagtaagtgtgtatttgctctgagactgttaatttggtatttccatcccaagttacagggaagacctcaggctgcaggttcctagctccgggctgaggtggcttgtggaggcagacagctgttgtctggaagtgcagagggctgggggctggccaggctgttactgagttcagaataggaggaaagagtgtgtagcaaagtcggcgctccttggccactgccagcattcagagttgtcttgtttgccttgccttaaacgttgccttcctggacgcctacaaagtcaggttgtaaccgctggccactgctgtgctcactggcagcccctgatttacgtgaggacctcaagtgtgtgttgggcagaattccccagcgcttcccgtacaccccccacccccagtgcagcatcgctcggtgcgtggctggtggactggaggagtgtgcgtgccggcagcactgccaggcacgtgcctaatgctctggccctgtgtgtttgtgttttcttcccgatttctgagcagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacgtaagtgcccttccgggagctcacacccgctctctgtctcccctgtccttcctctgcttcattttttcctggactctgaccgatgtttgcgttagagtatgtttgaacgtggggtcgattgggaaggattaagccttggtgctgaggctggatattgcaggaggatacagggtgaatggagccggcggggcggggcgggccgggctgctgtgccgtggctgctgttgtgctgacaccctctttcctagagaaacagcctcttattcacaaccagctgatttgaaatttcctgcagatcgaccccaagccatgcacaccccgggggatgcagccggagagaacacggccgaaggaaggatgggtaaggggctgggccgggcggcctccttgtgtgttctccactccacgtggaaaggaaatgcgtgccttcaatctgctgttgtcgctcgttaagattgagggcgacgcaggtcttctgggttggcactcgagcagctgaggatcacccagatttatcagtgccgtgagtgttttacagccaagaaaattcttactaatctatcttagggaaaaaaaaaatgacagctcatgccactgattatcaggagccagtcagcttccctctgtgccctgtgtgccctctgtgccgggcctgccccctcccactgcctggccctcctcagaggtgggccatccttccactgccggggctgggccgggctgtgtcagctcgtgctggccactttactgctccacttgagatcccctgacgtggcaacttgggttctctgacctgcgccctggtgcttgcctggccgacagggcactgtcctggcatggggtctccttggcatttgggtctcaccaccac

SEQ ID NO: 22139 - DNA, 1007 bp, Homo sapiens
gcgcacactcatgaaaccaccccgaacgtcacggcggcgagcactcaccccacgcgcacactcatgaaaccatcccgaccgtcacggcggcgagcactcaccctcaaaggtttatagtcttttattcaaagcagttggaacaacttaaaatgtgatagccttggatagggaaaaaaaaaaaaaaggatggttggtgggtgggggcaggaggagagcagccccagccctaagggcagcccgggagctggaccagagactcctggctctggccacccagtgagcgccgaggccccgggaagtggtgcccaggagcaggcgcccttgccagtgggaggccggcagaaggggctgtgtggtttgggccagtgtttcacacagctcttgagctgctggaggtttccgtagccatcattgtcacctgctggagatgtacagcctgaaatccagcttcctctctgctcatttcgtcgtcgctgctgcctttcccctgccgtcctaaagtccctgccttcacactggagcacttttccacgtggcagtggttgtaattcggaatagctgaggcaaggcacgcactgtgtcgtgggtccgtttagctgaaatgtagctctgcagaaatgctcaatccctgtctccttgggtctctctagaaaagtgagaaagtgtctcagcagagcccagtgtctttggacttagcgggcttgtggagtgttctgctctggctttcagctgactctttaaaccagcgcggattggcctttatgtcctccgcagctcgcgggagggtttggagggttcccgtgtgaactaactatccttcccttcttcaacagcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggcc

SEQ ID NO: 22140 - DNA, 1033 bp, Homo sapiens
agtgttggggctccagcctttctcagacagcagccccacggagcagctgttgcccgtgcacctcccccgctcagggagggcgcaccctgtgcgagagtttgggttcgtgggaacaggctgtgccctcggaagaccacctgtggtgctggccctggtgtccgtgctgacgccaccctctccttccaggtcacggaggtagtcatgatctatgacgccgagaagcagaggccccgaggtaagggcagatctagtttgacctcggccttctccctgctcctccctcagatggcaaactatctcacccgccaggcacacacaggtggcggctgtagcaaacagcctcaggaagggacgatttggagacaaatgactaaaacgtgggctcctcatgtgcaccccattcagcctgtctgtgcttcccgaggtcagacgtcacacattgttttttggcttgttcttttgaagtttttacgacttgtcatgagtctcggcctggcttctgtttttcactgtccggaagagtgtggtccttctgcatttgaccttccttcaccctcatccagtcctcccagtgtggccggtctcatttcgtgtcgtcagctgggtcagctggctcggtgtggagtttggattttccgtgatccatcccatgctttttttttctttctttcttttttccttttcttttctttttcttttttttcagttttctcccctctctgaagtcagcagggcaggtgggaggaggggtgaggagtcacctcagggcctcccctcattttccctcagcttcttgcacacccatccatgctggtttgtggagctgggacgatgggcgcccagtttctgtgccccttttccgtggctgctgctgtctgtcccgcccgcccgcatggttttggttcatcagctgcttttggccggccacgtgagcagacctgcagcctgggtctgcccgccacgtccgtgccgcccccgcaccaccggcccaggtcagtcggggcagccccgagcgccaggtggcgccgcagca

SEQ ID NO: 22141 - DNA, 1070 bp, Homo sapiens
ccctccccacggttaggagtgctcctcctccatgtcggttacgctgttaagtcttagtcgtaacttaatttagacatacatgcttagtgacgtacttaagtgtttcatagtaaagtacagtgatgttaagtaagctgtttttccttttctctctgtgaattgtgtgtgattaacgatatctctttagatttctcttctccaggtgctaaattatatcacacaggtacaggccagtcccgcagtcagaggagggagcggctttgctccagtggggtgtaaacgaagtttcaggtgtttctgtcccgcttcctcagtggtgatgtcgcctcttgacagccgcattcctagacagcgctcagggcgcctcccccaggacccagcgcctcttgcactgtgcccggaccaggcgagccctgtggtttcagacactcctgcagtttgcgaaaatgtctacttctaaatacgttgtttcatcaccgatgctgtgttccaatactgcctctgatcttgggaaacttgagcgcgcgggaatctgagggttgcttctagatcctcccggtccccctccggctgcccagagctggcgccccttctcctcgcgtcctgtcctgtcccgtgtggacgggacgtggcgagtgtcgctgagtccacactggtgtacagagcacttcggggccagcacgtggccacatgtccttagctgttgggctttgaaagtgtcccttgggtgtcaggcgagtggagggccggagagacgctgcggcgctgcttagcgggtcctcccagagagtgtgtccccttcccttggcctttctgcatcttctgagacgggtctgtgtccccctccccgccacctcctccctcttcctctccactgactgaaggtcatggccatgtccctgtcagggaccccgcctgtgtctcgggcacacagtgtctgtgcgggtccctgcttggccctcccacgtctaccctcggcccgcccgctccagccgctgcctcgttcgcctctcagtcccctcaggtcttctccatcctgcgctcctctcgctgtgtgccttgccttcctg

SEQ ID NO: 22142 - DNA, 1101 bp, Homo sapiens
agaataagtaggtcaggcctgctccatccattgtccccggccccgcaccctcctcctgagaagactgtggctcctgacacgtctagagaggaagggccccgggctgctgagcgaacacagtatgaagattgcttactgatccaaatgtccattttattgcatgtttgttactttttttgttagatgtaatgtaagattctcttatcacatccattccctctgacattagttttgagttaattgagattctttaagcgttagcctggggaaggtaagtctttatcttccattagacattttaaatttaaaaatctaagtaaaacaccagccgtgtttctcaggtatgagttaaaagcacaggtgggcgggctccaagcagtccagagggcgatgaggatgccgattgctgggaagatcctggtccctttttgtccccatgttttcaagaggaaggaggacgctgccattttacttgagtgaaagacccttcgtcacgcacgaaacccccgagggctctgggctcggtcctgctgccccgcagtgggcgggctctgtgtgtcttacggttgcatctgttgtacctgagaaacattttttaaacaaaaaaattcaacacaaaagaattttttaagaaaaaaatgctactggcctaaataaggtttatagttaagtatttagtcttaagttgtaagatgctaagtgtagtcataagttacccgagggtgtgtctaaagggaagggggtgctgggacccgcagcctcgccctaaaccagagctcggtttgtttaggtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggtaaggctgatgcagaggtgcccacgggaatgtcccccttctcggacttggcccgcgcgccctgggctgtgccgtcgctgcggcctccccacctctgctgtgcatgcacagagccgcggttcacagtgtccttgagcccccgcgaggtgccggctga

SEQ ID NO: 22143 - DNA, 1050 bp, Homo sapiens
agcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaaccactttgtgtccgttttttccctccttggtcttggcctgtgcctacccttccagtgcctaggaaaggtctgaaacgcgacggaggcgccctcgccctccccttggctcttggtggtctcagcaaccccgagggcttcagggcagaggctgagtggcgagctgggcccatccctcagtgggtcttgggatgctgtgactttgaggatgtggccaccaccagttttctcggggaatgtgggctccaggcttttcccatctcaagacctttaatcata

SEQ ID NO: 22144 - DNA, 1029 bp, Homo sapiens
tcaggaggcagagcttgcagtgagccaggatcgtgccactgcactccagcctgggcgacagagtgagactccgtctcaaaaaaaaaaaaaaattgtgtgtgtgtgtgtgtgtgtgtaaagaaacaagccccaggctgggcgcagtggctcacgcctgtaatcccagcactttggggggcctaggcaggtatatcacaaggtcaggagttcgagagcagcctgaccaatatggtgaaatcccacctctactaaaaatataaaaaattagccaggcatagtggtgcacatctgttgtcccagctgcttgggaggctaaggcaggagaattgcttgaaccagggaggcagaggttgcagtgagccaggatcgcgccactgccctccagcctgggggacagagtgagactgtcccaaaaaaaaaaaagcccccacgcagactattggtgtgccctggaactgagcattagctgttccctctccgagttctctcccctacttccccagccttccaggctgggctgtgggtcactgcctccgaggagccctcctggattctgctgaagatggtcaggcccctccatccccccattttctcttatgtacctgacagccctgccttaaaaaaaaaaaaaaggtagagcaggaattcccatttcacaggggtggaagccgaggcttggaggagtcaggactggtgcctgagttctcgcagtcaggaattgaccgcgctgggctgaacgcctctagggcaggttggggactgggtgtgttttctgggtggacatacccaggtcccggcgcggaccttggcctcctcatctgtgggcttagataaaggcctcccagcctcctgttcaccagggttgtcaccacgcagggtctgactcacctgcctggagctatgccggttcccagcccaggctggcggccgtgttctgctgggacctgggacctgggctgcctgccctcctgaggggtcccagtggtcggtcgcctgccttctgggtgggtgtggtagagggagggtcag

SEQ ID NO: 22145 - DNA, 1029 bp, Homo sapiens; identical to SEQ ID NO: 22144

SEQ ID NO: 22146 - DNA, 1047 bp, Homo sapiens
tccccccacctcggcctcccatagtgctgggattacaggcgtgagccgctggtacctagccatgaattgtgcttttgaaaatgacctgtcttggctgggcgcagtgactcacacctgtaatcccaccaccaggttgaagcgggtggatcacgtgaggttaggagttcgagaccagcctgaacgacgtggtgaaatcccatctctactaaaaatacacaaaaattagtcgggcgtggtggcgcatgcctgtaatcccagttactctggaggctgaggcatgagaatagcttgaacccgggaggcggaggttgcagtgagctgagatcatgccactgtactccagcctgggcgacagcgagactccgtctcagaagtaaaaaaataaaataaaaaaaaaagaaaatgatctgtcttctggtaggtgaattatatcttcgtttttaaaaaccaatggctgtttaaactctgtgcacaccaggggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggccggctgtggacccccgcggcctgggg

SEQ ID NO: 22147 - DNA, 1045 bp, Homo sapiens
tttcccctgtgtctccaccaaaacgaaacgctctgggctgggctgactgatgagtttcccaggcaggcagcccccgggagtgtgtgcaggtacgcgcacgcctgccttgacgtctctagggccgagagtgttttgctcagccccccacagtgagctctgagagccgctcctgcacagacgagagggaacgggagacctgcatgcaggggagccgggtctggacggggtcccaatgggagggccaggtctgggggtgagaggccaaccatgtgtcctgcaggaccgtgcagcgggcaaatggggtgagatgttggaggagctggctctgttcccttcaccccggtgggaggcgaaaccccaagtggtctgtagtgtctggatttactgtgcctgctgtgccttcggacttccttgtgtgtctaggggcttcctgtctgatttgaacctgtctagttcctctgaagaggatgagggagcagcgcctcattgcctgggctctgggcaggtctgggagccaggccgtttgcaggatggcccgcgatggtgcagcactttgtgcagacagattttgtggaattgccgatttgggtttcttcttttcttctcctcctttttaataatacagtaattactctgggctacaaaggaagtaggcgagggtttttttaattgaaagttcctgttgctcatcccaagcttaggggaagccagtatgccagccattaatttggggattggggtagtcctgttggtgtgccaggcacggttgggagggggggcactgtgtcttttggaactggtgggggttaccgcgcgcccgagtggcagactctagcgccccagcagatgcgtccgcagagccactgggacggacggaagctgagcttagggacagccggagttgcttgccctggggcatctggagagggggatcctgttgagcgtttgatgttgcctcctttctgcaccccccaccgagctgccccaggcccccaggggctcatggtccgtcaaggccttgaccgaggcctggcggagggcgggt

SEQ ID NO: 22148 - DNA, 1055 bp, Homo sapiens
gtgtgcccgggaggtcacgtgggcaccacagacgaaagtggagccgggggagagatgtcccgggatgcaccaggcgctcgtgcaaaccaagtgctgagcagagagcagcctgggagagaagggggctgccccgagcggcttgggtggccgggcctgtgggagaccttgggtttgctgttaggagggacagtgagcgcaggcacctctctctccacttcatgtttgtcctcactgagggagccgagcagatgcctttgcccctgcaggtcccccatgtcccctcgcccggggcgcgctccacaggctaggccactttcacagctcaccacacaggcagagactggagggtgcgcaggaccccgggtgactgcagacgtgggcacagaggggcctctgagggcgtctggcggcatttgagcagctgccagatctcccctggaaacactggggtgtgtgctcggtgggtgccgtgtgtggggggtatgtgctcggcgggcgccgtgtttgtggggtgggagctaggcgggcgccgtttatgtggggtgggcgctcggcgggcactgtgtgtgtggcacggccactgcttagggccccctggagctgcggggcacacggcagagccagcctcatgtcaccacgtgcttcccccgtgtgcagggaggggttggaggtgtgcgcttgtcttgtccggaagccgggtgttgggacgcgtcctgacgacggcactgcccacatcctaatgggacacctgagggacatcggtggctgagtaaggggcccctcccgagcaggtctggaggcgttggaagcacagcgcagcctcatggggcacctgcctgctctgcctggaattgaggggcgattgggactcccactgcccccaccaaagcctgtgcccctgatgtctgtccagagcacggcttccttctcggtggttcccagaggccgctgggcctcgcttcgtcctttttgggcagcgagtgtgtatgttaggggaacaggagcccggcagggccgtcttgcagggctcagcagtgggggccgtggggttggtg

SEQ ID NO: 22149 - DNA, 1048 bp, Homo sapiens
gccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagcc

SEQ ID NO: 22150 - DNA, 1070 bp, Homo sapiens
tcctccttccctgtcacgctgtggctttaggaggcccacgagtcccgcgctttcctccttccctgtcacgctgtggctttggcctcaggctagagggtcggtgtctgtcagcctgtgctcagacgagggcgaggagagttctggtcagcgcgtccagcctccctcctgtgttgctttgctgctggaaaaagagggtcctgatgcagaccccaagagaggagagaactcgaggtgagccgcggatcacagtgagagcagccaccaagccgcttccttacacagcgggcctccctgacagagcagggcgtcctcggggagcaggcagagggtgcctgctcttccttagcgcctccgtctgtgagaaacggccagggttgcgagtaaacctggaacgtgcagacactcactggaggccagccgggtggtgccatccgaccacccttcaagcccagcctgctcaccggccctctcagtacagcgggcacgggttctgcgggctgcccggaagacctcccccagacccatagatgctctgtgtccttggtgggcagctcataagtgtgaaccttcccggtaccttgcgagtgcctcactacgcacttcaagacggggtcgctccggttgtgttttatgaaaccagaggcctggtgagctgagcttcctctcacagcttcacagcagcctgtgtgggtggcctcagccctcctgagcccctccagtgtcgagttgctttgactgtttccagggaactcctttggttgttgcgtagcttgggctgtttgtttgtttgtttgagacaaactctgtcacccgggctggagtattggagtttagtggcgtgatcataacagtgcaaccttgaactcctggctcaagcgatccttccacctcagcctcctaaagtgctagcactacaggcgtgcacagctgtgcccagccagctggggctgttgcacatgggctagttattatcaagtcagctgaagccttgtcagccatccttggtctgagctctccctggctctcgggcagcaccgtcttcctcctgtggaggtctgagtccccttttc

SEQ ID NO: 22151 - DNA, 1054 bp, Homo sapiens
ttcctttccccagccctgaccgggctccacccagaggggagaaatcgcaggaacccagtggctcccagaccaggcccatcctcccaggtgcccggagactctgctttcgtcctgcttcccaccagctggggagctagacctgtgcaccctctactgctcgctcccagaagctgccactcgctagcctgggccccagcccgggccccacccacggctgcagcctgccgcagtccttccctgggcacacctgctccctccacagcggctggaaaggtcccccgcggaggaagaccccaggtccctgggctcccggaggccctcgcgccctccctgcatccccagtctccctcggcacccctgcgtctgggccgtgccctgcccctcccaggttggggctcccacctgctggcattctttcagcctctgcctgcactcagactctgcttgtgaggtgtcgtctcctctcaaccacgggcggggctccttgaaacgaggccctaggtgtgtcttcagcagcagcgtggcctggctgaagcacagatgagcggcccgtacacgaacagcctcagtagcctgacgaattcttgataggaccaccccatccaggctgcagggctgacggggccacccaagggtcagacagtgaaggccccttctccacagtgtctaggctgtccctgggctccttggacctcgatggacatgtgaaccttgtgcctgcaggcacgcgagccccacgtctgccccctttccacagtcctggctttgacgtggggaaggggccccaggggcagggaccaagaggactttgcacagactgggtgtggcagctcacgcctgtcatcttagcacttggaaggctgagatgggagggtcacttgaggctaggagttcaagaccaggctggtcagcatagcaagatcccacttctgtttatttatttaaatttattttcaaatttaaaaaatgcaataaaaagaatgtgtatcgtctggacgtggtggctcacgcctgtaatcccagcactttgggaggccaaagcaggcggatctga

SEQ ID NO: 22152 - DNA, 1048 bp, Homo sapiens
ctggcctcgggtgatccacctgcctcagcctcccaaagtgctgggattacaggcatgagccactgcaccgcgccgagaatgttttttaaagaagcattatttgtaggaggttgggcgtggtggctcacttgaggccaggagttccagacaagcctggccagcagggtgaaacccgctctctactaaaaatccaaaaattagccaggtgtggtggtgtgcgcctgtaatcacagctactcgcaaggctgaggcaggagaaccgcttgaaccagggaggtggaggttgcagtgagccgggagactctgtctcaaaaaaaaaaaaaaaaaaaaaaagttatttgtagaataggcttcaacttggaaggtgtttcctagtgttgcttgtaggcaggtggacaggacccggagcccagtgtgtgtgtgttccgtgtcattgttccttctctgtcaccttgagtggtgtctgctcttctgtttcctctctcctgtgtggcagtaagcagtgtctgtgtttcaggtggcagaatcgtgtcctcgaaaccctttgcacctctgaacttcagaataaacagtagaaacttgagtggtaagaaactctcatgttgttaatgatgaacacgggtaattttaaccatctgacacgcagtattcctaggtccctcttccttgaccctgtggacactggggctggatccttctgtggggtggggctgtcctgggcagtgcagggtgctgagcagcgtccctggtgtccacccactccatgccaggagcacccctggtcgcgacaaccacacacgtccccatagagcactgtgtgccatgggggtagaatcactcctcggggagaccccggcttcgaggggaggcgtgaaggatttacaggacttttgtggacagagacaggcccacggtgggaaggagccggcccctcccatgccccctgcctgccttactgtgctgcgtgctctgtcagctcccagccttgcggggcagcacggcctcctctgaggggcttccctgaggagcgcccacccgggaggtgcct

SEQ ID NO: 22153 - DNA, 1063 bp, Homo sapiens
cctgcggggccccaagcagcccactgctgtctctgggcctcagtttcctgatttgtgccacagaggacttgcagtggacagagttgggcccgtggcccccttgagtctgagctccgcgtgcctctcggtgcaggagggccgtgggcagcgctggggcttcctgtggctcaacctgctctccttccaggaggaacaggaggcagcccggcgccgccagcagcgcgagagcaagagcaacgcggccacgcccactaagggcccagagggcaaggtggccggccccgccgacgcccccatggtaaggccccagcctggctcctgctgctggagggcacccgccccctgcccgggagaccccatgggtgggaggctctgtgcccatccctgttcttcccttgtgtcctccaggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccagggtgagccgcccccacgccacggcccccgctctccccgagtgcggatgcctggggtcccctctgctgggacgctgccctcctgagccccgtgtgttcagggtgtccctggagcctccctgttgtggctgtgccttcagggtggccccatcctaaggggttgctgggcacctgccccatgctgacgcctctgcccaccgctctcccgacccgccctgtgctgacgcctgccctccgctctcccagatgcctacagatcccctcacagcccgttctaccagctacctccgagcgtgcagcggcactcccccaacccgctgctggtggcgcccaccccgcccgcgctgcagaagcttctaggtgagcccgtgtgaggcgtccggcgaagggttctgggcttggggtcatcccaggaggaccgtg

SEQ ID NO: 22154 - DNA, 1050 bp, Homo sapiens
actcccaaagtgctgggattacaggcatgagccaccacgcccggttgtaggtgttttctttagggttgtcctgctgcattttgtgcattgcaatcccagtcagctcagggactgttcaagtatttgacttatgatctaagtagctgggcaggctgattaagaacagacaaagccagctcttttgcaggctggtaaaccttcatcttaggctaaacttctttggttcgggtgagggcaactaagccgggggaagcgggggcaggggaggctgacaagcaggcatcagcgatccaagcaggggcctagtacatgctgtctcttctgtagtttgctgacctaagccaattcaaggcagtttgtcctggaaatggaccactgtatacatgatttccttcacctgaggtcccggctgtggggccccgccctgggagtctccgaggacctgctttagtggggagctagggccgggctatggggtggaagttctggcggcccagagataactccaaaagccattggagccacaaggtcggctgtccctgagccctggtttgcattttggactttggctttgcttttaaaaaaaagcttacagcgtgctttgagcatatatgcacatgcattgctcactgtgtagctgacagcatgcctgggccggggccctgttctctgctggtgtctgaaggttgtcctgtgtcagtggctcctggggtcttcccttggaggtgggcctccggacactgagtgtttgctgttacgctgcagaaggcttccttgcagatccatgtgaaaagtccatcccctggtattgccttgggataaactccttggcattggccggcctctgcgtggctgggggcgctgccctggctgagtccaggtggggtggcaggtgcagtccctccagctggcgagagttctttgcagtgaacctgatgcagagctggtcccctcccgccgtggcctgagtatttcttgacatctcagcccggtgtgggtcccctcaggcatgtctgtccttgagcgtgtcttcaggaagcatgagaggca

SEQ ID NO: 22155 - DNA, 1033 bp, Homo sapiens
agccgggtgtggtggtgtgtgcctatagtcccagctcccagggaggctgaggcaggagttctggctcccaggatggcatccccaagggccatattgaggcaaaaagggccgtgtttgagcccgggaggtggaggctgcagcaagctgagattgcaccactgcactccagcctgggtgacagagccaggccccatctgaaaaataaaatagcttgtactttctgacaccgagaaacgcattcgtggaggccgagtagaggaagtgtggaggagggtgtgcagcgggaaggtgctctcctccctgctcccaggcagaggcaggtgctggtgggcggtgcccacagctgccgtgcagcctagaaagcagcaggtcacgggctttgttcccagagccccatcccgtcgacactgtgcccgcctgctcaccttacgtgtccccagcgtggtttcactgttgatggacctggtgccctgtcgctggacctctgctgccttttcaaatgactgcaccaaaccgttgctgcaaggctgtccccggaggcgggctctcacgggcggctgacggacgtcgggaagcaccactcacgtgctcccgagctgctccctcacgtgtgtggcccaggcgagcctcaccagcgtacattagagaaacggaggtcgccgacctctttaccacagccgggccctgtgggtctgcctggagtagagccctcgggaagagcatatttgggttctgaccatttttgtcatcatcttttctgtgtaataaaaaaacaatgtgtttgttaaaagaaaggaaagcaggtaaacagaacagataaactaaaaggaaaaagcccctctcagactcagcgcccggggaagctgccacgctcgagtggcgtgtccctccacaggttttacacttagtgaaactggatgttttacacttagagtctattttgagagacgagagctctttgtatcttcctgttgctctttttgaagaaggtgcttccatgtcagcaaaaaccatcctcggccctccacatgac

SEQ ID NO: 22156 - DNA, 1030 bp, Homo sapiens
cggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgaggtgagtgccctggtggggctgggggtctgcagctggtacctgccgactctgcctggtgtgctcaggctgtcgggttctcagcaggagtgtgtttgttgaggagactgaggtggggaggtgctgggccaggccgctgcctctgagtgccagcccacggccctcgagagtgactgcagcttctcattccagagctgagcacaccaaggagaacggccttccctaccagagccccagcgtgcctggcagcatgaagctgagccctcaggacccgcggcccctgtcccctggggccttgcagcttgctggagagaagagcagtgagaaggtgcgggccgcgacccctgccccgggctcagggaggtgctcagcagaggcggcctgagcgagttgctagcaggagggcttgtcctagttgaccttggggcacggtgaggtactggggctgacctggagtaggatgttgtggcagagttgggggcaaccagtaaggacaggtcacaggtgacgttgggcaggtgccatggaggacatggggtttgtcagggtgtccctgatgcctcttagttctcagtgacggacggcaagtgctggtagagacacagagcccagtttgggaggccgctgcccatgaggacttccccgggggcactggcctgtgtgcacagggatggagagggaaggacggt

SEQ ID NO: 22157 - DNA, 1373 bp, Homo sapiens
ggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccag

SEQ ID NO: 22158 - DNA, 1050 bp, Homo sapiens
tatggggtggccccctcagggctggttagaccctggcgctgggagtgcagggtgaggggcagtctcgagggctccagcccagcccgcccagggaggtcccagcagcagccccgagttctgagccatcttcctcactctcctcttggcctccacaggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggtgggccagccaccgtgcagctgcctgtggtgggtgctgggctttccagggcagccctggagagggtgccagaggctcttcttgggcctccgcccaggctgggcgatgcagccccgtgtccagacgctcccctgttgcccccgagcagccacagctcccatctgtccaccccagagagcagaccctctgtggctctgagtcccatgtggacatgttttgttctgtccacagccttctgttttgcattatttaattttctgggagtggggagagctgatgtcagtccagccagatgtggtgaagggcagcctttgattttagcttgtgcagaggcaggggtgagccgagtcccctcagcaccgtggacatcggggctggagcactctttgtgtaccctgacatgccccacgggcctggcctatggcaagggctctgttaccgtccccgtcttccagatgaggtcatgggtagagggggtgccacagccgcagatggtggagttagactttgaactccagcgtctgagacgagatgtgtgcgcccggctgccccagcttagggcctgcagatgggcgggtctttgggtcttcagtgtagcccatttgcttttcttgtgcctgtgtctgccttgtgcctactgctggcgtggtggcgtgggcagtggacggctccctgcctcgggagtgaccggcggtgctgtcctggctgtgcctccctctgactcagaaccac

SEQ ID NO: 22159 - DNA, 1003 bp, Homo sapiens
gatagcccaccaggggtggggagggtgagcagggacagggcgcccccactgacttgggaccctcctcctccaggcccacacctcagcacccaggacatctgggccccccgcccccagcgctgtctagtttggttgcctggccgtcactcccagcctggttcccactcctgtgtcttctggggatggccctcaaggacggcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaaggtatgtggggcccagccccaagcttggcaccgccgtcttccttcaggtgggccgggtcctcctagggaagatcaggggctggcagagcccccaccctgggcagggaggctgtggtcttgttcctaggactgggttgcgggtccgtggcctggaaggtgggcaccacactctgtc

SEQ ID NO: 22160 - DNA, 1043 bp, Homo sapiens
ccccccgccctgggaaggttgggctgtcctgggcggcgccgcccgaggagtcggggctcagtgactgctgcccttgtaggtgcttggggcaggcgttggagctgccttcgggaagcctcgggggtgtgggaccgggtgggcccctgcctgggcggggcggggtcttttggccgaggcaggggtggggatgtgctgaaggccgcccggacgccctggaggggtctccgcccggagcctggcgctgcctcgtgacctgcatcatcttcagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgtgagtatggggccgggcctgctggggctgctctggggccacaggtactttcttgtgcaccttgctgcccgtacctgtgattgaatgtaatcgtgggaaccctgagtttcatcagagccggcgcacagtctcctgcagcccaggcgttgcctgagctcaacacggcctaggcccaagctttagcgctgccgggttcttggagtcctgtggggtgagtcagggttctgaattgggctgcaccccctggacaggatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacaggtgaggggcaaggacaggcagggagtgctcacccaggggagcagggaccaggtgaggggcaaggacaggcggggagtgctcacccaggggagcagggaccaggtgcgggttgctgcccaaggggtgcagggacagatgagggagggcactgccttcaggcagcacatatgggggccaccatcgctttgttggtggggacagggtc

SEQ ID NO: 22161 - DNA, 1074 bp, Homo sapiens
ggctacgcgcaggaacgaccccgctcggcccgtcttgggggtccagcctcggggatccgccgtccccgcgttgtcggccggcggtgccggggctcggccgtgaccttgcgggtctgtccccggctcctctcctttccccgcctcggaggccctccgccgctgcagcgccactcacttcccaccgggtctgaaatttgtgccccctccatcctccggttctgcttctccgtttcggggtctccagttgccgccggggacgcctctctccggctctgtggccttgagcaggcggctgcccacccctctccgagcctcagtttccccttaggcggaacgggcacggtgctaagctaacctcaccctagggggtgcggtgggggaacccagaggcgtcccgcgcgtcccccagtaactggcagcatcctggagcggccaggagtccagccctgcactggggtcggatccccgctccatcttttactccgtgaccttggacgatggaattcgtgtgcagaaggaggaccgactatggtgtggattctggaggttctgtccagggtgaccagcgcccagggccaacaggccttcattatgttcattgtgtgtcatttgatgtaaagagtgtcaggttctagtggggacagtctacgagatcgcactgtcataactgcatcttttattttcttaattccaaatcttccctctctcctgagttcggtggctcaggcaatggaacctggagcagccccacaaatgcagcccttaaccttcactaccccctcagagttctcactcttaaggcgtcgccgccacctggctcctcagtctccactcctccagccccaccgctatccctctgctgtggctgcctttgtccaccacatccccagtccatcctcgacacagcaggggtgaccctttcaaagtatgtcagaccgtgtcgcatccagatgagtgcgccgtccagttgtgacctggctgctggggaagcctgcagctcattgcagtcgcttcactctctagtcttttctcttaccctgagatgcccctggtctctgcaaggctgtcgggccc

SEQ ID NO: 22162 - DNA, 1061 bp, Homo sapiens
cagggggcttcgggctggctgccgggggggtttgtgcctcagttggtgggatcagggtggtgggtgaggcgtggcccctgcaggccagggtctccagccccagccccacagcccacagctgcacgtcgacccatggctggcgggtggctctgacgcctgcctccggtgtgttccttgaggcagcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaagtgagtttcgcatcgtgcgtgtgctgtgacggggtcgggcggctctgacacgggccgggacggccagtcttccagaacagcagtgagtgctttggcctcggcaggcacggctcgccccgtggagcccttcgtttcttcctcaggaggtcctgggacagaatcagtctcttttcctgccagggtgggctccgggcacctggtgggtgtgtagggctgggcaggtgtggatgtggcaggtacgggcgtggcaggtgcagggctgggcaggtggctggggccagctaccctcttcctgctgagccgcctgggtctggggaggccccatgtccagggctctttatgcagatccaagctgcggttgctgcccacacgccagcctctggcccggcctagtggccaccccagctcaacccagggacgcgggccctgccaccctctgctgtgtggtctcctctgccctggggacgttcggggcggttccttgcacttcagtcccccccgggtcccctcctgctcccgggttttctgccccgttcccccgggtggctgtgggctcccgagccccgtgtcggccagccggccccagggccccacgaccccatggtgtctcccaagaaggtacatgaagcacaagcgcgacgatgggcccgagaagcaggaggacgaggcggtggacgtgacgccggtgatgacctgcgtgtttgtggtgatgtgctgctccatgctggtgctgctcta

SEQ ID NO: 22163 - DNA, 1059 bp, Homo sapiens
gctgtcgctgataccatctggcacttcctcccagccttcctgaggcagccaagtacgcttggctttggtgtgtattggagccacggcacgtttaactggcagaaggaagatgtgaaaatattttgaatcctttgtacacaaagagaaaatgaatcttttcagttatttccaagccaggaaactcgctccgtcacatgaagttagagcaggcctcagtcagctgggcgcaggggctcacgcctgggatcccagcatttggtaggccaaggcaggacgatcactttgcccaggagttcaagaccagcctgggcaacaagcgagacgccctatttaagaaataatataaaatcagaaaaaataactggccgcagttctctgggtgcttgaagtacgtggcgcctggaattggctgtaccagcgtctcccatggaggcctctgctgttagcagccgccccgccctggagatgtttttatcccattttcaaatgaagcctttgatgtttgagacgctgaggaacgctggggaactcgtccagcaagtgacaggcagagcctgcattgggggcaggggccagcggggaggggactctggggcttcgtggggccaggagagagccgaagttgcggctggctgcaggggccgtggccttgtgcaggaggcagttctgtgctttgccccagggcaccaaccgcatggcagccccacccactgtggacccagaggttctttgaggaaacctggtgtggcacaagttttaatttaataaacagtttgggcacgggggctcatgcctgtaatcccagcactttgggaggtgaggcgggcagatcacttgaggtcaggagtttgagaccagcctggccaacatgacaaaaccccatctctactaaaaatacaaaaaaatttgcctggcattgtggtgtgtgcctgtaatcccagctacttgggaggctgaggcaggagaattgcttgaacctgggaggtggaggttgcagcgagtcaagatcgtgccaccaaactccagcctgggtgacagagtgagactccatctcaaaaa

SEQ ID NO: 22164 - DNA, 1031 bp, Homo sapiens
ggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgatacatatggcccggcctctgcctccgcagtgcacggcttggggcatctgctctgtgcaggtcccggtgagcagaactgagagctggcaggccgcctggctgtcctgcagaggacggattggaattgccaccgcagggccggccagtgctgtgaggtgcccagcgtcactcccatgggctctgtgggccatgtggtccctgtcacgcttctcagctctgccactgttgctggaaagcatcacagaccatgtgtaaaatgggccaaaataccttttacaaaattaaaatagagatggggtcttgcagtgttgctgaggctgatctcgaactgctgagctcagacaatcctcctgtctcggcctcccaaagcgctgcaattacaggcacgagccaccacgcccatccct

SEQ ID NO: 22165 - DNA, 1038 bp, Homo sapiens
cccggtctctccctcccctcacgccccgcctttctctccagaacatcaaacgcatcaagaagaagctgagccttctgtgcatcgacttcaacaagaacctgaacgaggacacgaccttcctgcccttcacgctccaggagctaggtaggggccgagcagtggggcacgggtggccatcggtcctgggactcagtgcaggcctgccaggccctcgggggccgccgcttcctcctgtgggcttctgtgctgaagggcggcgggaggccgaagtacgtggacctgaccgccctgggctgaggactttcctcaccggaagcgctccagggccgtttacagccaaaagctctgagccctccttggggagggccatggtctgtcccaccaagattccaccctgatagaaaatgtccctggcagtggcggaagcccaggccggacggggtggccaagggtgccagtctcagccatggccctgagggaaccacaattttcccttgagaccccacttcctgcctgcctttatttatttaatttaattaattaattaatttattttgagatggagtcttgctctgttgcccaggctggagtgcagtggtgcgacctccactcactgcaacctccgtcccccgggttcaagtgattctcctgtctcagcctcctgagtagctgggactacagacgtatgccatcacacctggcaaatttttttatttttagtagagacggtttcgccgtgttggccagggtggtctcagactcctgggctcaggatctgcctgcctcaacctcccaaagttctgggattacaggcatgagccaccgtgcccaggcaggccggaatattctgatgggtgctatagaatataacctccagttctagactctgaatgtagttgcctctgaggtggtgggtggggacaaggccctcatggccggaggcctccgcaggtggcttgatgtgtggtcacctgggcgtatgtttcctgagggaacactcgcaggtcgggcactgccaagcttggctgccagccactt

SEQ ID NO: 22166 - DNA, 1049 bp, Homo sapiens
ctcccaatactgctacctctcaataccaccacctccaacaccaccatctccaacactgccacctccaacaccaccatctccaacaccgccacctccaacaccgccgtctcccgatacctccacctccggacacccccacctcctgacccacccacctcccaacaccaacacctcccgacacacccacctcccgacacccccacctcccaataccaacacctcccgacacccccacttcccgacacccccacctcccgacaccaacacctcccaacaccaacacttccccacacccccacctcccaacactaacacctcctgacacccccacctcccgacacccccacctcccaacaccaacacctcccgacacccccacctcccgacaccaacacctcccgacaccaacacctcccgacaccaacacctcacgacacccacacctcccgacaccaacacctcccgacaccaacaccttccgacacccccacctcccgacaccgccacctcccgatacccgcatctcccgacaccaccatctctggcattaagttcctggtgcattttggaggggacgcacccaaccagagcagagacctgtgagtgtccatcactcgcacattgtcatacactagttgccatgtccatggatgacttctgccgccctcaccctctgggcatcagtcatcctgccgtgactccgaaccttccctccttgcctgtcttcttactgatttgtttctgtccgtgtgcatgaggcttctgtcttattcccgggttatcattcattatcatttatcccagtgctcaaatcgtcccacatggaccctcaggagtccctccgaacaatccctgtgtccttgtaatgcacctgctgtcctctgaacctgctcttactgtggggcacatggtaccgcaggctcggcctctgagcccgcgcttactgtggggcgcgcggtaccgcaggctcggcctctgagcccactcttactgttggacatgtgatgtcgcaggctcgtcccatgctctccctgccccagccctcagat

SEQ ID NO: 22167 - DNA, 1033 bp, Homo sapiens
gtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggtgcacccgccccgtccggggaagggtgctaacctcggggggcggcacacagctggggcctggcatgtgccccgggtgggggtcggagctctgggcagagtgggccggggcaggtgcagaggccagctctctccttccctcccgcccaggcctcttcaacctgcgccagatcgtcctcgccaaggtggaccaggccctgcacacgcagacggacgcagaccccgccgaggagtatgcgcggctctgccaggagatcctcggggtcccggccacgccaggtagccacccttgagccgggcacaccctggaatttggagcctcagctgcttccctgggaaggtgaagggagttggtccccatgcttcacttagcaagtgcaggagtccctgctggggagccacggagcgcgtcccaggctcctcgggggacagccccagctgagatgcagctgcaggcccagggtcggggacgggtgtgcggccccagcccccaggaggagtgtgttccctggagcctctgctttgaatgaagctggcgttttcctgattgaaatgtatgacacatgctttgtaaaaagcctggagaagtacaggaaggcctaggaatttccgatcctaatgatgagaagtgggccctgtttccatgctcacctgttgtcctgtgtgcatgtgtgttcacacacgcttgcgaggatccagaatttggaaatacagc

SEQ ID NO: 22168 - DNA, 1033 bp, Homo sapiens
tccccaccgtcctggagaaggtttgctggtgaacctccttctccccaaggcacacctgctgcagggagccagtcgggccagctgtaaagtgttgtcactccaaataagggccccttcagtggtttacaaaacagaagctcttgccctgccccgcccctgccctcccgagctcctaggttagctcctgggccgggggcggggcggtggggaaggtcggaaatgcgtgagaggcagcggtgacggaggagggggcgtgctggtggcggtggctcttggggaggaggcaggtcgcatgttgtgtggggaacacgttgcctctcctgccgtgagcctcttagggccctccgtgtcccgggttacagaggtgccttggatgaaacgccttcctgatttttttccccaaacttgtgttttgatttacctaagggttctaaaatgggccatctttccagggggccgcgggtaggcagagccgtggtcctcacgtttggaggaaatgtgcagtgcggcccgcgtggtggcactttgcacagagtggcactggctggcttttgtagtgggtcgtggactttgtttggatggaggggagttaggaattactggtgtcataaagatcttaccagatggccttgccctgtggctctgtgacctccagaacccccgccgccatccctgcatgcacccggtcttctgtgcctgcactttggacttgagattgacacggggttcaaggacgaaggtcaggggctcccgtgtctgccgccttggctgcttggagcaagtctggaagtgatgcggcccttcccgcatcctctgtccagtgcccgcctgtggcccgggggtgtctgctgcaggagcacctgtgtctgcagtcccaccccctcccactctgtgagcctgaaagttgacccctatcagcctgtaagacgggaggttgctgtcaggctcagggccaggcgtggcagataggacagtgaggaagatgtgagctcacgtgcgacccaaggaggactggtgtcagtgccacgcagag

SEQ ID NO: 22169 - DNA, 1050 bp, Homo sapiens
tcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcct

SEQ ID NO: 22170 - DNA, 1041 bp, Homo sapiens
tggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatc

SEQ ID NO: 22171 - DNA, 1028 bp, Homo sapiens
cttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagaggcaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccgccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgct

SEQ ID NO: 22172 - DNA, 1049 bp, Homo sapiens
tgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagacggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctgtctcagtctcccaagtagctgggattacaggtacgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaagttcttacccacgactgagccgcccctgcagaagcggagggcttacccaacatacgggtacactggcgctcacagggcctagctggtgtctgcagggtgcc

SEQ ID NO: 22173 - DNA, 1067 bp, Homo sapiens
agcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgc

SEQ ID NO: 22174 - DNA, 1028 bp, Homo sapiens
ttcctctgcctcagtgtcctcattcatggatgggatgaggggcacacaagcagcctgcctggccgcgcctcattcagtcactcagccgccactgaccacgaatgacacaccgcccccacaacggtgaacacccccactctctcttggcttcctactccgtctggttcttccttcaggcttcttcactggcccttctttctttatttaatttttgctcgtagtagctttatttggatacacttctcctgccgcacgattcactgctttagagcgtgcagttccctggtttttatatgttcacaggctcgggccgccatcacctctgcccaattctggagcattctcattccctcaggaagaaaccagccttgaccccatcagccgccaccacctgtctcccctgcctctgtggctgggcctgtcccggacatttcatagaaatggaatcccacattgtgtggccttttgtgtctggcatctctcactgagtgtgatgtcctcaaggtgcgtctaggctgtggcctgagtcagagccctgctctttgtcgtggctgagtcatgttccgtgatgtggaggcaccgggttttgtgcgtctccttattcagtggacgttggtgctgtttccagtgtctgcctgttgtgagttgagctgctgcgaagaggcaggcgctggtggttgtgtggcgaccgtccttgttgctctgtgactgaggcgctggtgcctccactcgccggctgatcgtgtctgatggtgtcaaccccatgcaaccaccgtgagcccagctctagagacctgccttccaacctttccaccttgtcctcctgcccccagcatgtcccttccaccccagccttcccaaattgctgcacggttctgatttttttcttttttctttttcctttttgagatggagtctcactttgttacctaggctggagtgcagtggcgcaatcacaactcactgcagcctcgaccttccagcctcaggtaatctgcccacctcagtctcccgagtagctgggactc

SEQ ID NO: 22175 - DNA, 1045 bp, Homo sapiens
gtgcattgtcacaactggggggcgctcctggcatggagtgagtggaggccagtgatgctgctcagcgccccgcagagcccaggactccccgccatagacagcgttccggcccaaatgtccgcagcgctgaggttggggccctcgccatgaactccccggactgggtttctattgctaccgcctcacctcgcctgggacccgtgggtgggagctgcatgacacagacagagatgcagagatgtgcgggcctcgggaacctgatggcgctccatccgatcctgagagaccacaggcgtggtgccacgctgccttcctcctcacgtggggcactgcagccttttgtgctgccgcagacccaggtgtcttttaggtctgaaggtgtcatcaagtcagacagggctgtgggtactcggtggtaccaggaggctggagatgagcaacctcgggtcttttatctgcaggcaccatttggaagtgtggagagcagttctcacgggagtgggctggaggtgggagctgccccccacacagggaagagggtgagagctgctggccgagtagaccctggggatgcttctcatccactctagactgctattcactctagactgcctgccggctgggtacagaggctcacgcctggaatcgcagcactttgggaggcctcagcaggaggattgcttgagcccaggagtttgaaaccagcccgggcaacatagggagaccctgacccccatctctatattttaaaaacaagaagagaaaaataggctgcacacccagtgggggcagcagcttggctctgctttgcggcgcctgggtcagcacctagaacccacatggcacatggctggttggtggggaggcgtcggctggcaggtggcggcgtgagtaaatgaatgaatgacgtgcacggggtgtattcccggggcccaggcaccggcctccaacagtaactcgcctcgccatggctcacacgggcaccctggaaggcacgctgtcccctgccaagggtctgggccccacccttttttacttggctact

SEQ ID NO: 22176 - DNA, 1027 bp, Homo sapiens
gaggtcaaggctgcagtgagccgaaatcgtgccactgcattccagcctaggtgacaaagcaagactgtctcaaaaaaaaaaagagggtctcgctcggttgcccaggctggagtgcagtggaatgatctcagctcactgcaacctctgcctcctgggttctagcgattctcctgcctcagcctcctgagtagctgggattacaggcacccaccaccacgcccggctaatttttgtatttttagtagagacagtgtttcaccatgttggccaggctggtctcaaactcctgacctcatgatccgcctgcctcggcctcccacagtgctgggattacaggcatgagccaccgcacccagtgcaagaccctatttctattttttaaaaaaatggagatgcagtgaatgggctcccgcaagtgtgtaataacgggggtgagtgcatgtaccacctgctcctgggaggaaacaccagaaagtagtgagtggcaggtgggtacggggccgacagcaggggtgaggggctcatttctcattgaatattattctgtgctgttttgtttgtgttgagacagagtctcgctctctcacccaggctggagtgcagtgacgcaatctcggctcactgcaacctccgcctcccgggttcaagctaattctcctgcctcagcttcccgagtagctgggaccacaggtgtccatcaccacacctgactaatttttgtatttttagtagagacggggtttcaccatgttggtcaggctggtctcgaactcctgacctcaggtgatctacccaccttggcctcccaaagtgctgggattacaggcatgagccactgcgcccagacaattttgtgctgttttaattgtgttttaaaagctacatgtgtcttgcaattcatttcaaaagggtgaggttctcctgatcttgaaattgcctttctagtggaaaagccgagtctatgtggggtccctcaaacaggctctgtaactgaccaggctactcccatgttctgtgggcacctggg

SEQ ID NO: 22177 - DNA, 1077 bp, Homo sapiens
cagcctcctgctctgcttcctgcccactggtccccctcccatggcagcctgtgaatgttttcactgatgggtagagtggtcggcatcacccctgtgcctagccaggggcacctgttccccgcccctccaggacagtgccccctgtgtccctcatacctgactgtgctgcctctactcttgatctgggggacctgggttggggaatcagtgctggtagctcttagctggacagggtgggtccgggagttagagaacttgtatgtgccggggaggggacagcctggggagggggccagcacatgggccagctggagggggaatggtcccatccgatcagctttttttttttttttttttgagatggagtctgactgtcgcccgtgctggagtgcagtggcgcgatcttggcttactacagcctcctggcttcaagcgattctcctgcctcagcctcccaagtaactgagattacaggcacgcaccaccacacccagctaattttatgtacttttagtagagacgaggtttcaccatcttgaccaggctagtcttgaactcctgacttcaggtgatccacctaccttggcctcccaaagtgctggggttacaggcgtgagccactgcgcccagtctcattttttgtatttttaatggagacggggtttcgtcatgttgaccaggcttgtcttgaattcctaacctcaagtgatccacctgcctcggcctcccaaagtgctgggattataggcgtgagccaccaggcccggccccagtcagccttttaaaaactccctgtgtttcatttctatttaaacttgtacaattatgcgcttgtcctagaaaactggagtcaacagcagagcagtccggccggcgccctgctgcccgagtgggccgcctcggtacaccgggccggtgcttgccgccttctccctttgcatgtgtgattgtaggaatgtgtggctgtgtcctggctgctattttataaccaccccccatactgtgagcatctgctcacagcgttaaatattcatcgtcagcagcatctcgtgaggctccctggcagccttgggtgga

SEQ ID NO: 22178 - DNA, 1007 bp, Homo sapiens
taatcccagcactttgggaggctgaagcgggtggatcgcctgaggtcaggagttcaagaccagcgtggccaacatggtgaaaccctatctctactaaaaatacaaaaaaattagccgggcatggtatcgggcacctgtaatcccagctactcaggaggctaaggcgggagaattgcttgaacccggaaggtggagatggcactgagccgagatcgcgctattgcactccagcctgggcaacaaaagcgaaactcatctcaaaaaaacaaaaaataataataatgaatataggccgggcgcggtagctcacgcctgtaatcccagcactttgggaggccgaggcgggccgatcacaaggtcaggagatcgagaccatcctggctaacacggtgaaatactgtatctactaaaaaaatacaaaaaattagccgggcgtggcggtgtgcacctgtagtcccagctgctcaggaggctgaggcaggagaatggcgtgaactcgggaggcggagcttgcagtgagcctagattgcgccactgcactccagcctgggcgacagagcaagactccgtctcaaaaaataaataaataaataaataaataaataaataataataatgaatatatttttccagacatgggatcctgccatttccctaggctggtctccaacccctggcctcaagcagtcctgcctcagcctcccaaatagctgtgtactgtcctcggagcagggaacaaagcagacaataatcttttccctcctagagctggcgttctggattcaccctccaagtatttggggtcctccttggcagttacaagaaattgaaagctggccaggcatggtggctcaagcctgtgatacagcactttgggaggctgaggcaagaggattgcttgaggccaggagctggagaccagcttgggtaacaaagcaagagcccatctataaaaaaaaaaaaaatttaaagttacctgagcatggtggtccccgctaccaagggag

SEQ ID NO: 22179 - DNA, 1050 bp, Homo sapiens
tcctgttgtccttctgcttgtccatctctatatctgtctctctccgaggcttcgtcagtctcttatctctgtcttggactcttatctccttggctctttgattctctgtccctgtcttggtctgtcttggtcactctctgtctctctgtctctctctgtgtctctccgggtttccccatctctgtgactcccacgtctgcccggccccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccaggtagcctgccccctcccctccctaagtctctggtggaggagatcagtctggacatggacacagagcccagtgtggtcagagttggggtggagaggggacctggggctggtggaacccagagagggaatgaagggagaggaggttttgagtggagttttgatggttaaataggagtttcccagatgacggagggcacaggcatgttctgacataaacatgaggtgctcgatatatagatagagccaaatactgccagagattgacccaacatccacggtggctggggtggactagggtagccttaccgtgggagagagaagtgttgaactgagcctcctgagcctgcccactccctgcccaccacagaggtactccatctcccaagaggatgccctcaggtcgtgggggacgggaccgcttcaccgctgagtcctacacagttctgggtaaggaaggggagaagaaaggggagaggggagttttgggcaggggcctaatggtgggggttgagggagaacctttgcctttggctgcggaaacaggcagccatcagcaaagctgctcccggaataacaggttgttctggcactgcccaaatggaaatatttcgggataagggattgctggggaaagccagaatttatggagtgaaggaaagagactctggaccagacagtgcc

SEQ ID NO: 22180 - DNA, 1064 bp, Homo sapiens
gtcccagctactcaggaggccgaggcaagagaattgtttgaacccggaaggaagaggttgcagtgagccaagggtgcgccactgcactccagcctggtgacagagcaagactctgtctcaaaacaaacaactccccccacaccccccccaaaaaaaaacaggtttttatttggtctattacatgatgaaatagttaataaaagatgcaatggcattgaagtaagtgaacataggttctttgggaaattcactctccaaagtgtttctgtgttcctcctaaccagcccgaagcctggcagactctgggagaacagtttgattgatgagaaaagcctaacagagcctagggtgctgaggccaggagaaaaaaaaaaaaccctgtccacaaatgtgtctatattttctacttgagaaccagatgcagttattatcaaatgagattttcacccattaaaaataaatttggaatatgaactgcatctgaaataaacaaatgtctcttgaaattctggcgatggctctgctaaaaggcttgtcaggattttgttttttaagttaggatgttgaagcggggcatggtgactcacatctgtagtcccagcaccttgggaggtggaggcgggcagatcacctgaggtcaggagtttgagaccagcctggccaacatggcgaaaccctgtctctactaaaaatacaaaaattagctgggtgtagtagtgcatgcctgtaatcccagctacttgagaagctgaggcaggagaatagcttgaacccaggaggtggaggttgcagtgagctgaggtggcgccattgcactccaacatgggtgacgagcaagactgtctccaaaagaaaaaaaaataagtaaaattaggatgttagaaaaggatagaatgaaaagatagcaccccccaccccctctttttttttgagacgaggtcccttttgcccaggctgcagagtagttgcaccaccacagctcactgcagcctctacctcctgggctcaagcgatcctcctgcctcagcctcccgaagtgctgggattatagatgtaagtcagtg

SEQ ID NO: 22181 - DNA, 1047 bp, Homo sapiens
attacaggcgttagccaccgcgcccagccttgtctgttgcctttatttctgagcttgccttgtttttcttgtgcttggtgtccttcactcatttctttatctgcctccgtagtctctcttgttatctaatcccagatacacacatgtatgcacacttactggagtttgtgaccctattatgacattttggttctgttggtggaaaaactgatcacctggaaaggtttctctttttctcgaagcaattgaaataacccgtgtttaaagataaacgtcttctgttttcagataactaagaaattcgtcaaaggctctacagagaagaacaagctcagactgcaaagagtaagacattttccctgaaatagaaaattaacctgctgtgctttttgcattaaatagtaagcaaagccctttgaagttcctttggtctagtttttacattttccccagccttctctgaccatcattttgattcctgcttcattttaagtacttggacttcatggtttgtggattgtgtcattttttggcttgctgagtgagtcctaaggttttgtgtgtggccttttctaagcttttatcaatagtgctaccactgtcttaatggttcagtatcccattgtagcttcaaattaccttccaaaaacccagtccatttccttgtagtcctgtctcttttttttttttttttttttttttgagacagagtctcgctctgccacccaggctggggtgcagtggtgcgatctcggctcactgcaagctccacctcccaggttcacgccattctcctggctcagcctccccagtagttgggactacaggcatccaccaccacgcctggctaattttttgtatttttagtagagacggggtttcaccatgttagccaggatggtctcgatctcctgacctcgtgatccgcccgcctcggcctcccagagtgctgggattacaggtgtgagccgccgcgcctggccagtcctgtgtctttcacttattgctaagtgctataacatctgaatagcctctacactcgatggg

SEQ ID NO: 22182 - DNA, 1049 bp, Homo sapiens
ctcactctgtcactgatgctggagtgcagtggcaccgtgttggctcactgcaacctccgtctcctggtttcaagcaattcttctgcctcagcctccccagtagctgggattacaggcgcccaccatgcctggctagttttttttaaaaatatttttagtagagatggggtttcaccatcttggccaggctggtctcgaactcctgacctcaggtgatccacttgcctcggcctcccaaagtgctgggattacaggcgtgaaccaccgcgcgcagccaatttttgtatttttagtagagacagggtttcaccctgttgaccaggctggtctcaaactcctgacctcaggtgatctacccacctcagcctcccaaagtgctggaattacaggcgtgagccaccatgcctagccttggtccctcaattctgttcatcccgtccaggccgtgctgtcctccatgctgtgaaccgagcttcctcctgggagttggagggagggccacctgtcacttgccacactgtcttgtaggatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggagtgagtgtccttggaggccatgctgggcccgccaccctgctgctggattccgctcctggccactctgatggggcctttccacttcacaggcagatggcggctcccttcagttccttcccatttctccttcgtgaggtgcccgtggggccctgacgtgggagcggtggaaagcagctccctgctctttagtgctcccccacgtccaactcaccctggaccccttgtctctgctgtgaccatccttccagttcccaaccaacttaggcatttgcattgcaggattgtgggttt

SEQ ID NO: 22183 - DNA, 1070 bp, Homo sapiens
agcgggattctgtctcaaaaaaaaagcatagatggctgggtgcagtggctcacgcttgtaatcacaaaactttaggagaccgaggcaggcggatcacttgagaggccaggagttcaagaccagcctggccgacatggtgaaaccccatctctaaaaatgcaaaaattagctgagcatggtggtgcacgcctgtaatcccagctactcaggaagccgaggcaggagaatcacttgaactcaggaggtggaggttgcagttgagccgagattgtgccactgcactccagcctgggcaacagagcaagtctgcgtctcagaaaaaaaaaaaaaagacaaaaaggcacaaatgttagtgacaccatcttcatcccatgtagtcgttaaacgttttcctgactcctgttttccgtagtctgcgctcctccgtgtctgtgtttagcacttgcagtgctgctggcgagatgacagctgtccccgtgaagcaagctgccggcagctcagcacagtgggactcggtgttatgtgttaaatcctgtcttcagcctagagggtgaagagtggtgattgctctgaaaaattttggatccaagaaaagcctaatgtgtcaacgcgtctcctgtgtggagggagggcccagtgacttgaggtggctctgaagaaattggcatgttcttttgtttaacgtccccagacacctccagatcagaatgtccctcctcagcagcgtctacaggggactcttagactcttctttgcttaactattctttcaaaaaggtagttgaaaatggccgtaggccaggctcagtggctcatgcctgtaatcccagcactttgggaggctgaggcaggaggatcacttgagaccaggagttgaagggtgcagttacctgtgattgcaccactgcaccacagcctgggtgacagagcaagatgtttctcctgtgtcctcacagggtcaacccatgctgcctggggagagggacagcctgggctcccagccactgaagagaggatccaggaggggagcccctacccaggaattgatgaggctacggtaggaacccagtc

SEQ ID NO: 22184 - DNA, 1076 bp, Homo sapiens
tcccagctactcaggaggccgaggcaggagaatcacttgaacctgggagtcagaagttgcagtgagccaagatcgcaccactgcactccagcctggatatatggcaagactctgtctcaagatttatatatattaaataaaaatacagttgtctgtaatcccaggactttgggaggctgaggtgggtagatcataaggtcaggagtttgagaccagcttgaccaacatggtgaaaccccgtctctactaaaaatacaaaaattagctgggcgtgatggcatacacctgtaatcccagctactcaggaggctgaagaacgagaatcgcttgaacccgggtggcggaggttgcagtgagctgagattgtgccactgcactccagcctcagtgacagagtgaaactcccgtctcaaaaataaaaaataaaggccaggcatggtggctcacacctgtaatcccagcactttgggaggctgaggcgggcggatcacgaggtcaggagatcaagaccatccggataacacgatgaaaccccgtctctactaaaaatacaaactgggcgtggtgtcaggcgcctgtagtcccagctactcaggaggctgaggcaggagaatggcgtgaatccgggaggcggagcttgcagtgagtcgagatcgcgccactgcactccagcctgggcaacagagcgagactccgtctcaaaaaaaaataaaaataaataaatacagttgtaatctgatggggccactatcaggtatgcggcctgtcactgactggaaattattctgcagttggcaatgatggctgtttttggagatctgaatccagttcatttgagggaacccccaaggttctctggttgtggcctcttgaataaacctctcacatttggacagtttgttaccaaattgggttctggatgttggtttccttccgtgttgggggtgggaggaaggtgtcacacctgtggagttccccccgctaccgcactggcaccagggtggctgctgcctgcagtgctgatggccgtgtaccctgtctgtccagattggtgctgaagacatggacggcttcca

SEQ ID NO: 22185 - DNA, 1050 bp, Homo sapiens
gctgcttcctgggttgaaggctcccctcctcccagcgtgatttgccccaagtaacttggctgatttctcggtgatttcctgggtcagtgggtaaagccaccccctcactggcctctcactgcagatcgacgacatcgcggatggcgccgtgaagcccccacccaacaagtaccccatctttttctttggcacacacgaaacgtaagtgtccccttctggggcttggttttctcctctggtgcctcccggggtggcctcactcacctgggactggcccccgtttcccttctccagagccttcctgggacccaaggacctgttcccctacgacaaatgtaaagacaagtacgggaagcccaacaagaggaaaggcttcaatgaagggctgtgggagatccagaacaacccccacgccagctacagcgcccctccggtgagtacccggggtggagagccagtgtgaagcgcgctactgatgcaagaaggggcctccagttagggtctctcccctgggcactgtggacacatggggctcgatcgttccctgtggtggggcattctgggccctgcaggtgctgagcagtgtccctggcctccacctactcagtgccaaggccacccccaccccattcatggtgatgacagatgtccccagtcattgcccagtgtcccctgggtggaggggaacgggatagaatcagccctggcgagaacccctgctgtagaatcagtccaagtttcttttttttttttttttgagacagagtctcgctctgttgtccaggatggagtgcagtggcgcgatctcggctcactgcaagctccgcctcctgtattcccgccattctcctgcctcagcctcctgagtagctgggactacaggtgcccgccaccacacccggctaatttttttgtatttttaatagagacagggtttcactgtgttagccaggatggtctcaatctcctgacttcgtgatccacccgcctcagcctcccaaagtgctgggattacaggcatgagccactgtgcccagccttttttttttt

SEQ ID NO: 22186 - DNA, 1047 bp, Homo sapiens
ccgccccttaatgcttctgcaccccaccgcctgtccgtctacattcctgcctcagtttccgtctgtctctctgtcactctcgctgtataggttagggggagacagattgagtctcaattgccccccttggcgtggggctctgctctgggaccagcacccccatcccccatgtggactctagtggactctgccccctttaactgtagggccgcaggtgctcaggccagattccagaaccctgagggcattccaggcggtgggcagctgggccagccgtgcggaggtgggcatgactgtagcttctagctaaaccaggcatcggtccaggcatcggtggcggggagccaggcctaggccagcccgggcccacccagactggcccctaatgagctcccaagtggcctgtggggacttggcctcagttttgccagctgtgaactgggaccgtcgctgctaaggtaattggcaggtgatctgaaggacacctgccgcctcctggccttttctgtgaagtcgaactaggcccatttcctgggatgggaaactaaggcctagaaagaggccaatgcttccaatgtttgtccagggaagtggggacagaggcaggacagaatctgttttctctgcatcctcacatttcccagcaccttctctatggaggggggaagggctggtggaggagcagccccaggtgtaaacaggccgccagagtttatttcctgagccagtcccagctcagctggaggcgatgaacgccttgggaggccccaggggggccagcccagtggtggcggagcttggaccaatctaggtttgagctctgccacccgcatgatatcttgaaccagtttttcaattctgcggagcctcagtttcctcatctgtaaaacaggagtgggtcgtaactccccaagttgagggctgctgggggatcagatgcaggaatacaggccctgctcataacctgcctgactctcgctgtggctctgccccagtcacactggcctcctcctgtttctccaacaccccaggcgaggtcctctctca

SEQ ID NO: 22187 - DNA, 1021 bp, Homo sapiens
gtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcagtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccttccagccgaggtttggacaaagtctcaggttcccgtgactcagggtaaggtgctggggctgccagaggacctgccccagcaagatttttgtcaagagcgagactccatcagcccaggcagacgggagcaggttcttggccagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggatttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaagagaatggcctgcctgatgcgtccttggcgtgggttaactggggaagtcggaggtgggtgagtcagtccatggcattggtgtgagtgaacagagagccctagggccacctcccctagccagaggggtttctgtgttacatactggggctttttttttttttttgagaca

SEQ ID NO: 22188 - DNA, 1064 bp, Homo sapiens
ccagaaagcaccaccccgttagctgggtccatgggattttgctgagcccctgccatgtgccaggcaggtttcaggcccccttggggataaggattgagctgtcgatatgaacgtccggttaatccctgtgcgcccgcctcacgtggcagtggggagaggccctgctgtggggcaccgcatgctgcttccatggtgcattgggttggagggctcttctcccgagggtgggtgtctcccatctcttgccttcacacacctgctgtcttgtttcatttgggactggacagtcccacaggtgacagctgttgggctgttgtatgcctgtttggtgttgcatcaaaggagtgggtttgaatcagcaggtgctctcaaagctgtctcctgggagacacagtactagtgagcatttattgagcacctactgtatgccaggcaccattttctgtggttaaatgcactgcctgtttacacaacagccctctaaaggaggaaaaacatatcagagtcccatggatggaagaaaaataatgaagtaggaaaaacggccctcttaagatgaaggtcatctttttttttttttttttttttttttgagacggagtctctgtcgctcaggctggagtgcagtggtgtgatctcggctcactgcaagctcagcctcccgggttcacaccattctcctgcctcagcctcccgagtagctgggactacaggcacctgccaccatgcccggctaattttttgtatttttagtagagatggggtttcaccgtgttaggatagtcttgatctcctgacctcatgatccgcccacctcggcctcccaaagtgctgggattacaggcatgagccaccgcacccgaccagatgaaggccatcttaaagctcaaccagtttcaggtgagggctgatccagcagatcccaattattcctaaagacctggttgatagctcccttgagactggggtggggtgggtgtcccaagatgaccgccagcagaaaagagagcatctttctcccagtcaaaagccaaagtaggacctatctaaagtaagtcctggcc

SEQ ID NO: 22189 - DNA, 1198 bp, Homo sapiens
gggacggggcggccggttaccatggccaccgcggggcgggcccggtcgcgcacgcgcgcggggggggccggcaaggagggggggcgtgggcaccgaggggtcccggggtccgcggatctcgggtggggtttttccctctcagtggcacttggttgagttcccccgggacttctgaagttccggcccgcgctggacttctgggattccctcttccgtaaataggaatccgaggaatgaatgaatcaatgaatgaatgaataaacgaaccaactcggccacttggcccgggcctcctttctcctctggtcgtggggaaggagggatgggttggaccttctgcttttctttcaattccctcttttcattctccttcctcctcaatcttcaacacttggctagtcgttaatgccttaagtgcttaatttgttgtgtctggtcctggccagggtctggctgtacaggaggactggaagggcatcctgggagtttcctggtgtccacaggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacaggtacacccgccgccagcacctttgttctatgcctggtccaggcctcgcgcctctgcagccaccagccgatactttctccctcccacctccccccccaacaacctcgtccggtcccacttcatctctcccggaaggagaagtccacagaaacctcaaatgcctgcgagaggaaggaacaaagggaggactcacagattgacacgctgggctggcggctggccctcgaatctatagggtctgggcttttaaacttcttttttcaaagctccgcctcaaaataatggctagagaaagaagttttggaggtggccgatggaaggctgaggaattttcgagaaagggcccaggaccatctggtagctaggacggaggggaccaggttttcttttttaaacatccaccaccaattgctctcagcctgtaccggttaagcatcagac

SEQ ID NO: 22190 - DNA, 1031 bp, Homo sapiens
ctcttcccaaactgaaactctgactccatgaaacactcactccctagcccctgacacctctgcatcctactttccatctctgtgaatctgacaactcgggggacctcctaggaatgggatcacacaggatttgtcctttgcatctgttcactgacgtcactgagtgtgatgtccttgaggtgcatcaggctgtagcctggtcggaatttccctcctttttgtggccgagtgatagtacgtgacgtgttgtctataaacacgagcatcttggcaacggcgttccaagtacaggtacagcaagcacgcagaggtcctgggctgggacatttatggtgcatctgtggcccggtagggaggtcagtgagctgcgggtgatggaggggagtggctggggctgtgggagcctcctcactgagtctgggccttaagcgcgtggctcgggtgtggtgtggaattggtctttattctctgctaggcgcatttctgaatctgagattttctgagaaactatctggattgttatatggaatctgatttttaaatgctggtgactaactttttttttttgagacagagtcttgctctgtcacccaggctggaatgcagtggcaggatctctgcttactgcaacctccacctcccgggttcaagggatcctcctgcctcaccctcctgagtagctgggactataggtgcccaccaccagctaatttttgtatttttagtggagacagagtttcaccatgctgcccaggctggtcttgaactcctgacctcaggcgatccacccacctcagcccctcaaagtgctgggattacaggcgtgagccaccgcacccagcctatctggttttataaagggcagttcccctgcacacactcccttgcctgccgctgtgtaagatgtgcctgtgctcgttcaccttccaccatgattgtgaggcctccccagccatgcggaactgtgagtccattaaacctctttcctttctaaattacccagtctttattatttagtatgtctttattag

SEQ ID NO: 22191 - DNA, 1052 bp, Homo sapiens
tcaaactcattcttcccagggcatcctgcaatgaaactctggtttctgtgttttgtttttttttttttttttttttttgagactgagtcttgccctgtcgcccaggctggagtgcagtggcgcgatcttggctcactgcaacctctgcctcccgggttcaagtgattcttctgcctcagcctcccgagtagctgggattacatgcgcgcttctccaagctcagctaatttttgtattttcagtggaggcgggggttcaccatgttggccaggctggtctcgaactcctgacctcggcctcccagtgttggtattacaggcgtgagccactgcgccctgttccgtttcatgttgcttctgtgagtgcagctttgattgctagggggcgtagctgagctgttgccccaggcatcccgagaacccgtggtgttcaagtgctgtgagtagatttaggggcctcggcaggccagaatgttccagcgtcctcgttccttgcagggatgattctctgaacgactgtcggatcatcttcgtggacgaagtcttcaagattgagcggccgggtgaagggagccccatggttgacaaccccatgagacgtgagttctgagccagcctttccccatcttccgcggtgggcacggggcgggggctcttgtcccgtctctggcttggccgggccccgccggagctgaccctgccgccccgtgcccagggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtgagtgcggccctgcccgccgcggggagaccagagcgccccctacaaatccccagaggggcactgaggagatacaggagaggggcaggcgcgggggctcacgcctgcaatcccagtgctttgggaggccgaggcgggaggatcacttgag

SEQ ID NO: 22192 - DNA, 1067 bp, Homo sapiens
tggcctgtgtgggccgcaccaaggaatgtaccatcgtcccgtccaaccactacggacccatcccggggatccccgtgggcaccatgtggcggttccgagtccaggtacctgcagcgtcccggggctccaggggccacgcgggctcatcctgcttttctgggggcagtttctcctggctttggccagccaggggtcagggtggttaccagtggtgcctcggctagccgaggaggggtgtggaaagcctgcaggtttgggtttactccttattttaccagggacctgcaatgaatccttgggggtgggggctgctgctctgctcagagacacgtaaggtcattcccaaagctcctgtcccagggaaggggtggcatctgctaagagggacctgtctcagcgctggttgtgatctatcattggggcagcccctgcctgtgactgggtgttgacagtgctgggcgctgtcagctgtgggctgtgtgtcacggcagacgagacactttggcactagtgacattggagccagatggttctctggggcggggccatcctgggcactgcagggtgctgagcagcatctctggcccccacccactccatgtcctcccaagtcatgacaaccagaaacgtctgcagacatgagtgtccccttggaggcaggattgcccctgggtgagatgcactgagctgggtggacaagctgggcctcatcatggagttcatggggccaggcgtgcagggctaggagctcctggggcagcgctgtatccctagtgctcagcggccagccggggccccatgctcaggccagggcctctcaaggcattttgtggagtgagtggcaggctgcacctcaaccggcctaatgaaggccggcttttatatcataacctcatttagaactcagtcacccccacttttattttttttgagacggagtcttgctctgttgcccaggctggagtgcagtggtgcggtcttggctcactgcaacctccctctcctgggttcaagcgattctcctgcctcagcctccccaatagctgggatcacagggacatgccacc

SEQ ID NO: 22193 - DNA, 1078 bp, Homo sapiens
ctccctgcagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggtgagtgccccttgaggaggccgggggctctgtccccgccggggctgcctctgatggagctgacgctgatgcccgctctctgcaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcaggtgtgtctgggatgggggatggcactttgggaggccaaggcggatggatcacttacgttaggagttcaagaccagcctggccaacatggtgaaacctcatctctactaaaaatacaaaaattagctgggtatggtggcgggtgcctgtaatcccagctactgaggtggctgaggcaggagaattgcttgaacccagaaggtggaggttataatgagctgagattgcgccactgcactgcagcctgggtgacagaatgagagtccatctcaaaacaggagcactgccgggctccatgacggctctgacacttcccgcctgggcaccatgtgtcctgcttggaggctgtcatccttgaaggtcattgtgggtcacagaatgggccctgcctgggcttgtggtgctcatgttctggaccgcgctgaacactccaggaggcctcccgtctcgggcccatgcttccctggtttctctctgatccagaataatttccagggccccagctgatggcacccccctagctgtcccatataaatcctccagccagggggtgatgggaacgcgcagatgacatttgcttctccgcctgccgcatctcagagttgaaaaccagacttgcttgtcttcgttctgttggtaaagggatcgctgcagaccagtcaggcatctggtgtcttctgtttt

SEQ ID NO: 22194 - DNA, 1038 bp, Homo sapiens
tccccacaatctgtccttgttgctctgttccaacttgggaagctcagcatcggaggggttctgggaaacaggctgtgaccttccaccttgatctttttaaattataaacttgaggccagccgtggtggctaatgcctgtaatcccagcacttggggaggctgaggtgggaggatcacttgaggtcaggagtttgagaccagcccgggcaacatggtgaaaccccatctctactaaaaattaaaacaaaattagctgggtgaggtgacaggtgctactcaggagactgaggtggtagaatcgcttgaacctgggaggtacaggttgcggtgagctgagatcgcgccattgtactccagcctgggcgtcagagcaagattctgtctcaaaaaaaaaaaaaaaaaattgaaaaaaacattcagagacagcatctcactctgtcgcccaggctggagtgcagtggtgccatcatagctcatcgcagccttgaactcctcgcggggctaaagagatcctcctgccttagcctcctgagtagctggggctacaggcatacaccaccatggccaacatgatgaaaccctgtctctactaaaaatacaaaaattagccaggtgtgctggtgggcgcctgtaatcccagctactcaggaggctgagacacgagaatcccttgaacccgggaggtggaggttgcagtgagccaagatcacgccactgcactccagcctgggcgacagagcgagactctatcttaaaaaaaaacaacaaaaacaaaagccacaggctgcctggggcaggtgactgtgctgtggtcaccaggcctctcccccatgtggtcaccgccctcgcccagctgtgtgacgacatgctgcagacatgtgccccctgcgtaggcatctgtgcacctgtgtacggcgtgtcactcctccctggcgtgcagccagcccggtggcatcttccctgtttgtctgcttgggaagtggagactccaggcctctcagctctgtcttctcctggctttcttccccaggcacgact

SEQ ID NO: 22195 - DNA, 1159 bp, Homo sapiens
gctggagtgcagtggcaagatctctgcttactgcaacctccccctcccgagttcaagtgattcttctgcctcggcctcccaagtagctgggattacaggcatgcaccaccatgcccgcctaattttcatatttttagtagagacagggtttcaccatgttggtcaggctggtctcgaactcccgacctcaggtgatccactcgcctcggcctcccaaagtgttgggattactggtgtgagccaccatgcctggccagcttagtggttttagtatagtcaatacagttatgcagccatcaccaccatctaattacagaactttaacatccacacaaaaagaaacctcacacccttccgcagtcttgccctgtgtccctcccccaggccctgcaagccacgaatcctctttctatccttatggatttgcctgtcctggacatttcatataaatggaattatactgtattttgtgtctggcttctgtcactaaggatggaattttcgaggttcatctgcattgtagcctgtgtcagagctttattccttttcatggctgagtaatattccactgtacggatgggccacctttctataatccccgtttgacttgttttaagatgtagtcttgctctgttgcccaggctggagtgcagtggcataatctcggctctacaacctccacctcctgggttcaagtgattctcctgcctcagcctccggagtagttgggattacaggtgtgcaccaccatgcctggctaatttttttgtatttttggtagagacggtgtttcaccatgttggccaggctggtctcgaactcctgacctcaagtgatctgccctcttcggtctcccaaagtgctgggattacaggcgtgagccatgaagcccagtccccaactgcttttttttttttttggagatagtctccatggcccaggctggagtgcagtggtgtaatctcagctcactgcagctgcctcctcctggattcaagcaattctcgggcttcccctctctagtagatgggactacaggcatgcaccaccacacctggccgatttttgtactttttgtagagatggggtttttgccatgttggccaggctggtctcgaactcccgggctcaagtgatcctcctgcctcagcctcccaaa

SEQ ID NO: 22196 - DNA, 1050 bp, Homo sapiens
atgaagacatgtgtagggtgagggatgtgggaaggggcacagagggttccgtgctctccccgggctgtgacgtctccaggaacctccacgcattcatctgtggggaagcttccatcccagtcctccgggttttacctcagcttcctcgcagaggcttgggtgacctcactgcattggcctgggtgatcaagtcagccttcagccacatgcccctcccctcccgtccagcctgggtcttttcagtgagcagccctattccctcagctcccgaggggctgccaagcccttagtcacctcattagcacactggagaattccgaggatctgggggagtcgtaggccaggaaacaggacaaaatgtatttcacagtctcactgggccggtcccttgcctccgcttccttgtctgtgatgagaggacgggagggtggctgtctggacagtgctgaagtggtagaggtgagtcgctgccgtggagggcttggcagggtgctctgtgaagggccctgtggcctggggtggaagccgcttgcagagtgctggttctttgcctaaggatggtggggcaggggggccgtgttcacacgtgctgttggctgtgtctgccagtcttcctttcttttttctgtttctgtttctttttctttgtttttttttgtttgtttgtttgttttgagacagagtcttgctctgtcgcccaggctggagtgcagtggcacgatcttggctcactgtaacctccgtctcccaggttcaagcgattctcctgcctcagcctcccccagtagctgggattacaggcatgcaccaccacgcccagctaatttttttgtattattagtagagacagggttttaccatgttggccaggctagtcttgaactcctgacctcaggtgatccgcctgcctcagcctcccaaagtgctcggattacaggcatgagccaccatgcccagtcttcttcttcttcttcttcttttttttttgtgagatggagtttcactttgttgtccaggctggagtgcaagggcacgattttggctcactgc

SEQ ID NO: 22197 - DNA, 1076 bp, Homo sapiens
ttgtaaaagttaacttttactgagaggaaattcacatacatcatattcactctttaaaggatacagtttggaggtcgttggtgcactcacagggctgggcagcatcaccactcattccggagcatctcattgtcccagaggaagctctgtccccctcagcagttgctcttcatcctgtcccccacaccccaaaaccaggcatctccttcctgcctctgtggactggcctgtcctggacatctcatagaaatgggatcgcgcactgtgtggccttttgtgcctggagtctctcactgagtggcccatcctcagagttcatccactccgtggcctgcgtcagagccttgctccatttcatggctgagtcgcgttctgctgtgtgtggtgccgggcgacctgctcccctgctgatgggcgctcatgtggcctcctctctggctattgggagtcgtgctgctgtggacattggtgtgcaggtgttggtgtggacgttggtgtgcaggtgttggtgtggacgttggtgtgcaggtgctggtgtggacgttggtgtgcaggtgttggtgtgggtgttggtgtggatgttggtgtgcaggtgttggtgtgggtgttggtgtgcaggtgctggtgtgggtgttggtgtgggtgttggtgtgcaggtgctggtgtggatgttggtgtgggtgttggtgtgcacgtattggtgtgcaggtgttggtgtggatgttggtgtggacattggtgtgcaggtgttggtgtgggtgttggtgtggacgttggcgtgcaggtgttggtgtgggtgttggtgtgcaggtgttggtgtggacattggtgtgcaggtgctggtgtggatgttggtgtgcaggtgctggtgtggacgttggtgtgcgggtgttggtgtgcgtgttggtgtgcaggtgtgggtgttggtgttggtgtgcaggtgttggtgtggatgttggtgtgggtgttggtgtgcacgtattggtgtgcaggtgttggtgtgcaggtattggtgtggatgttggtgtgcaggtgttggtgtgcgggtgttggtgtgggtgttcgtgtgggggtgt

SEQ ID NO: 22198 - DNA, 1032 bp, Homo sapiens
gtcagcctcccgagtagctgggattacagcctcctgagtagctggtattttgtatttttggtagaggaggggtttcaccatgttggctaggctggtcttgaactcctgacctcaggtgatctgcccgcctcagcctcccaaagtgctgggatgacaggcatgagccaccgcgcctggcttctttatttcattaaaaaacaaagtggcctttcagctggaaggggctgtagtggagcaggggccgtctcccaccctctgagcttttccttgtcttgcttctgccctgggagggtctcggggagagaccatatcatgtgtcctctcatctgtgtgactgttctagaacgggagctgttggccttgttactctagagttggggtcgaggatgggacttgaccatcctcagctggcactcagctgtgtgccctcaagtccctgaggccctgtcctcgtccccttcgcttggaaattgaggtttttgttttgccggaggccttgggagtgggctgggtggtgtccccgttggcactggggcttctcgctccccctcaaggctgcggctcctggtgcccaccctccctgatgggaagagagtcccaacatcgcaggtctccagcttctggtacggcatgagcgggatgccacccccacttcgcttcgtgtgtttgcacactttcatcttatgtctttcttattcatgatggagccttggtgatctttcaaatgtaaaatgtgtaaaaataaaacttacaaagtcggtgacaaatgcagcttttctcatttccaaagctgctttttccctgttggctcccagtgccgggaaagggtgacgtgggcctggagaccgtgacgtgggcctggagagcgggctggcagctccgggggccccagatgcttgctgttccagactcggccctcccagggtcccctcgccacccgcagttccaatccaatacttttgttttttgccttttcagcctcctcgaggtggagtgccgcttaaccgggagcatccccactcctggctttct

SEQ ID NO: 22199 - DNA, 1049 bp, Homo sapiens
atgtccgggacaagccagtgctcagaggcaggaagggatgcttgggtgtgggggctggagggtgacaacggatggggacgggttttctttggaggatgaaaatgctctacctttgatggcgaagatggtctccccactctgtgaatacacaagctcctgcgtcgcacacctggtgaattgtagggcacacgaatctcactgaaactgtccagaaacatccttcccccagatcagctctcagcaaatcaggaacagtaatccagaataaaaactgggcagcctttctggaaggccgtctgccatgggttacacatgtgtctcctgtggcctagcggttctgtctctggaacacgtgcataccggttccatgtctagggatatctgtagccccgtttgttgtagtggaaagttctatgaccaggggatgggttgaaccagtggaatgttatgcagctgtgaaaatgggtttgctccatgaggtttgctctgtatctttgggcatggagagatgagcgcgacaactttaagggaaaaaataggctgtggactgggactcttgtgattcccgttttttgtggggatgtggttcttgaactgggaaagggagatttgcccaagtattggttgatattagtttgatgtcatggaatttgggataccttaaaaatatgcactaacttctcaatatggttctgtctttttttgtactaaaaaaaaaaaaacccacatactcctctttccatagtcagaggggtgtagctctggggagggaagagtggggtccgccattcctaggtgcttcttgagcaagcaccccacagttcccaagtggaaaaggtttttgttgttgttgcttcgttggtttgttttcagaatgggagttaaaaaccaaacaaaaggccaagcgcagtgactcatgcctctaatcccagcatttagggaggccgaggtagggttgcatgattccagaggttcaagaccggcctgggcaacatagtgagaccccattctccacaaaaagggggaaacaagacaaaaacacaaaaact

SEQ ID NO: 22200 - DNA, 1074 bp, Homo sapiens
atgtagtaaaaggctgtaaagccccacgtggcgcatcagtcggccatccaggcttcgtggttttgttttttgttttgtttcttgagacagtctccaaaaactccagattggagtgcagtggtgcgatcatagctcactgcagccttgacctcctgagatcaagcaatcctcctacctcagcctcccgggtagctgggactacaggtattgcaccaccatgcccagctaattttttgtagtttttgtagagttggggtctcactatgttgtccaggctggccttgaactcctgagctcaagggatcctcctgccttggcctcccaaagcactgagatgacaggcgtgagccgccgcgcctggcctgtgcaggccttggtggagctgctccttcggtcctgatggggagcatttcccaaatgtgccccatggaaaaggcaaggcgcagagcagggaccgtaggatgtcattgacatgaaaagcagaggaccgctgccctgtgtgtcgggaggctggggcctcagggcagagagcgcgttggccaccttcccttttgttcttctggagctgggtactgggtgcagtgttggctgttccagaaagtctatgagttctgtctccgttttggcttggagttctcctgtgggaggtgcccagcaaggatgattcccctcggccaccagtgagatgggaaccctcctcctcctcagctcagcagagccgtcgtggacctggggcccccagcttctttggatctcaggcatggggggcgcaaatgtcagtcgggagctgtcaagctctgtggaaggtttctgcatgtttgcccgagccccaccaggaggggcttcaaaagtgcttgtccaagtgcagagcaaggcagggcacagaggcagaggcagacacagcccccagctgggccagggctggtggccaaggggcttcctcagtgtgtagcctccgtggcagcctccatgtgtagtacatggtcagtagaagccccattaacagcaggggggactcggcctctggggagcggatttcttttgcaatatgatgttaaaggaaggtctggcatt

SEQ ID NO: 22201 - DNA, 1103 bp, Homo sapiens
ggcggcgggcgacgggtgacgggtgacgggtgatgggtgcagcacccgccccgcccataggagagccctggtccactgtggcctgtggatgccgcccctgacgtcagcatctctctctggcctccctgggagcagtctcagagcagtgaagagctcttcacgtccggtgctgtggcgatactaagtaataagatctccaggttttattgggcattaatatttattcccatgaaaaggttaaatttatttcactttaaagccctggagagtgcaaggtggagccatagtcgcctctcctggcaacggccctgcccaccacgtacccacctctcccacacaggccagtcctggtgatggcctgcaggacagggcagatgtgtggggcagttgggggcacccccttttggaaggcactgctgccagtggggccggtgagtgtgcagagcccagggccaatgtgtgcctcctgcaggcaccgggcagccctggccactcctcagctctctgaccccttcccccgctctctgcagcaggcaccacacgagccaatttcgcttggcacgacgtcctgaagcaggccctgggctctgcggctgctggctctgagcccatcgacattctgatttgtattttttcatgctttggaaaaaagaaatctatttatctctgcgtcgggtcccgctctgcataaccggaggcaaaccagcagccccgcccgctttctcattttcctgggaaggtagcagcgggtcctctgaggcctgcgtcaagaatatcgggctgtcggacgcgtcagtcttcaggggcaggtgacggccgcactgcttccagctctttggcttggtgtttgggcaccagctgacgggccagccagcagcagcggtgctgaggttagtccaggtcccctgaactcgacggccatcaatcccgggcctgtcatttgcaagcagctgcagcagctggtcgagcctcctgctagaccctctctccaccccaggtttttcttaagggtctgtgacggtatctgtcagtggagactcatgttagccatgtcaggagggcctgtgttggagaaggatggagggaacagccccgagcccagg

SEQ ID NO: 22202 - DNA, 1037 bp, Homo sapiens
ctgcactccagcctgtgtgacagagccagatcccatctcttaaaaaaaaaaaaaaaaaaaaaaaaggctaggtgcggaagcttatgcctgtaatcccagcactttgggggccaaggcaggtggatcacgaggtcaagagatcgagaccatcctggctaacacagtgaaaccccgtctctactaaaaatacaaaaaattagccaggcgtggtggcgggcgcctgtagtcccagctactcgggaggctgaggcaggagaatggcgtgaacccgggaggcggagcttgcagtgagccgagatcgcgccactgcactccagcctgggtaacagagggagactctgttgcaaaaaaggaaaagaaaaaaaaaaaagaggctggaagtggtatgggaaaaagagtagcaggaatgaagagggagtgcccactctctgagaaccatttggtatagctctgactgaaaaatcatagtcatgttatacacactttaaaagataactgattaaaatcaaggatatgatgtgtactccaaatggaaaacaaatagtaaaatataaactcagctgcaccacaaatgaaaatcaaccacactgaagagccaggggaagaatggagttgatctcagtaaatttgggaaacaatgtttccactggatactgttaggctaaaaatgaaaatacctatacaccaacactatactctagttcaaaaatctagttctcatggcttagccatctgtacctactatatgtgaatattgcaattgagcaaatgagtgaattaattgtagatgagctaggtttctctctgtcagcgaaaaaagttacgtcaagggtaaaggaagcggctagaatgaacattgtgctggttggaatcagaagtgtcagtataggctgggcgcagtggctcatgcctgtaatcccagcactttgggaggccaaggtgggtggatcatgacgtcaggagatcgagaccatcctggctaacacagtgaaaccctgtctctactaaaaacaaaaaaaaaattagctgggcgtggt

SEQ ID NO: 22203 - DNA, 1090 bp, Homo sapiens
cacgtttttgtgatctgtttgataaatcaaaagtgatatctgattatggcttaaacattcattcctcttagaacgagcgaggttgagtatactctcattggattaaaagccttttgtcagaactgtcttgaaacatactattttttaaattccacgatggccatttcccgtcagtgagagggttgatttgatgtttaatcttttgcgtttctacatccatctagctcagcgtcagttgctgagatctgggtcaggggtcacacccagctttttcttctcttacgtttgatgttgataaatgagaaaaaccaggtcaggtgtgctggctcatgcctggcattccaacggttgaggaagctgaggcgggaggatcacttgaggccaagagtttaagaccagcctgggcaacagagtaagacttcgtctctaccaaaaaatcaaaaagtgagctgggcgtggtggtgggcacctgtagtctcagctactcaggaggctgagataagaggatcacttgagcccaggagtttgaggctgcagtgagctacgatcacaccactgcactccagcctgggcgaaagaatgagaccctgtctttaaaaaaaaaaaaaaaaaaaggcctcatgtcgtggcacatgcctgtaatcccagcactttgggacgccaaagtgggcagatcgcctgaggtcaggggttcaaaaccagcctgaccaacatagtaaaaccctgtctctactaaaaatacaaaattagccgggtgtggtggcacatgcctgtaatcccagctacttgggaggctgaggcaggagaatcgcttgaacctgggaggcagatgttgcagtgagcccagattgcaccactgcaccactgcactccagcctgggcaacaagagtgagactccgtatcaaaaaaaaaaaaaaaaaaaaaagagagaaagaaagccgagtgcggtggctcacgcctgtaatcccagcactttgggaggctgaagagggcagatcacaaggacaggagatgagaccatcctggctaacatggtgaaaccccgtctctactaaaaatacaaaaaattagccggatgtggtggcgggc

SEQ ID NO: 22204 - DNA, 1031 bp, Homo sapiens
aactggtggcgtcagtcggtctccagtgtagagcgagataacagatgagtggatgggccacaggtcctgggtggtgagggcggcagcagctttttgatcttaaaaatacagtttccttgtcacctgagagctctctgaaagcagtgtgtgagctgactttttggatcaactttacttttcccttctttttaggcaattgaagatgaaggtggtaatcctgacgaaattgaaattacctccgagggaaacaagaaaacatcaaagaggtctagcaaaggtatggaggatttcataagcaagtttcatgttaagtgctttcttcaaaacgaatacattgctaatgtgcctcgtttacttgtctgtgtgttggacttgtgaaccactctgaactgggagccttcagcgaagctttgcattttctttcaagatctctctactgtgttttgttttcttggtatctgggaattccaatggaggatggaaggagtatttgtcctttattcattttcctctgtagattgtcagcggtccttaaataaggagtcttttgggagtcagtcacagtggcgtgtgcctgtaattccaggcgactcggggctgtggtaggaggatcacatgagcctgggagttcaagaccagcctgggcaacatagcaaaacccagctctacaaaaaaacttttaaaggcccggtgtggtggcatgcatctgtggtcccagctgcttgggaggctgaaccggaaggattacttgaccccaggaggttgagatcagcttgggcaacatagggagacccccatccccaccaaaaagaaattagccaggcatgatggcatgcacctgtgatcccagctacttgggagttttaggagggggatcacttgagcccaggagctcaagcctgcaatgacctaatgattgcaccactgcactccagcctgggtgacagagcaagacccagtctctcttaaaaaaaaggggggtgggggcggggcacagtgtctctcacctgtaatcccaacactttgggaac

SEQ ID NO: 22205 - DNA, 1033 bp, Homo sapiens
aactgatccatcccaccaatagcaactcgtctccttgggtcctctgtcctcccgtggcatagttccttaccccttggtttaatatttatgtcatcttgccttctgtcaagagcagattgatgaggactagggctgtgtcttgtttatctttctttccccttcaatggtttaacttggtaacactcaactattggcttaagaaagaatcagctgaggcagggcgccgtggctcacacctgtaatgccagcactttgggaggttgaggcggactggtcacctgaggtcaggagttcgagaccagcctggccaacatgatgaaaccccgtctctactaaaaatataaaaattagccaggtgtggtggcgggctcctgtaatcccagctactcaggaggctgaggcaggagaattgcctgaacccaggaggtggaggttgcactgagcccagatcgcaccactgcactccagcctgggcgaccgcaagactccatccccctaaaaaaaagaatcagctgaagctgggcttgtagaccgaatgttctcttggttcatgtagagttttccctatctgaaatgcttgggaccagaagggtttcattttttggattttgtgcggtattttcgtacgcataatgagataatcttgggattggggcccaaatctaaacaagaaatttgtttcttatacacctgaagataatttaataccatattttttataattttgtgcatgaaacaaaactttcactaattccacacatcaggtgtggaattttctacttgtggcaatatgtcagtgctcagaaggtttcagtttcagatagggttgcccaacctgtaattgaaggcctggttctcagggcccaaaactaaatgagataataactaatacttggtggtgaagtactgggtttaaatatctgagagtcaggccccagtgtcagccacagtgtttggggtaagtgctgggagaacagcagaatgaagtcacttctgtggctcatgatacattgcgtgtttttgcctttactca

SEQ ID NO: 22206 - DNA, 1249 bp, Homo sapiens
agtttacaaatagctgtcccggccaagttcagtggctcacgcctgtaatcctagcactttgggaggctgaggtgggcggatcaaaagatcagcctggccaacatggcaaaaccccacgtctactaaaaatacagaaatttgccaggtgtggtggtgggcgcctgtaatccaagctactcaggtggctaaggcaagaagatagcttgaacctgggagactgaggttgcattgagccaagatagtgccactgcactccagccttggcgacagagtgaggctgtctcaaaaacaaaaacaaaaacaaaaagctgtcccaggttgtaccctaccaacaatgggtgacggtgcctatttcactaaactcaacatcaaacttaccttgtttgcctgttaccttgttgcctgttatatagaagaaaagtatttcattgtatttatctgcatttttctgcaggtgagattttcgtttgcatttcttcacagattatactcttctgataattggacatttgtgtcgtctgaatggccttttcatgccctttgccgatttctgtgctgggttgtttgtcttattgagttataaagactcatataaaatgtttctattgttttaatctgtcattcaatttaatctgattcgacttgtggtattttgatcactaggcttctagattttatgttacgctttaaaaggacttctttgcttttaaattattaaaaatatgactgtaaggccaggtgcggtggcacacgtccgtaatcccacgatgcaggtggatcacctgaggtcaggagttcaacaccagcctggccaacatggtgaaaccctgtctctactaaaaatacaaaaattatctgggtgtggtggcaagcgcctgtaatcctagctacttgagaggctgaggcaggaaaatcgcttgaacccgggaagcagaggttgcagtgagccgagatcacgccactgcactccagcctgggcgacgagtgaagcttcgtctcaaaaaaaaaaaaaactatatgtataactctgttatatatagaaagaataatatttatggttttatttttacattttacatttggaggtttaattaatttagaatgtattttgcatgtggtgtgaggtaggtagggatgaaaacatgaaacatttaggctgggcgtggtggctcatgcctgtaatcccagcactttgggaggctgaggcgggcagatcacctgaggtcaggagttcgagaccagcctggcc

SEQ ID NO: 22207 - DNA, 1034 bp, Homo sapiens
tgtcatcagaaagatcacttctgcccctcccagtgcgtctcccctcccagcccctgcaaaaataaaagtcgctgttgtgattacttcaccagatattagttttacccattctagaacttcatgtaaaatggagccatgcaatactagctcttttgtgtctcatttgttgttttgttttgcttcttgtaatcagttttattctagaaatttacagtacattttgatatctgatagggcaggtcggtaagttttcttgaattattttcaactactttatcagtgggttttatcaagattttaactgaaaatagagggactgctgtaatgtgtgaattcaaaatgctttaaaattccagaaagcatatctcatgtaatctcagttctcctcctattgcttggacttggagaaaatgacatcccttttaaacagcacttggccaaaacagaattgtcactttaacattttttttaaaaactgcttatacagcaaaagtcacattccacatgacgtgactctcaccatcttagcagactctcaaaataattatcaggggctgtgcgagatggctctcgtctgtaagcccaacagtttgggacaccgacgcggaaggatgacttgagcccaggagttggagagcagcctgggtgacatagtgagaccccatctctccaaaaaattagaaaaattagtcagatgtgatggcgtgcatctgtagtcccagctactcaggagactgaggtgggaggatcacgtgagtccaggaatttgaggttgcagtgaaccatgattgggctgtgattgctctccaacctggtaacagggcaagactctgtctcgaaaaaataaaataattaccaggaaactaaatttatttgtagtgtcatcacaaagtacaaattaataggatgttttatggtgtttgagaatgttttgtaactggagatgcaaagttggcctgtttgcttggttaagtattacccaatcctttgctgctggcttgttttgttcagtttttgttcattttggcaatttc

SEQ ID NO: 22208 - DNA, 1035 bp, Homo sapiens
tgttggagaaaggaggcccagttctgatcacacacacacagcctgggcctcactcctgagatcttcctgggctgctcctgtgggcccgagaagccttcttcccgctggagtgtacggttctgcagaccacgtagtggacgcacagccctggagtctgtgcgacccagcgtcttacttaaagtcagccctgggacctggctgggggtgtctaggtccccttctgcagctctactgttgtgcagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggtaagcagatccatgctgcccttagcacgtggcgttcagaatcgtgttagggacctcacagtccagttagcttgagatttttttttttttttttgagacggagtcttgctttgtcgcggaggctggagtgcagtgacccgatcttggctcactgcaagctctgcctcccgggttcacaccattctcctgcctcagcctcccgagtagctgggactacaggcgtttgccacctctcccggctaatttttttgtattttcagtagagacggggtttcactgtgttagccaggatggtctctatctcctgacctcgtgatccacctgcctcggcctcccaaaatgctgggattacagctgtgagccaccgcgaccggccagcttgagatctttcattcaaaggaagcataggccgggtgcgctagttcacgcctgtaatcctaacattttgggaggccagggtgggcggattgccttagctcaggagttgaagaccagcctggcc

SEQ ID NO: 22209 - DNA, 1042 bp, Homo sapiens
tcaaggtcaatgatgggagaacgagaaggacaggtaagtctgaagctacagtggtagccacagaatttcccatagaatgggttcttttcccttcagcgtgccttcttcctgccctttctttgagcaagaggcaaaatgaggaaagagaaaagtaaagcactagaaaagtctaggtttgtggaatggaaatttgggattatttggggttagtcttggctgtcagtccaaacagttactctgaagctgtttttagccttgaccctggggttctgtgtgccacactcaccacacatgtgcaacagtgccagggaaccttgggatgtgacctggctctgctgggaagtgtctagtgagccgcacagctgactcagacaggtgcatctggggaggctgtggttgctgtgtctgtcctcgagtgcctgccctcttttgaaagtaaggacatccttcatcaccccagggcccagcttagccttggaaaacaactagatctgtggtctgtgctcattctcttcgggggctagcacattagaacaataagctccattttctccttccatcttacattgagactgagacttcccaggagagccttggacctctagtggctttccctataaacttgggggcagcacattgctgtgtggaagatgcctcctctctgaggactccactcatgagcccttcctcctcctgccagcattttctggactccaccataagcttcccgcttctgtcccccttggttccttaatgtggctgagcatagccaagtactcagctctgtctcgggatcctcaggaattccatcagcctcgtggggttcctttttccctgctcctggaggcaaattatatgcagcaaaacgtagaactagtcttgtggattttctttggtggaggagcatacaccaatggttccatgtaaaggctccagaatcagaactggcgtcacaccttggtgtcaccccttcctgctgagcctgtctccccaggagtgaaatgagggtaatattcctcctacaaagggtgcggtggtgggg

SEQ ID NO: 22210 - DNA, 1072 bp, Homo sapiens
atgcttgcctagcaattggtcggatgaagggctccatttgatacttccttcactgtggaaggaagaaatttgtaaaaattatttccagaatatgcacacattaaaggtttataaacctgacctttctttagtagaagacagtaagagaatactgttggctctgggaactaaccatttgagctgtgggacccagggaatctctcttgtaagcatcatctttagtgggtgactcctggtggccctcccagctctggtggtgctgtggggacctgccttggagatgccttggtactagtaccttttttgtaccaggccatgagcctagggcacagggcctctggcctgcagatttcaggaaggcagctgtgttgtgtgaaccgatacagcctgccagcacttctgtcccgagtgactgtcgttgtcatcgttagcatgttgcctgaaaagccttggggtctgggcgctgacactgaagcttttttttcccttctggctctgtgatgtccagcattacccagaacgccatggaggaccagagcgccacggccgggactcccgcgatggctgggggggctatggctctgacaagaggatgagcgagggccgggggctgcctcctccccccaggtttgtgtcccacacccgacagtacctgaccccccccccgcccacaagggggcccgcaagtcgctgggatgtgggcacagggtgggaaacacagagggattcactctccagaagccgccacagttattagcacaagagccagagatgggggcaatccaaatcagagatgtctctctttcaaggggcagacgtgactggggggaccatggccgaagagaggatgaccggtcatggcagggcacggccgacgggggcatgatggacagggatcacaagaggtggcaaggtgaggagcagctctgggctgggaccaggatgtgctggggagtgatggaaagatggaggccgcgccttctctccttgggggagcacaggaggtgctctgctctcagtgctggaatgaggaatgaagagcactccagacaccgcctgctctctggtggtc

SEQ ID NO: 22211 - DNA, 1943 bp, Homo sapiens
ggagcgcgtgccgttcttgcctctctggcctgcgcctcctgagccgagtagatatcccggagttccgcgcggcgccagcccttccgccacggccgtctctggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcggggtgagtgcgggtgccgcgcggaggttgtcgggggtttcttggagggcggagggcatggcttgggcaaaggctctcgacctgaaagaacgcgcgttcgggcgcagaactaaggggggcttgaatggaagagatggggtgggggagtgggacttcctgcctggtgctcgaaggcgggcacccatctgggtttttcccaaccgtgcaatccacgctggggcagagggagcaccttgagagcggcgcggggcagcgggtttggggttctgacgcaggagtaggagttcgctcatggagctggcccgaggttgcggtgtgtgaggttgagggatttcaggtgtgtcagtgtattgggcgcctttattaagcgggcagcgggtttggggttctgacgcaggagtaaggagttcgctcatggagctggcccgaggttgcggtgtgtgaggttgagggatttcaggtgtgtcagtgtattgggcgcctttattcagcaggcagcccagactccaggtgcgtcctgccagtgttgcggagactgggacttagggaggatgggagctgctccgggcgcggcgaaaagcgctaggcgttaataccttggttctcacagctacccacagaggggaggaagtagccagggaaatcgcggcagcgcgagagaagctgcttaactagaatgcagggatccccctaccctgacggccgcccctttcccccctagcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtaggtgggcgctgccggccgaggggcggggtgggatgggagtcagggccgggctgacggcggcctcgtccctggcaggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcctggtcgtgaatcaaaagccgtggcccgcccacccttcccggggcagcaggtgaggaagccgccgtactgcaaatgactttaatcattaaatagcttctatgccacactctgattaagccgactgaggtccctgggatctgggtcactggaccgagctgctcgctcggtggctccactgccaggtccgggcgcgctccccacagcgctcagttctggcccagacagggcctgacatccgccgcctgcagtcccggggtggccgtcaccgttccacggccagcgcctctgcctgctcgtccgggaaggcgatgtcgaagatctcccggtagtgttccacgaagtgcacctccaggccctcggtgatgaaggctgccaggtcgtagaagtcc

SEQ ID NO: 22212 - DNA, 1032 bp, Homo sapiens
agcgatcctcttgcgtcagcttcctgagtagctgggactacaggtacatgccaccaagcccagctaattttaaaattttttgtagagacgggggtctcgctatgttgcccaggctggtctcaaaaccctgggctcaactgatcctcccgcctcagcctcccaaagtgctgggattccaagcatgagccactctgcacccagccccatcctggttttttttttgttgttgtttacatgctcttgacatctaattaccttatttcacatttattatctgtctccccgactggatggtgagtttgtcggggaggggcccagggtggccttggttaccaccgagtccctggtccccagccaggccctggcacacagtaggcgctcaataagtgtttgtcaggttaattcgtgtgctggaggcggaacccagccgggcactctgggctttctgccactggggccttttactggctggatctgctctgctgtgtgtctttaagaaaatctcgtacctccctgggtctcagcgccactgttctctcaaacagcaggtcctacgcccctctctcacctctcctcttttcctcttgttaacacaggccagcgggttcccaggcagtagttgtggagtccgggagagaacaagtttggagttggatccaggttccaatcccagctcagacacttgttacttttaattaaaaacatttttttttggccaggtgtggtggctcatgcctataatcccagcactttgggaggccgaggctggcggatcacgaggtcaggagatcaagaccatcctagctaacatggcgaaaccccgtctctactaaaaatacaaaaaaaattagctgggcatggtggcaggcacctgtagtcccagctactcgggaggccgaggcaggagaatggcgtgaacccggaaggcagagcttgtagtgagccgagatcgcgccactgcactccagcctggggacagagcaagactctgtctcaaaaaaaaaaaaaaaaaaatttttttttgtaaagaca

SEQ ID NO: 22213 - DNA, 1060 bp, Homo sapiens
tgggctggagtctctcttcccgactctgtcttcccctccagactggcttggggctggggccagcgtggagcgcgatcatatttgcagagtgaatcactgtgcttctagtccctctgttagcacccctgagccacccttgtccctgtccttacagaagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgtgggtgcctggtctgggtccactgggctacgggaagggcagagggaggtacccataggctaggcactcgactgctcatccactgtccccctcccccaggactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaaggtgggggccgggacccttgggatggtgggggagaaggacagtgaagtggggacagtggggcccctattgagtcagccccagccgcctgaacgccgagtctcgggcaggaattttcctcttggctgccagcccggactggagggaaggaaggcggccgattggcctgggagtcccccgaggcgaaggcgggggcagggtggggaggtggggaggtccgtggcgtttgtctgctgcttctcgggatgctgggagaaaacctgctggtggaattcagggctggcctgagggctggtgacaccatccctggggactccccgagtttctctctccatcctgctgatgggactctgggagccgccctgcatgtcttgctttcttgggtttttggattttaatataccttagcacccttggtttatacctttgatttatactttgggtccctcttcacttacactctcatac

SEQ ID NO: 22214 - DNA, 1040 bp, Homo sapiens
ttcttctgaaattagtatgtgattttacttaaaattttttttttctttttagagacagggtctcactctgttgcccagactggagtgcaatagcacaatcatagctcactacagcctcgaactcctgggctcaaataatcctcctgccacaaactcccaagtagctgggactacagacacgcgcttccatgtctggctaatttttaaaaattttttgggccgggtgcggtggctcacacctgtaatcccagcactttgggaggcccgggggggggcagatcacgaggtcaggagattgagaccatcctggctaacacggtgaaaccccgtctctactaaaaatacaaaaaattagctgggcatgatggcgtgtgcctgtagtcccagctagtcaggaggctgaggcaggagaatggcgtgaacccgggaggtagaggttgcagtgagccgagatcgtgccactgcactccagcctgggcaacagaacgagattccatctcaaaaaaaaaaaaaaattttttttgtggggtctcgctatgttgcccaggctggtcttgaagtcctggactcaagcgatcctcccacctcggcctcccaaagtgctaggattacaggcgtgagctgccacagcctgtggtttttgtttttgtttttttaactgacagataacagtgtatgtatttatcatgtgcaacgtgacatattcttgaaaaatgcaagaggagcggatgttaagcactttcaccacaaaaatgagagctatgcgaagtgctgcatttgttactaagctagatttaatcatgccactgtgtatatatacttcaaagtgtgtttcctttttctttttccttttgttttttgagacggtctcgctctggcgcccaggctggagtgcagtggtgtgatcttggctcactacaacctccgcctcccaagtttaagcaatttcgcctcagcctcccgagtagctgggattacaggtgtgtgccaccacgcccagctaattttttgtatttttagtagaggcggggtttcgccat

SEQ ID NO: 22215 - DNA, 1033 bp, Homo sapiens
ctggcctcaagtgatctgcccgccttggcctccaaagtgctgggattaccagtgtgagccgctgcacctggcccctaagtgctgcttgctcaccccctattgatgaaccttatctgtgaccccatgtaactcctatttgaccctgtctggccccttgtccctagagcatgacttcggtgctggaacctgtgttggacctcacgtacccagtcacctccatgttcactgggtctgcctttaaccgcagcatccatcgggtcttccaggataagcagattgaggtaggcccacctcatcccctgccctgcctacccctccccggaggagccccctgctcctcccccacctcgatccctgtccccgcaggacctgtggctgccttacttcaacgtgaccacagatatcaccgcctcagccatgcgagtccacaaagatggtgggtgtccccgcccagcctgcagcaaccgctgacgccacgtggggttggggggatgcttccgggagggccgctgagcttctgggacgttgttaacacgagtgaccgtccaccctggcccgatcaccgaccactaaccgccacccactaatgccccggagaccccaggtacgtccgtccttgggggaggggagcagggagactcgtcggacgccttacccccctcacgccatccccgcaggctgtgtgtggcgttacgtccgggccagcgcctcctactgcccctacctgcccccactgtgcgaccccaaggacgggcacctgctggtggacgggtgctacgttaacaacgtcccaggtcagcgagcccatcgggccggctgggcctccggcgtgtctgagcgtgtctgtgcgtgtttgtgtctgtgtgtcccaccgcgcaggctccctgtggcggtacgtgcgcgccagcatgacgctgtcgggctacctgcccccgctgtgcgaccccaaggacgggcacctactcatggatggcggctacatcaacaatctgccaggcaagtggccgcccgcaccacccgcacacgcaagcac

SEQ ID NO: 22216 - DNA, 1025 bp, Homo sapiens
ggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttcaagttccctggcaccagctccaagattgaacacttcatctccatcctgggcaagtgtttcgactctccatggaccaccagggccctatccgaggtatccggggagaaccagaagggcccagcagccaccgaacgggctgcggccaccatagtggccatggcagggaccgggccggggaaggcaggggagggtgagaaggagaaagtgctggcggaaccggagaaggtggtgaccgagcctccagttgtcaccctgttggacaagaaggagggtgagcaagccaaagccctgtttgagaaggtgaagaagttccgcatgcacgtggaagagggcgacatcctgtacaccatgtacatccgacagacggtgctgaaagtgtgtaagttcctggccatcctggtctacaacctggtctatgtggagaagatcagtttcctggtggcctgtagggtggagacgtcagaggtcacgggctacgccagcttctgctgcaaccacaccaaggcccacctcttctccaagctggccttctgttacatctcctttgtgtgcatctacggacttacctgcatctacacgctctactggctcttccaccggcccctcaaggagtactccttccgttccgtgcgggaggagactggcatgggggacattcctgacgtcaagaatgacttcgccttcatgctgcacctcatcgatcagtacgactccctctactccaagcgcttcgccgtcttcctgtccgaggtcagcgaaagccgtctaaagcagctcaatctcaaccacgagtggacgcccgagaagcttcgacagaagctgcagcgcaatgccgcgggccggctggagctggccctct

SEQ ID NO: 22217 - DNA, 1029 bp, Homo sapiens
taatgaaagatgaatatattttctcttcctaatgatttttttttttttttttttggagacagagtctcgctgcatcccccaggctggagtacagtggtatgatcttggctcactgcaacctctgcctcctaggttcaagtgattctcctgcctcagtctcccgagtagctgggattacaggcgcccaccaccatgcccggctaatttttgtatttttagtagagatggggtttcactatgttggccaggctggtctcaaactcctgacctcaggtgatctgcctgacttggcctcccaaagtgctgggattacaggcatgagccaccttgcctggcctcttcctaatgattttttaaagtacatcttgttttctctgtcttactttatcataaaaatatatgatacaaataaaatacagaatatgtgttaatggactgtgtatgttatgagtaagccttccagtcgacagtgggctattattggtggttaagttttgggggagtgtgtgttcaagggtcaaccgcacttcctgagggcactgtgagaactaagttaaataacccacttttacaatctttggaaccgggggcaggtggctggggctcacacctgtaattacagcactttgggaggctgaggcaggaagatcccttgaggccaagagtttgagaccagcctgggcaacaaagcaagactctgtctctacaaaaatttttaaaacttaaccaggcagctgggcgcggtggctcacgcctgtaatcccagcacttcgggaggccgaggcgggaggatcacaaggtcaggagatcgagaccatcctggctaacatggtgaaaccccgtctctactaaaaatacaaaaaattagccgggcatggcagcatgcgccggtagtcccagctgctggggaggctgaggcaggagaatggtgtgaacccgggaggcggagcttgcagtgagccgagatcgtgccactgtactccagcctgggcgacagagcgagactccatctcaaaaaaaaaaaaaact

SEQ ID NO: 22218 - DNA, 1902 bp, Homo sapiens
gtgaaaccccatctctactagaaatacaaaaattagccgggcgtggtggcatgtacctgtaatctcagctgcatgggagactgaggcaggagaatctcttgaacctgggaggcagaatttgcagtgagccgagatcgcgccactgcactccagcctgggcaacaaagtgagactatctccaaaaaaaaaaaaaaaaaaaaaaattcagagtcatgcctggggtcagggggagtccagaggagtcacctgactcagcctaaggaggagtcagggaaggcctcctggaggaggtgacagttggctgggtcgctaagggtaaggaggagttaaccaggccaagagaccagtgggcaaattgcagaggagagaaactgccagggtgcttggatgaaacaaccacaaagccagggttgtaagatccagaagaggggagaggaagaagggcagagccagcctgccagccttgaacaagcatttggcattatttagagctcagggaacagactgcaggggtcgaaggcaggagcctggagaccaggatggaagggactgcaccaggccaggggagtaatggtggggctggaccaggtgaaggcgtggacgggtgagacttgggtggatcttggagagatatggagaggccgggggagggagcagctgctcatgggggagaagctttaggtgtaagtcagcaatctgttctcagcatctggaaattgccatgctgctagacacccaggtggtacggcgtaggatgggctttaaagcaagctgggagcttgggagacagcagaaagagggcagaaggaaaaccaggagtgggtggcaagctgggagccaagggagctggggctgtcataggaggaaagggtcttgaaacccctgtttgataattcagtagcaggcatcttactgtttttttaattattattttttttattttttggaatggagtttcgttcttgtcgcccaggctggagtgcaatggtgcgatctcggcccactgcaacctccacctcccgggttcaagcaattctcctgcctcagcctcctgagtagctgggattacaggtgcgaaccaccacacctggctaatttttatattattagtagagatgaaggggggtgggtttcaccatgttggccaggctggtctcgaactcctgacctcaggtgatgcacctgcctcggcctcccaaagtgctgggattacaggtgtgagccactgcgcccagcccgtctcactttcttttgtggctgctctttaccaaccctgttctgttccccatgcctttcagtacaagctcttttctttgcttttctttcttgtttttgttttgttttttcaagacaagttctggctctgttgcccaggctggggtgcagtggtgcgatcttcgcccactgcaacctccacctcccaagtttaagcaatcagcctgggactacaggcataagccaccacacctggctaatttttgcatttttttgtagtgattttgtagagttttgccagttgcccaggctggtctgaaactattgagctcaaacgcctcagcctcctaaagtactgggattacaggcatgagccactgcactcggcctctttctttctttcaaaggcagaatcttgctctgtcgctcaggttggagtgcagtggcatgatcataactcactgcagcctcgacctcctgagctcaacctcagcctcctgagagctgggaccacaggcatgcaccaccaggcctagctaatccttaaaaaaaaattttatacacatggacaggggtcttactatgttgcccgggctggtcttgaactcctggcctcaagcgagcctccagcctcaacctcccaaagcactaggattataggcatgagccactgtgcctggccaagcg

SEQ ID NO: 22219 - DNA, 1137 bp, Homo sapiens
cctgggaggttgatgttgccgtgagccaagattgcaccattgcactccagcctgggcaacaagagcgaaactgtctcaaaaaaaagagaattggtttcttaagtagtgaggtgggggtagagggctcattccctaccaaaaatgccccctctcctgtatcaaccctgtctcctgtatcaaacacaccttcagtggaaatcttttcattttcatgtactataattttctatttaaaaagtcacccttaatatatatacatacactggaatatgattcaggttttttttcttctttttccttgagacagagtctcactctgtcacccaggctggagtgcagtggtgcgatctcggctcactgcaacctctgccttgatcttggctcaagcaattctcatgcctcagccttccaagtatctgggacttacttggaagtaagctggccaccacgcctagctaatttttgcatttttagtggagatggggtttcaccatgttgcccaggctggtctcgaactcctgatcgcaaatgatccacccgtctcagcctcccaaagtgctcggcttacaggcatgagtcactgcacccagcctgattcagccttaaaagggaaggatgtaacatgtcatgtgggtgaaccttgaggacattatggtacatgaaatcagccagtcacaaaaggggagatactgtgtgattccacttacatgaggcccctagcgtcaccagattcacacagagagaaagtagaatggtgggtgccaaaggagagggaacagggaattattgattattaggcatggattttcaggtttttgttgctgttgttttgagacggagtctcactatgttgctgggctggaatgcagtggcgtgatctcggctcaccgcaacctctgcctcctgggttcaagcgattctcctacctcagcctcccgagtagctgggattacaggcgcccgccaccacgcccagacaatttttgtatttttagtagagacggggtttcaccatgttggccaggatggtctcgatctcttgacctcatgatccgtccatttcggcctcccaaagtgctgagatgacaggtgtgagctactgtgccctgccagagtctcacgatccgtccgcctcggc

SEQ ID NO: 22220 - DNA, 1043 bp, Homo sapiens
tagccaggcatggtggcgcatgcctgtaatcccagctactcgggagactgaggcacgagaattgcttgaaccctcaaggtggaggttgcagtgagctgagatcgtgccacggtactccaggctgggcggcagagtgagactccatctcaaaatgttgggggaaataatccagattcttccctgcggcccccatgccttgcaggctctgtgctgcccctcatcacctccctgccctcccctcctccctctctcccccttgctcactgcaccagccacacggacctcctcactgttgctccaacatcccaggcatggtcctgcctcagggcctttgcacctgctgcgtatttatctagaaagcccctcccccagccccaccttcttgtgtgaaaaacccacaaccttctcatctttttttttctcatagggtcttgctctgtccctcaggctggagtatagtggtgtgatcgtagctccctgcagcctcaaactcctgggctcaagtcgtactcccacatcagcttcctgaatagctagaactacagatacgtgccagcacacctgactactttttaaattttttgtagagacagggtcttgctatgttgcccaggctggtcttgaactcctgagctcaagtgatccacctgcctcggcctcccaaagtgttgggattacaggcatgaaccactttgcctggcctgacctccgcatctttttttttttttttttttaagatggagtcttgctctgttgcccagtcttgagtgcagtggcatgatttcaactcactgcaacctctgcctcccaggttcaagtgattctcctgcctcagcctctcaagtagctggggttacaggcacatgccaccacacctggctgatttttgtatttttagtagagatgaggtttcaccatgtgggccaggctggtcttgaactcctgacctcagatgatccacccgcttcagcctcccaaagtgctgggattacaggtgtgagccaccgcacctggcctgacgacctcatctttaagtcccagct

SEQ ID NO: 22221 - DNA, 1074 bp, Homo sapiens
gttccgcagccgctggatgagacgggtggcggacgccatcttccgtccgcgatactgaagggcgcagccggtgacgtctccaccgctggggctgctgggaaagacgcggcgtggtatcgcgagacgggagtgggcggtgctagaacgtcctataaaggctctccccgaagcacgtgactcctctccgccagaccgccgccgcgccgccatcatggacaccagccgtgtgcagcctatcaagctggccagggtgaggtgggggcccgaatttgggggcagggggagggattagaggagccaaacgggccgggtctgaacccagcttctttcctccaggtcaccaaggtcctgggcaggaccggttctcagggacagtgcacgcaggtaatcgggtgggggcatttggccgactgccggcgacctaaaccctgatgtgacctctaccctgccctaacccctgccagccggaatccgggagccgattctcatttcatcacggggttctgatggttccctttaacgatctgtattctggccccgacacgttctctgaattcatatctgcttcccactccgcggtgcctttccgcggcccgcccttacttcttcctccactccggtggggacccgtaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctggtgggtgcaaagaggacacccctttgatagacctttggttggtggtagggaggcttcgttaagcccagggtgagagggtttgggaggcagagtctacatacagagactgacaagagggaggcgggagtttgccaattgctgcggggcctgtcaacatctcatgtttgggtctgtttacagggtcttggatgtcgggttcgaccacttggccgatgggaatggtctgtcacagtctgctccttttttttgtccgccacacgtaactgagatgctcctttaaataaagcgtttgtgtttcaagt

SEQ ID NO: 22222 - DNA, 1034 bp, Homo sapiens
tcggccccccaaggtgttgggattacaggtgtgagccaccgcgcccagccaaaagttaaaaagacttgcagagttaagtttttatatgtacgtatacatatacatggactagagaagaatcttcccctaattttgtcctgaagatagtgagaaaataggattggacatgttaaaaaaagagcttttcaggacatcacttttatactatcacatcatctaaacttgaatatgtccctccccttccccttccccttcccttgccgagacagggtctcccgctgttacccccggctggagtgtagtggtgcaatcatggcttactgtacccttgacctcctggagccagactgtcttctttctgcatagctgggaccgcagttgtgcaccaacatacctggctaattttttgtattttttttgtagggacacggttttgccatgttacccaggctggtctcaagactcctggattcaagcactcagctcacctcagcctcccaaactgctgggactgcaggcatgagccaccatggccagtctgcttgaatatgtgtctcgaatgatatttctttgagggtcattctctacaagtctgtcaagaattagttggtggtggtagatttccaaaaaggtcaattttttaaaagttggaaatgacaagagatagttctaatctctttactgaggaaacctctcagagggaatgattagccagggaaggatttgtttgcagaggtgctgtgcccattaagcatggtgagagccgctttctcaatggtgagtcatgtgatgtggattaaccccaaaccaaatgctcagcttctgtggttagattggatagtttattcgtagccatggtatgcacctgtggaatataggttagacactttgttacctgctttggctgtaattatttatttatacatttcgtagtttataggtgagcttaagcagtctggtgaaagactggaaataattcatcatggactctgtcagaatgttttttattgtaaatcttaaagtatttgggactt

SEQ ID NO: 22223 - DNA, 1761 bp, Homo sapiens
ctccctactagctagtactgcaagtgcaccaccacacctggctaagttttatatatatttttttgttgttttgacagggtcttgctatgttgcccaggctagtcttgaactcctggcctcaaatgatccccccttcttggcttcccaaagtgctaggattacaggtgtgagccaccgcatctgaccaatactagtcttgtgtcatatgtaactttgtgtggaattgtaaacctggcaaatcaaataattatctttcacattgtgctgacatataaaccctttacctttttttcctctctctcgaattcagtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaaggtaatggtactggtgattgagtagggtgagaaggttggtgtgtcatcttttctgtggctaattccttggttatttttggtcagtggaagcggctctgggtagagcatgttctttccaggcttaagagtgaagcccccttaccccacctcagttttttttttttgttttgtgttttttttttgttttgttttgttttgtggtcatacccctgtgtgtcaaacaggatggtttgtatggtcctttggcctacagatgattttactggcttagtatggttaataaggcttcgattaggcttccggggagccttttcgtgttgaaattttttgaattttgcacgttaggtgggagagatttttcctttctttccttttttttttttttttaagctttttaagtttcacaggaagatagcttgtttaaaattttgtggatgtcttcctgggatcaaaatgtggtagctggaccttatgcttctcagattccaaactataaaacattagcttgtattttaacttttaggctttttcccctctgggaaaaaatagagtagactggccattggagagctcaaaataaggtatctgctttgtaacgcggtgccttaggatgtggattgtcatagcctaggtgtccaccttccagccgagggcaggggaagcagccaagctctgctgccaccaggaggcccgaggaggcctgcctctgtgatcctcacccccgtgcacactgtggtgtcctctctctctccttcttccctcctgtgctgctatcgtcttcctttctttcctgattcttggccctgctggtggcacttaggactaaagagactgctcagccctgggttagacaacaccgtggtagagaacaatttgtatattgccttgaggcgccctccccgcaccccgacctagactcaaactacccttcatggagtctttgcatgactgaaaggtattggttttctggagcattcattatgaaaagagatgtgagcttgatttgtcaaatgatttaacatttcagtgacagagatgccccgtggataggccattttggtatgtgtactggtgctccctgcattggattttgaaattatgaatggcactgccatcattgtcccatcccttattttgaccatgacatgcaagaagcactaggcactgtgaacctctccgtacagtcacgcgtgctgctcccacgtggcatttctccagataacacagatggaaaaacgttttggtgtgagattgatgtgcctgccttgatcagccaaatcat

SEQ ID NO: 22224 - DNA, 1051 bp, Homo sapiens
acatttcaggagaggacaaagagggtgaggctctagatgtaaactttggacacttggctttcttgccttcaaccaatgtgcagagccattaataaatatgtccttcagatctttaaattttttgtaaaataattttaccttgtttttcattaaaaatttttcttcctatagcctcataattttaatgtcctttaaacaaaagagttggaataggcatgacttgttgaggccgttaagcgggttatttttacccttgtactgctaaaccaaaccgatccagaggacaacaaaagcccattttttgcctttggagagtctggttagagatagttttctccagggtaacactttacatttgttttctgtgtgccatcttcaagttcagcagccattttggtggttgtcttgatggattctaacatctggtcatggtggtcatgaattggcaatccaaaccttgaggaaaatctgcagaaacttttgaaatgctttggttttttcccttttgtgtagattagaatcatatgagtctgtttaactgtttagatacaaaatctgagccctaaatttgaatttatttgtgtcctttaaatggggaggtttagaaagcggcaagaatgaagcctggcctaattcactgaagagaatccagatgctgctctggttttgtgatcttattatattcaaacattctgcctctacagatgtggagcctagtgctgtgtgcaggaccagctatagaatttgtggggcccaacacaaaacgaaaacaaggggcctcttgttaaaaaaaaaaactaagaatgtcatggcagcgataacagcattaaaccaagctcagggcccctgagtgcggggctctgtacaattgcacgagttgctcacctgtgaagctggccctgcggccgtgtgtgcctgtgagcttataccttcgcatacgtgcgtccttgtatttatagcatgtgagctcagcccgatggcatcgcaatttgtatgcatttcacctgcttgccaccaatgagagcgtatgtgtaaaacctcctcccttccc

SEQ ID NO: 22225 - DNA, 1008 bp, Homo sapiens
tcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattgatatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgt

SEQ ID NO: 22226 - DNA, 1484 bp, Homo sapiens
tggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccgcaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaggttctct

SEQ ID NO: 22227 - DNA, 1888 bp, Homo sapiens
agcctttaaacttggtaagttcttggcagaagataccccagttgaaacatgtgatagaatttttctttccctgcttagtctaagcagtcttgttggatgatgctgaaatgtgaacctctcttgcaggaatggaggggccctttggtggtggtatggaaaacatgggtcgatttggatctgggatgaacatgggcaggataaatggtaagcatcgtgttttcttcctgctttcactcaccctttgccggctgttgcctctcaggtgacttttaggctgcagacccactgaataagtggtttctcacttctgcttttcaaccgaatcaaatgtcttttgaattgccttaaatatttcaaaaactagacataatagtagacttacttcacttggtcgctagtcttttgagatgtcctgtgttcccaagctctgcagtaattttcgagtacagtgttaaaaagcatgtacacgttcgtggttatggtctccgagtatgagggattctttaaagtttgtaatcaagtttgtctctgggagtgctgcaaagggttgttcttggtcatctgccccagctacaagttgtctatagaggcgttaataaaaatcacaggctcttttaatttagcatttacataatgcaaattctggtttagtataattcaaatcctccaccaacttttttttttttttttttgagacagggtctcactctgtcacctaggctggagtgcaatggtgcgatcttggctcactgcaacctccgcctcccaggttcaagtgattctcctgccccagcctcctgagtagctggtattacaggtgtgtgccaccatgcctggataatttttatatgtttagtagagtcggagtttcaccatgttggccaggctggcctcgaactcctgacttcatgtgatccgcccgcctcagcctcccaaagtgctgggattacaggcgtgagccaccgtgctcggcacctgcccccaactttttagcagaaatataataatataataacaatgtagtatttcatttagtccttgtgagaaccacatgatatgtacatactgctatccttgtttcatctgaaactgaggcacagagagtgacatgcctaggtcaagtgactggtaaacagtggtgcctgcatgtgaacccaggctgtctggctccagagcctggcacttcatcatgtgggaatcctgccttttagaagtgcctccagcacagcacttggcccagggcaccagcagggctgtagagtgtgcatgagaaattgtaaattttcctttttgaaatcctttatgtgttggtgactctttgaccttccccttcactgcaggaaagctgctgcttttttacacagaaactttcttggactgagaagtcattagggatttaggtataaaccttcctttgcgggtctgccataacaaaggatgtgaaaatggtacaaggacagacatcattgtcaggcttgaaaggcggctgtccctgatgatcaggcccttcttccggtgcacagggagcagtggggcatgatgtgtgttgccctcttcatgggtgccttgttctagaagctggtaaaaggatgtaggaaagttgtcaccattagtaataaagcaacagaggtctgcgtttccagtgtacattcaagcttgcctgtaacttgtgtgtgcatgggattttaatttttaaaaaaagtttcagaaatctggcttggtaaaatgttactcagagcagattagtctgggtgtgctggctcacgcctgtaatcccaacactttgggaggctggggtaagaggattgcttgagctcaggagttcaagatcagcctaggcaacactgcgaaaccccatctctctcttttttttttttttttttttttt

SEQ ID NO: 22228 - DNA, 1050 bp, Homo sapiens
agtcaggattcagagcctggggtacgcggtggcaaaggattccaagtgctgattctctggagaaccacaaatggagtgtgttttcctagactgttcttagatgttctgagatacggcactcggagtgctccccacaccctctacagctgagaacagggactccttcccacttgaccagcattctttggtttgggtgggatgagctctagagcccttgggcactgcaaggaaactgtacatcacactggaggaagaattgaagcagacgtttgggtttaatgaaatgttaattcatgactagagtgtagccattatggtcatgggtgctcccatcagactgctggtcatgcaggttcccaggacccacactcagcatgagtcaaatcttgatagagtggctataaaaatgtaaatcaaaagattgttaaatgtcggccaggcgcggtggctcacacctgtaatcccagcgcattgagattaatgttaaaaaaaaaaaaagagagattgttaaatgtcaaaaactgactgtagtgaggcagtgtttgacagtgaaaatgctaccctttgtgggtgtaaattggagttcacggtgctccctgagctctggggccctgttgacagccagtaagatgagttatgaggtccttgccaacatgctgatgccagcctgtggcatgcttgtctggagtggggtgctgccttcttgcagacaggtggcaggatggaaggagagcagcagaactccatgaggatgccgctgcggggctgcagggttctgtccctgccgccgtcccccccaccctcccaccaccaccgactcctgggctctgctatccagcagatagcacccatgaggagcatgctgacccatgaggtcacttgggttaattcaaactaggaatgttaagcccaccattggcagccagtccttgttaattcataatgtgctgctgctgccacatctctaatggaattgcttattttattgaaagatagggactctggctgtataatgcaaggtgttcattacatcgcacctatcttacctga

SEQ ID NO: 22229 - DNA, 1058 bp, Homo sapiens
tataggtgatctcagtgtgtacctgccacacataggcctctctaaggtgagggtagggtgagttactgggctaggtgactctctgggacatgagatatgggtcaagtgagtgtgtacctggcccgcccaggtacaggtgacggtaaacaggccaagtctgggtgtacctgtggacaggagagtccaggctaggtgattagagtacacgtaggttcagggctgtctggggcagaagaggatgtgtctgttggtggaggtgcccagctgtctatgccaagcatgaatgcacgggtcaggtgatgtatccctgtagagagcatgtacctatggactaggctgcctgggccaggtgagagtgtacctgtggacaggtgtgtctgggccaggtgaaggtatatctaatttccaggttgaaggtagagtgtacctaatggatgggtgtgtctaggataggcaagggtggcctcgtggttggggcttctagacaaggtgaatgaatgtgtgattgttgagagatgcatctggccaggtgagggtgtatctgacaggtgtgtctgggctacaagtgcatgtttgatggacagctgtgtctgctatacttgagtgtatacctgtgggcaggtgtgtctgtgccgggtaatgatgtacctgtgatggaacagattgatctaggctgggggatagatacctgtgggcaggtgtgcctgggctaggtgaggatatacctgtgatggaacagatggatctaggctgggggatagatacctatggacaggtgtgtctgtgccaggtgagggtatacctgtgatggaacagatggatctaggctgggggatctatgcctgtgggcaggtgcatatgggccaggtgagggtgtacctgtgatggaacagatggatctaggctgggggatatctggctgtgggcaggtgcatctgggccaggtgagggtgccaggctgtagtcagggtcttgctgtgcccacccactagtgcctcaccttgaagcggcggtcgtacttggtgaccgaatcggcgaagtccacccgctccctcttg

SEQ ID NO: 22230 - DNA, 1027 bp, Homo sapiens
ggtcttgggtttcctgtcctggggtaggaatgggtgtttgggaagaaacatactgaagaccagactgaaggaggaggtaacgtctagggtgtctgaatcccccttcttggtgtcccctggggggcttgcttaccacccagtttgaggggcagacatattggcttcttctgtgtcttggatcaggccttgagctgctggaacaggagcagctgtgtgagggcatcagtgtcctctctctccctggctgccccctgcccctgagaaccaggtatacacccacccaggtggaagggtccattctgcagggaaggtcttccaggggcctggagcccaaggacttatcaaggctccctcctcctcagtttctcactcagcccctctcccattattattattattattattattattattattattattacatcagggatcttgttagattctagataaaaatactcaaactccaatcatggggagagctcatgggatggggggctcatctggactggtactgacactgagaaccagatgcccctggccaactggatcacttggactcaggagcatcgcccacccccaccagatctgggggctgggctagttcttggctactccaagtttatcagagccacaaatgtgtgcagggtgaggacgtacaaagtgcctctctctcactagtacaacaggtgggcagtatcaccaaacaggccaagagctcccctgtgactgggcatccctagaatcctgcacatcacaggtaggacctcctctacttgctcagcctttggttctggtccagggcagggattgggcaagatcagcccttctccttccctccatgcctgaccttccagcaggtggcttttctcatgtcactgagcctcccttatacatctataaatgtttacctataaatgagcccattccctagaaatatattgtgaatattaaataagaggcagtaaataaattgcccggtataggggcttctctggactgttttatcttcataaataatgtgaat

SEQ ID NO: 22231 - DNA, 1023 bp, Homo sapiens
agtcacgtgagagcaagagagtagctttctggttgtcctggtgccctgctcaggcaaactgactgccattctctgaggatggcagctctgtcccccacatttggtaagttcttgggtcagtgcgtgccctgagaaagtgagtgcaagtggcccctgccacttgatggggtgaaagatacgtacaccatagagggctgctgggagaggatgggcaagtggaaaaggggtgggaacagagccccagcagccaccccagtgactgtgtctgctgagggtcttggtgggtctgggagcaggccagtgtccttatcattcatgcatgaagagggtgcaggtaatgggtaaccctgagttatctcatttattattttgatcactttcagcaaggtcacaactctagctctcagaacttgcatttcttcactcctaggttggaactatgtcacttcttatgagtatgtagcccaccaccctctttatgtttttggtggaacagggctgctctgacttgttatgaaactgatgtgtgcaagagaggtggggggaggaagagagagagaggattgaggatgtgaacactcagaatcagtgtggagcagtttcctggtttacaagtgttgtattatgagacagggcaggctctgattctcatgaaccctgttttctcctccagccacgtccacccaggattccacctgtctccaggactcagaatttcctgtttcttcaaaagaccattcctgtccccagaatttggacctgttcgtgtgcagtggtctggagcctcacacacccagtgttggttcccaggtgcactaagatctctgggtccctagagcaggagaggcacttcctggaagaccccaccagtgcatgctggaattcttgcagagcttcatctcagccagtggatgccagaacagggcccaagagagagccaaggaatattggggctgtcctggtgttggggaagttaggggaagtgatttatgtagcatctgtttccctcatgcttgcaaaatc

SEQ ID NO: 22232 - DNA, 1032 bp, Homo sapiens
ccagcagtaaaagaaattgggtttattgaagcagcagggcacagcagagtggctgccccttgtggagcagggctgactcataggcagtatacccagggtagcagcatataggctgttggctagcagtatttatacccagttttaattacatgcaaattaaggggtgggctattcagacagcactcctcattcaccttccaccatgattgtgaggcctccccagccatgtggaactatgagtccattaaacctctttatgaattaggcagtctcaggtatgtctttattagcagtgtgagacacagttgctccggcctataaatgacacatagttttaagtctgtttcctgcagttctcctatgattggccagggttttgattctgttttgtttttttgcattttcaaattaagggtagatgattctgagggtcttgctccagctctgtctcaggcccccccaccagctatccctctttcttgcagtttacctaacagagccttggggtgggcatgtgtgggaccgtggtgctaagatttaatgctttttctcattttactcatagttatgttgcaattttggcattctctatgtcttaaaggcagtgttgaaggtatagttttgtgtagaagattcataggtgtggagttacttcacagcatttgaaaggggatttggggaggttgcttaccactcactggccattgtttttagttacctggaagtctcctcaccttagtttttggagatactttggctgaatatgttattttattttattttaatttattttttgagacagagtgtcgcccaggctggagtgcagtggcatgatctcagctcactacaacctccacctcccaggttcaaacgatcttgtgccttagccacctgagtagctgggattataggtttgcaccaccatgcctggcaaatttttgtatttttagtaaagttgaggttccatcacgttagccaggctggtcttgaactcctgacctcaggtgatctgcctgcctcagcctcccaagg

SEQ ID NO: 22233 - DNA, 1057 bp, Homo sapiens
tataaatgcaactgttctcagtttgtgctcctctagggttgcttgcaattattagcttgattatggatttctcttcaaggtattttggttccagtattgttactatgtgtttccatgagtgaacagagaggtagggcttcctactctgccattttactgacattttttatgatatattacttattgaatcttaaaatacaaataaagtagttctgaattgctaattcagacccctgtggaaaacagatttattaactgagttatttttgtgtcattcttttatatttaggcttagattatatgttcaaaatactgttttccaaaatcacttagatgagttatttttatctttcaatatggttttgttattcatttgtaatacagttaaaaagcagtcgtttttgttaccttaaagtataatgttagctttggcgtttttgtagatgccctttattaggctgaaaatttttcttgggcttattgaacttcattaaaaacaatcatggttaatgaattttgtcaaattccttttctgcatctcatgagatcatctgattttctggcctgctaatatgttgcattaaattaatttacatttgaatatcaatctggcatttctgggatatgttctaacttgatgtattatcttttcatatatagaggtatacatatgtatgtgtgtgtgtatatatatatatatcactgtattcattttgctaaaattttattgagggtttgtgttaactctctgctctgcaaccagcctgtgatagctgagggcccagagtaccttaaatggatttatcttcacccctttgccctgccacttgccttggggggatggttgcctcggtcatcagggaggctacatgcacctcagtgatcctgccttatcccagcctttgatatactatggtctaatattaggtgaaggcttggtgaaagtctgtggatggattcatcactgtgaattctgtaactgagatgtctcagaattctaatgtggtcaatcagtccacactctgctgtcaaattttggtaagatttaattatgatt

SEQ ID NO: 22234 - DNA, 1083 bp, Homo sapiens
gttcaaggctgctgtgagcttgatcctactattgcactccagccttgggaagagtgcagccctgtctcccccatacccccagaaaaatataaaatagacaaacttttgcacaatgtgtgattcagcatttcatccaccccatacattttcttttttcttctttttttgttgagacaaggtctggctctatcgcccagactggcatgcagtggcgtgatctcagctcactgcaacctttgcctcccaggctcaagccaccttcccacgtagctggcactacagacacgtaccaccacacctggctaatttttgtggtttttgtagagacggggttttaccatgttgcccaggctggtctcaaacttgtgagctcaagtgatctgcctgctttggcctcccagagtgctgggattacaggcatgagtcacaccccaaatattttctaccctctgctaggacctatgaatattaaaagaaaaacttcagataaacgtaatagttaagcattaaaggattcgtgaatcaggcagcactccaaaaccagaagggttcagggggctctgctgtagcagcatgcacagttggcttttgtagactgaatgtgaaagcaaagtaaagaaattacttaattggcttagccttagcagtattctgagtttctttagtgaaccattattattactctattgctttggataaaaagttgagtgtcaacttttttagggaagccagatgtcagttttcaagtgtcttatggttattttcttatattttcttgccagaaccagttctgagtctgtaaatatacatttatatgtgtgtgtgtggtaggggaggtggaggatgatattacttatccattcatctatttttttccatagtacttgtcaccaattgacataatacatatttatggctggacacagtggctcatgcttataatcctagcactttgggaggctgaggcaggcggatcacctgaggttgggagttcgagaccagcctgaccaacatagggaaaccctgtctctaccaaaaatacaaaattagctggggttggtggtgcatgcctgtaatcccagc

SEQ ID NO: 22235 - DNA, 1045 bp, Homo sapiens
aaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtg

SEQ ID NO: 22236 - DNA, 1035 bp, Homo sapiens
gtggtacgtgcctgtaatcccagctactcgagaggttgaggcagaattgcttgaacccgggaggcggaagctgcagtgagctcagatcacgccactgcactccagcctggatgatatggtaagaccatctcaaaaaaagaaaaaaaaattaaaatatcctcagagggttttttaatgaaaaacttagttatagggaattgaggaacatttaggggtacaaattttcacttattgcacacaagaaaattggtactggccaggcatgctggctcacaccttaattccagcaatttgggaggccaaggcagaaggatcacttgagcccaggagttcaagaccagcctgggcaatatagtgaaacctcatcttgacaaagaataaataagattaactgggtgtactggtttgtgcctatagtcccagctatttaggaggctggggcaagaggattgcttgagcctggtcagggaggcagaggttgcagtgagccctgatcgtgccactacactctagcctgggcaacaggatgagaccctgtctcaaaaaaaaaagaaaattgacgccagcaaagaaaaccaaataaattatttaagtttgcctttctatatgtctttaaagactaatgatattgaacatcactttcatatgcttatgagtctttggtgaagtgtacatttaatgatcttttttcactgttgctgagaatctttggtttgaattattgaggcaggttctttcagtaagtttgagatataattgccatgtaataaactgcacatgtttttagcatacactttaagtttggacacatacacatatgtgtacatacacaccatcaagataatgaacatacctatcaaaccagatggtttcctcatgcccttttataatttcttcttctcctcacccttccctgcctgtcactctcctgatccactgatttgctttctcttagaatagacgactttatattatgtacagtttttatataaatggaatcatatagtctggcatctttcaggataattttttcag

SEQ ID NO: 22237 - DNA, 1031 bp, Homo sapiens
ccagctttttcttttcagagttgtctttactattttaggtcagaggttggcaaagttttttataaaagaccagattgtagagattttaagctttacatgctatatatagtttctgttgcatattattttttctattacagaccttttaaaatataaaaatagttctcacattccattcaacctatacagttataggctgtgagccacatttggtcttgatgtggctgtaccttgttgacttacagctgttacaggactttcgtatttccatataaagtttagaatcaggttgtcaatttctaccagcaccaccccacacccccaaagtaattcactaagattttgattatcattgtgttgaatctgcagaataattgatgtcttcacaatattgagcatttcaacccatgaacataatatatctctccacttatttaggatttataatttttttctcagtagtatttgtgtttttcggtgtttgggtcttcctaggcattttttctctgacactattgcaaatggtattttaaaaatttcaatttctctgctagttcactactactatagaggaacacagtttttttacatatattcatcttgtatgctgcacccttgttaatttgttctggaagatttatattaacattatacttagaatatattaacattataataagctacataattttatttttttattttttaaattaaaatagagattggggtctcactatgttgaccagtcttgaactcctggcttcaagcgatcctcccatcttggcctcccaaagtgttgggattacaggcgtgagccactgaacctggccacaattttattcttaaatgaaaatagatctttgatatcatcgccagattcatatttgttttttgttttcttgagatggagttttgctcttgctgcccaggctggagtgcagtggtgccatcttggctcactgcaacttccacctcccaggtttaagtgattctcctgcctcagcctcccgagtagctgggattacaggcac

SEQ ID NO: 22238 - DNA, 1047 bp, Homo sapiens
agtcaggagtttgagaccagcctggccaacatggtgaaaccctgtctctactaaaaatacaaaaaaactagccagcatggtggtgtgtgcctgtaattccagctactcaggagtctgaggcaagagaactgattgaacccagggggcagaggttgaagtgagctgagatcatgccactgtgctccagcctccagcctgggtgacagagcaggacttcatctcaaaacaaaaggaattggggcaaattttaaaaatattttagtaatatacataacatgctttttaaaaataacttttccacaatggcaacaaaataatgtggaaagagcgacatattgcatgcttttgcaaatctctttaatgtcttaagagcttaatagatgacagctgaattctcatacttgtttctacattttttgccattagttgctttgattagaaagtttggctttgctgagatacgtagttggaaaagagagaagcattttcaggtaattttggattttctttgatattacaccaaaactcaagaaatggtagtttctgaaagattagttgcaatatggaatgaaatcctgttaaggaattgtttctattctgttacattaaaattcatttgtttgtcttgcactatttttttcttttccttttatttatttatttatttatttttgagacagagtctcgctctgtcgcccaggctggaatgcagtggcgcaatctcggctcactgcaagctctgcctcccaggttcacaccattctcctgcctcagtctcccgagtagctggggctacaggctcccgccaccgcgcccggctaattttttgtatttttaatagagacggggtttcactgtgttagccaagatggtctcaatctcctgacctcgtgatccacctgcctcggcctccgaaagtgttgggattacaggcgtgaggcactgcgcccggcctttttttttttttttttttttgagatggaattttgctcttgttgcccaggctggggtgcaatggtgcgatctccactcactgcagcctccgcc

SEQ ID NO: 22239 - DNA, 1032 bp, Homo sapiens
caccagcgcttttggccacttttataatgtgtcatcagtataaatgtggatatggtgaaaaggtcaagaatgtatttgtgctattataacaatagttttttttttttgtttttttgtttttttgagacagagtgtcgctctgtcacccagggcgtgatctcggctaactgcaagctccgcctcctgtgttcacgccattctcctgcctcagcctcctgagtagctgggactacaggcacccgccaccacgcccagataattttttgtatttttagtagagacggcgtttcactgtgttagccaggatggtctccatctcctgacctcgtgatccgcccgtctcggcctcccaaagtgctgggattacaggcgtgagccaccgcgcccagccataacaatagttttaatctcacagaccgcctgaaagtgttttgggtccctcagcagtttaccaaccctgagaactgctattctgtatcacttaagtttgaagtggtttttttacacaacaataataatcagaaccgaactcatatcccttttttcttcttctttttgattattagtttcttcagtgtactagatggctgactgggaagattccagggtcccaacaggcttcagagttgcgaaggctctagaggtactgtttgctcacatagagcctaggtgttgagggcttagactctggagcccagctgctggaatgtgggccctgcagctgttactgttgagctgtgtgtctggagcccttcccttagcctttcctgagtctcattctccgttggttaaatgatgtcattaataaggcaaatgattttgttgctaaatgccagtggaaactttctaatagtcataactgtcacaaggtctgatgacctcacagttattttgcccttaacggatgccataaaatgcccgaaaagctttcccggggtcaactcacttcattacaactccctgagggagtaccattgttaatgtcttatgtggtctgtgtactatgaaatatccaccaccatctctgatgga

SEQ ID NO: 22240 - DNA, 1028 bp, Homo sapiens
ttgggctccttttccatttttttggaagagtttgagaaggattctttaaatgtttggtagaattcaacggtgaagccaccaagtcctgggcttttctttgatggaagatttttcctcactgatttaatctccttactcattattgatcttgtcaggttttctatttatgattcagtcttagcaggttatatatttctaggaatttattcatttcttctaggttatccaattttttggcatataatttttcattatggtctcatgatcctttatatttctgtggttatcagttgtaatgccttctctttcatttctagttttacttcagtcttgtctattttaatcttaagtagtctggctaaaggtttttgttggtttatcttttcatacaaccaacattcagtttcatcgatcttttctattgtcttcctagtctctcatttatttctgctgcgatctttattattatttccttccttgtactgactttgggcttagtttctttttccttctactgactttgggcttagctgctgctttttctagtaacttgaggtgtaacattaagctggtataagatctttcctactcacccttgctctctttggtttccatttacgtggaatgtcttttcccatctttttactttcgggctacatgcattcttaaagctatagtgagcttcttgtaggcagcatataccttaggtctttcttttttaatccagtcagccactatgtgttttgactagagaacttaatccatttacttttttgtttaaggagatagggtctctgtcacccaggctggagtgcagtggcatgatcatactcccactactctcagattcaagcaatcctcccaccctagcccaccaagtagctgggactactggcagatgccaccacacccaaataatttttttaaattgttttctgtagagatgcggtcttgctgtgttgcctaggctggtctcaaactcctgctctcaagtgatcctcctgcctcagcctcctgagtacatttat

SEQ ID NO: 22241 - DNA, 1071 bp, Homo sapiens
ggagatcgtgccattgcattccagccagggcaacaagagagaaacaccgtctaaaaaaaaaaagtggcatttcagataaatggggcaaaaaatgccatttgtaacaaatggaaggtctaagatagctggttagccatctgagaaaagatgaaattaaatccatacttcacagcatatacaagaataaactccaagtggactagggatctaagtgtaaaaaataaaaccacacacgtatttagggtgtttaagtgatttcttggctgagtaaggaaaaagatgttaccacaaggcggcagtagcacacaagcttcatttgggatgtgctttgacaggttagcagtgggggaggtagcaaacagcaagagaatatccacaggcttctacctgtgggtcgctgctcagaaagggtggaaaggaagaaagactctcagaggagaaggggaatcaaagagggggcttataaataactaaatgatgatattcaccagactggcagcatatcttccagttaaaaagctctgaaggataagtctggccaatatggtgaaactccgtctctactaaaaatacaaaaattagcaggtatggtgccaggtgcctataatcccagctacttgggaggctgaggcaggagaatcgcttgaacccaggagatggaggctgcagtgagctgagattgtgcccctgtactccagcctgggtggcagagcaagaccctgcatcagaaaaaaaaaaaaaaaaaagctctgaaggaccgcaggggtatggggttttcatagccctggagttatcttatctatggctgtcagatattggatataatttcagagaatacaaagcaggcgcactcgaaatggctaaaaataggcttgttcaggctatgtttcaaacaatccagtgtgttaaaattgcagtttggcaggggtaggctattgtgaatactagtgagacaaacattggtgtacaaatatctctgagtccctgctctgaacagttttggatatgccaaagtggaatatctggatcacatggtaattctgtttaatcgttctttttttttcttttttt

SEQ ID NO: 22242 - DNA, 1058 bp, Homo sapiens
atcataataggggtgctcattctcttagggtgctgtattataccctgtgtctgcggactagttcaaaagctcatagaaacagcccttaccaagacctcccacaactctcccccaccctattcagataaacgtttatttctaagcaaccaagaagagcagtgaagccagatcctgttagaaatatatgaagaggaaggactacaaaatcaaaaggggaaaattattagacaaaatgagttgctctacaaaggtccaacttcgttgtcctttgttctgtaacctttgttctgtaaactgcccttcccgcagaaactgtctttcccgccgaccaaaactgcccttcactatcactgtaatccatacccctactctatttgaaactgccaatcgggatcagcttacattgtgtggttcaaccaccagccaatgaggaaaaaacacagaagcaaaagctatgatgcattagggttaaaaaccccttcctttccctgtccaatgtgctcttgagactgctacaggcgcaagcagccaccttctgcagaagtaaaccttgccttgctgagaaatttttcttttgagtgctggtctctctctgtggcaccaagaacttatttctaacatggagtgatttccaagatagatggttaagtgaaaataaaaactgttgccaggcacggtagctcatgcctgtaatcccagcactttgggagtctgaggaggttggattatttgaggtcaggagtttgagaccagcctagccaacatggtgaaatcctgtctcttctaaatatacaaaaaattagccgggcgtggttgtgggtgcctgtaatcccagctacttgggaagctgaggcagaagaattgcttaaacccaggaagcagaggttgcagtgagccgagatcacagcactgcactccagcctgggtgatagagtgagactcggtctcaaaaacaataataataataataataatacaaataaaaaaatgaaaataaaggccaggtgctgtggctcacccctctaatcccagcactttgggaggctgaggcaggtgga

SEQ ID NO: 22243 - DNA, 1050 bp, Homo sapiens
ggctcactgcagcctctacctcccaggtttaagcgattttcctgtctcagccttccaagtagctgggattacaggtgcccaccaccacacccagctaactttttgtatttttagtagagacagggtttcatcgtgttggccaggctggtctcaaactcctgacgtcaagtgagccacctgcttcgtcctctcaaagtgctgggattacaggtgtgagccactgcacccagccagaaattcttttgtaaagttttggttctctccaaataaaaatggcctggtccaaaatgggcttccttagccctgggctgagacctcaggccacctgacccggctgtgaatggatgagaggggtggggacggaagtcagagtcaggattccttaacacctttccttcagatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgctttgttgttgtctctgtatgacagctgtctagtgatgggtggatcagtcgctgtttggtcatcactgcaccatcagcatgcagctgctaaaataagagctctgatcaactggatccatgagggcagagtagaccagcaggctgggagtctgtgtgggagcccagagagagctctggggtttgctgtgggtgtctgaaggtcaagagactctgggattattgtcaccctaataaaccaaagaacctccggctaatgacagtagatgtaattgttaggaattcagattctgaaatcacacagaccatgtgtggaatgtcagctctgccaccaagcagctgagtgacactaggcaaaattttttaacctctgtaagcctttacttccttatccactggaaataattgcgtttacttcatgtctgctttcaatcggcatattgtgaggaggtataaatgagtttaaagcatgtttaaacatccacagttcctggcatttttt

SEQ ID NO: 22244 - DNA, 1052 bp, Homo sapiens
ccagtaacagggcatgtttttctctgtgtcaagcgctttaagttctctctgaattgccgcaactctgggagccaggtagttattacttccaccttaccagcaaggaaactgaggtcagaaaactgaaggaactcgtccaagatcattcatttcaggggccgggggttggattaggacctaggcagtttgcctacaaatccccctccccgtgtcactgcaaactcctgaggagcaggcccagcatctgtgggcaggtcccgagtcactctgctgcctctagagcccatagcaatcgcatttgcaataataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaatgtgtgccagtttctgtcctaggcattttgtagatgtgtgagcttatttagtgct

SEQ ID NO: 22245 - DNA, 1030 bp, Homo sapiens
aataaaggccaagcctcataaacaatcacctgtgcccgctcccatctggctggcttcgggagcaatcgctcattcgcctgctgcctgcctgccggagcatttgtcattaggaaggtttaatgggtttcctctcagctccagagggctggggagagccggctgcatggatacaccgccaggcagaatgttctcccatcgcctggtggaggggggttgggagtgaggcagccatgccaccattcacaccaacagttggatgtggggttggggaagtgactgcacccctcctggaacagtagaggccctgggtctggaaggatcggaaattagtggctggggcccagagggtttgctgagttccactccagggtgaagaatgggctttgtgtcctgaccatcagcagcagggcccagggaaggctgtgcatcgttctgtgtgggagccgctgcccccacccgtgtgtatgtgtgtctgcgtttgcccaagaatgtgtggggccatgtgactggtcgtctctctgtcctgtgcattttgggagtcctccggttctgagagtcctccggttctgagtgtgaccacctgcccctccaggtacccccttcccttgtctgtctgtgcagtggccaaaacccaaatgagaatgtcgctgttaggtaaacatgcctccagagcccacttcggggccggtgattcattattaagcagctgcgcattccctcacctcccacccaccccctcaccccctcctgtctagaaccagggcataaatcccaggcctttaggatggtgacagtgtagtcttccctagtgccacttacaggcacctcccaggccagacccgccccagggggtcagtctctacgtgcccctggcttctgtggccgctgggcagagctggagcaggtcaccttggggtaaacggtattactgccccaggacaggagttggcttcgctgtgcccacgtccatgatgagaggggaagtcagtgagttagcagtggatagccgaagacgcacacagattgatcc

SEQ ID NO: 22246 - DNA, 1067 bp, Homo sapiens
gtctgggcgaccggaggagaccgtgttagaaaaaaaaagactagaatctggaggcagcaaagcagggttggaaactgacttctccccagtatctgatgcaagttacttaacctctctgggcctgagttcgctcatttgtcaatgggaagatgcgctgtgagcaagagacagagttagaactcaaatctgcgtccgactgactctaaaggctaagatccttttgctcctctgggcttgttgaaagggtcagatgcaagacagaccataacaggatctgcaccgtcagcttatagttgtcacaacaagggataagctatgttttctttttttctttttgtcatttccaggttcgtaagaagaactcgctgaaggactgcgtggcagtggctgggcccctcggggtcacacactttctgatcctgagcaaaacagagaccaatgtctactttgtgagtagacgccctcacccttcatctcccccagacccccccttcccctatctctcatgatgaacacatatgcctctgagctgctgtgatttctggcttcaaagtaaacgctctgaagaagagatggggcaaaggtgcctactccgggcacctctgctagacccctccagagtcactgatcttttcttctcctgcagaagctgatgcgcctcccaggaggccccaccttgaccttccaggtcaagaaggtgagaggggtggaggtggtacaaagccatgtggggtgggagctggacttggggttgtccgcagccatgtgtggttggtggtcaccccctcctctctcctgtcctacagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgggtctggcctggcgaggtggcaggtatgggggggtgcagcggatagaggtgccacaggccctcagatggattgctcactcctcccag

SEQ ID NO: 22247 - DNA, 1070 bp, Homo sapiens
tttactttttttttaagagacggggtctccgtacgttggtcttgaactcctgggcacaagcaatcctgcagcctccgcttcccgagtagctgagactacaggcgtgcaccaccacatccaactcatttttccatctactttttgtagacatggagactcgccgtgttgcccaggctggttttgaactcctgggctcaggcagtcccaccacttcagcctctggagtagctaaaactgcaggtgcgagctggaagcagcatttctagccagtgccacagtccacgaacagtgtgtgtatcccccaaagcccccacttccccaaactttgccatgagtctactggactatgctctcttcctccccttccaggtgaacctgaacaccatcaagcgctgcctcctcatcgactacaaccccgactcccaggagctggacttccgccactagtgagtgtcccagcaggatgggagacgagggggtgccgggtgggggcctccacatgcggctgatgacagcacttctgctgagacgctgtgattgctctgtccaaagtaaacgccctgacgcactgtgggaagggtgagatgggcaccgccagccccatcacgtgccccctgaccacccccttgccgtccactcatgttcctgcagtagcatcaaagttgttcctgtgggcgcgagtcgcgggatgaagaagctgctccaggagaagttccccaacatgagccgcctgcaggacatcagcgagctgctggccacgtgaggagggcatagggcgggaggccactgcggcccggggaccccagaacaggaccgggagcctgagctcccccactgagccctgttatgtcctacacacaggggcgcggggctgtcggagagcgaggcagagcctgacggcgaccacaacatcacagagctgcctcaggctgtcgctggccgtggcaacatgcgggcccagcagagtgcagtgcggctcaccgaggtgaggcccagggcagggggacccccgggctccaccagtcccaacggtgggctgacgcttcttcctcgtcccctcagatcggccc

SEQ ID NO: 22248 - DNA, 1048 bp, Homo sapiens
aaggagtgagtgcccctgtgctgctgtgccctgggcactgtggtgagcactggcaccagtaatgggtaagcaggcccccccatcctcccgaaggagggagatttttctcaccgtcatcaggtggcgcagggtatgggggaaaataacgcagggaagggagagtggaggcacgagggctgctgtcaacagtggttagggtggccttggggcctctcgcaggcaggaccacggacgtgggaagaggagcctcaagaatgtctgggtgtggctgggcacggtggctcacacttgtaatctcagcactttgggaggctgaggcgggcagatctgaggtcaggaattcgagacctcttggccaacatggggaaaccccatctctactaaaaatgcaaaatttaaaattaaaccaggcgtggtggtgggtgcctgtagtcccaaatactcaggaagctgaggcaggagaatcacttgaacccgggaggcagaggttgcagtgagctgaagtcacatcattgcactccagcctgggtgatgagagtgagactctgtctcaaaaaaaaaagtctgggtgcgaaggtaccaaggcacaagtctgcaagagcagccaggaagcctgggtgggctggtgcgagggagtgagtcgcggagcacagagggtggcactggggggtatggcgggcgggagcgctcttgggggaccttgtggggtgagtctggctttttggcggcaactccctggccaagtgtgagcacctggaagcaaaaggatggggcaggactccagcgctcgcgggtgctctctggtggccacggggagaagaggctttgggcggcggcgggtgccaaggtcagggcagagtgggggctggacccccacggggctttggacggcacagatctgaagtggagccggcaggccttgctggggctggactttggggaggaggcctctagtggggccaggtgtggtgggggagtagggtggccgctgtctgtgttaccagtggaccttgagctccaagactgcctggcccgcctaagctggtcc

SEQ ID NO: 22249 - DNA, 1048 bp, Homo sapiens; identical to SEQ ID NO: 22248

SEQ ID NO: 22250 - DNA, 1048 bp, Homo sapiens; identical to SEQ ID NO: 22248

SEQ ID NO: 22251 - DNA, 1048 bp, Homo sapiens; identical to SEQ ID NO: 22248

SEQ ID NO: 22252 - DNA, 1048 bp, Homo sapiens; identical to SEQ ID NO: 22248

SEQ ID NO: 22253 - DNA, 1033 bp, Homo sapiens
caccaccatgcaggctaatttttgtatttttagtagagatggagtttcaccatgttggtcaggctggtctcaaactcctgacctcaaggaacctacctgccttggcctcccaaagtgctgggattacaggcgtgagccaccgtgcccagctcattttcagttgttttctgatcactcactgatgtgggcattgtggtgggtgagaggatatagcagggaccacgaggacaaaacaggcaaggtccggctgtgtgcaagtggctcaggcctgtaatcccagcactggaagctgaggtgggtgggttgcttggggccaggaaagaccagcctgggaaacagcaagacccagtctctaccccttcccccacaaccccaagaaaaagatgggcaaagtccctattctaatgaaggtcacagtgtcatgggaggagaagtgaaggtgagtcagatggtcatacgtaatgtgtaattatgagcatgtcccagagaatgggacgttcaaccttgggtctactgtagaagctaaccagatcaaggaggcagtggggctagtgtggagataacaggaacagggtgtgcaaaggccctgtggcagggaccacaaggaagccagtgttgccacagaggccagtgggagcagtggggaggagtctgggttttgtgccaagaacattgaagaatccattaccagtcagggtcttatccatccaccccagaggtctggccagtcctccccctgctcacaccttccctggctccccatcaccctaggaataaagtcatcagtctgctattctgagttcttcctgatttccttgccctgctcctctttcctgattctccctgtctgtgtcatttcccatggccctccctccttgtggctacaaccacattaaaattgttcaaaaaataggccggcacggtggctcacacctgtaatctcagcactttgggaggccaaggcaggtggatcacttgaggccaggagttccaaaccagcctagtcaacgtggcaaaaccccatctctactga

SEQ ID NO: 22254 - DNA, 1032 bp, Homo sapiens
gatctgcccggctccctgacacctgcctcgtggacctgacccccctcctctttgtgcctccagagctatgccaagaccaagacgagagccgaggtgcggggcggtggccggaagccttggccgcagaaaggcactgggcgggcccggcatggcagcatccgctctccgctctggcgaggaggtaacaggacagggtggagggggcggggaggggtgggggggccagggaagggcctgggtgtttactcacacacagctgcgcacatctggcatggtattatgtcagccctgttccctccacctcatggaaccacctgggctggtgacatcggaactgaggcccttggacctcactacccatataaggggacagagatctgggagccatccactcctccctctcgcatgccctgtctcttcagcctgtggccacagcccctcttgaccccacctcctgtcaccctctcctgacccacacttcccacagcacccagagagctcttctaaatcgtggaacctgaactccggacctcggcctttgtgtggaacctgaactcctgaccttgtcattgtgggccctggtggctgcacacctttccccctcatcccctcctttccctctctgaccaggcagagatgactctctcttgttttttcggttgtgtttgtttttaactttttattttcttgaatgctaacaagatgactcagggtggtgccagccaccccatcacctgtttacctggccagctctcctcacctttcagggttctgggccacacctcctccaggaagccccccttgatctcctttccttccacatcccccggagctaccctgatttcttctacagctgagcctcttttctgccctgccggaatgtgaatggcatgagggcagggaccatgtctgttgtcttctctgctgcatttccaaggcccaggcgagggcagacaccaacacatggtgcttgcaggggtctccctgactgttgttgctcccagatcatactgcttgctccaccggagcatg

SEQ ID NO: 22255 - DNA, 1053 bp, Homo sapiens
gctggagaggggcgcctgatgactcctcggactttctcagcccgaggaggactggacctgccctgggggtgtctaaatcgggggtggtatggccctccccttgcagggttaaacgtggaggggagactgtggccctgccttgggagctggggtttccccgcctcggcaacagccttctccttgtcttccacctcctgccattcgcagcgaggactcgcgcgagcgcgcgcgcgcacacacacacacacacacacacacacgcacacacacacacacacacactttggaatcacccggaccccctcaaaacgggtctcggctccccaccccgctggccgctgggtgtcgctagagtctagcccacggcgcgtattcctggccccgcgcttggtggggggaatcgtggaggggtggaagggggctttccttgtcgtcacagtctggggccacgcatagcccctccccgttcgtcttggggtacgcttcctccgccggggctctaaggactccattactctaagcatgcagggcctcgaccacctcacacttccatgcatcccaatccacgctttgataccaggataataggccgtgttgcagccttgggccaggattatctcagattaaagggtgctccctcgggggtcaggctggataggaggagctccagccactccggtgaggggcgcctcttcctagtctcccctggagccgacgttggaggcagtgcctggagagagcgagcgaagttctccagaagggggaggattccccggtgcatggagcgggaagggccatcggacaaaaacgtcctcccgctgccgcccttccccctcgcgcttcattcaaacccgcgagtgggcgggcaggggcgggggagtccccatctcctacccctccctcttcccctccaccctggcagtccagcacatcagtggccgtcacggcccgggcacgcgcgcgcacggacccacaccccggcggctctcacaatcgcacacacacatacacacacacaccagcaaacaaagggtctggacacccccgtcccct

SEQ ID NO: 22256 - DNA, 1053 bp, Homo sapiens
cttagccgagtcttcctggagctgagaggtgcctaattgtttgtggtttttctgattgaacttgtttggtgcctctaggcaaaaattcctttggctccttctagtattttcagggtcttgaaggcccatattcctgagcatgaggaatctaagtctgttattttttcctaaattttcatgttaaataccacgttgacaaaggacagctgctaatattttgatcacacagatacagacggtgctccctggttaaggcctccaggtaggggacaggtagagtcagtgatggggaagaagccttctgtaagtccctttcctttgggtagacagtagattaccctttaggctttagcaagatgtgggggttagaagtcttctattcttggaaaagcctttagtcgttttctttgggctggggcctcttctcttagggactgctgtcaccctttctcggtttcttttgattacctttcatggccccagaggagtgatcccttcccttatttatacctcttggacttgtcatcctgctacattttgtcagcaagttaattcaccttgtgcagttttgaaagatgtgtaagtgttaacatttagtattagcatttatggcccaggaaattgtgaccttaatatttgaatcttgcttttattaaacctttacaggaactaggattttgtagggttttttttttttttttttttttgagttagagtttagctcttgttgcccaggctggagtgcaatggcgcgatctcggctcaccgcaacctccacctcccgagttcaagcgattctcctgcctcagcctcccgagtagctggaattacaggcatgctccactacacctagctaattttgcatttttactagagatggggcttctccatgttggtcaggctggtctcgaactccgaacctcaggtgatccaccggcctcggtctcccagagttgtgggattacaggcgtgagccaccatgcccagccttctaggttctgtttattggatgctttttatcttaacaaagtcctggcagagaaagatttgatt

SEQ ID NO: 22257 - DNA, 1028 bp, Homo sapiens
tcagcctcctgagtagctgggattacagacgcctgccaccacgcccagctaatttttgtatttttggtagaggtggggtttcaccatgtgggtaggctggtctcgaacccctgacctcgtgatccacccgcctcagcctcccaaagtgctgggatcacaggcgtgagccactgctcccgtccaatttttttgtatttttagtagagaggggtttcaacgtgttagccaggatgctatcgatctcctgacctcatgatccaccagcctcagcctcccaaagtgctgggattacaggtgtgtgccactgtgcctgatagtggggtgattttctacttctaactctctaatgtgtcacatggctttttttaatagattgtctgtatcaactgggggtgaactttagtcttttaacaattttcagactatgaagtttggatgtaaacacctctaatgtgggaagttagttttttttaaagtatctgtatggagttatggatatatataaatttaatgtgttgaatctgttttattttagtaacatcttttgaaaatgttcaaacatagaaaaaagggtgatacaattttagtgaacacttaggccgggggcagtggctcactgcctgtaatcccagcactttgggaggccgaggtgggcagatcatttgaggtcaggagtttgagaccagcctggccaacatgttgaaacccccgtctctactaaaaatacaaaagttagcctggcatggtggtaggtgcctgtaatcccagctatccgggaagctgaggcaggagaatcacttgaacctgggaggcggaggttgcagtgagccgagatcgcgccactccgctccagcctgggcaacacagtgagagtccgtttcaaaaataataataataaaaaatttaagctgggcgcagtggctcaacgcctttgtaattccagcactttgggaggccgaggcaggcagatcacttgaggtcaggagttcgagaccagcctgacaaatgtgatgaaaccccgtctctac

SEQ ID NO: 22258 - DNA, 1045 bp, Homo sapiens
tgttgctaatgcaagaaggaagctagtggctgggcaagtggggtttcaggtccaagtctgtgcagaagctttccttgggcgatcgatcgagtggcttgccccatggtgtgagtctcaggcatgttgagccactgagcccagggactggctttctgcccttttcatcccatgccccctcacactccttccctcctgcatccctaccctgacatgaagcctttgacctcaccatgtcctgttgctgggctttgcaggggcatcatttgactcctaggggttttttgttttgttttgttttaaatgagacagagttttgctcttgtcacccaggctggagtgcaatggtgtgatctcgactcaccgtaacctccgcctcccaggttcaagcaattctcaggcctcagcctcctgaatagctaggattacaagcatgtgctaccacacccgactcattttttgtatatttaatagagacagggtttcaccatgttggccaggctgatcttgaactcgcgacctcaggtgatgcctctgcctcggcctccctaaagtgttgggattacaggcgtgagccaccgcgcctggtgacccctaggttttatttatttatttattgagacggagtctcgctctgtcacccagggtggagtgcagtggcgcgatctcagctcactgcaacctctgcctcccgggttcaagtgattcttctgcctcagcctcctgagtagctgagacaacaggcatgtgccaccacacccggctaattttttgtatttttagtaaagatggggtttcacagtgttagccaggatggtctcgatttcttgacctcgtgatctgcctgccttggcctcccaaagtgctgggattacaggcatgagccaccgcacctggccggttttatttatttattcatttattttttttgaggtggagactctatttgccacgcaggagtgcagtggcgcaatctcagctcactgcaacctctgcctcccggtttcacgctgttctgcctcagcctccctagtagctgggatgacag

SEQ ID NO: 22259 - DNA, 1050 bp, Homo sapiens
ccggctaatttttgtatttttagtagagatggggttttacagcgttggccaggctggtcttgaactcctgacctcaagtgatccacccatctcagcctcccgaagtggcaggattacaggcgtgagccactgtgcctagcatgatgtgaacatttctacctgtagtgttttttggagagctgttaatattttcatacttgtaaaaatgggcatatttatgtaaaggaagataaaagaagtaaaataccatctgagtggcttgtgggcctgaagtcagttctggcttctagaaaccatctgttttcatttttagggtgttacgtagttaatgccttggcttagcagtggttacttggaaataaagatgtgtcctgctgtgttgacaggcccttcatgaggcagcacacatgtcattcttgctactgtgtacctagctgctgaaatgaatcctataaattatatgaaactaaaaagattttctgatcttatagagttgaagtattgataacaccaaggaactctatcacaatttgaaaagataagcaaaagtttgatttccagacactacagaagaagtaaaaatggtaagtttgtttttgatcacagatactgtttcttcactcatgtacagagatgtttgtagccttttccaaagcatttgcttccattaccatttttattagcccttttggattataaagcaatattatctattctgtattccattctgatagtgtaggaacgaagtcagtgccccattactcccactgcccagagacaacagcttttcagtttgcttgtccctccttggttcttcagttgtgctcctgcaggctttgcttttacacacgagcgatatagcatcattctgaattgtgcagcttaaaagatgaacgttgggctgcttgctctctttacatcatttttaacttaattctcacatccctagcgtccaatgcgaatttttgtgaatgatgaccgccatgtgatggcaaagcattcttccgtttatccaacacaagaggagctggaggcagtccagaacatggt

SEQ ID NO: 22260 - DNA, 1031 bp, Homo sapiens
aagtcaggccctcagccagatgtgctcttcatgtgtgttatttcatcctcctctaagtgggacagatgatgtgacagagctgcagggcagctgaggagtggatcccaagacccacggctgggctgtttggaggcatcagaacctctgccagctgttgcctcctcaggacacagtccccctgaatttatttataggataagcaaaaaagaagtgtacaatcatctataaatctttgacagagtcttgctctgtcatccaggctggagtgcagtggcctgatctggggtcactgcaacctctgcctccctggctcaagtgtttctcccacctcagcttcccaagtagctgggactacaggtgtgtgctaccacacccagctattttttgtattgtctgtgtgtatgtgtgtgtgtagatacgaggttttcccatgttgcctaggcagttcttgaactcttgatgacaggcctgagccaccacagcctttgaatctttgaatcttattccttggaaagaaaaacctgatttactttcacaatgcagatttgtgttctttcacatgggactgacgattttgggttcaggacaaagatcaggattaaaatacggagctaatgtaaatgcattagatacttctgcggagctattgtagatgaagctgtgaaatttttctagtgacaattttctttttttttctcctgaaggtacatcagcatagaggtaattccttttcttttttgaaacagtcttgctctgtcacccaggctggagtgctgtggtgcgatgttggcttactgcagcctccgcctcctgggttcaagtgaatctcctgcttcagcctcctgagtagctgggattatgggtgcccgctgccatgtccagctaatttttgcatttttagtagagaccatgttggccaggctggtctcgaactcctgacctcaggtattatgcccgtctctgcctcccaatagttctgggattacaggcgtgagccactgtgtccggcccatagtggtaattttttggca

SEQ ID NO: 22261 - DNA, 1051 bp, Homo sapiens
gccaccacgcccagctaattttttgtatttttcgtagcatctctggtctttaccaggtgaagtttcatctgtgttagccaagatggtctcgatctcctgacctttttttttttttttttttttttttttaagggaggcaaggtctcttgctctgttgcccaggcttgggtacagtggtgcaatcacagctcactgcagcctcaagcaatcctcccacctcagcctcctgagtatctgggaccgcaagcatgtgccaccatgtctggctaatttttaaaattttttgtacatacgaggtttcattatgttgtcctggctggttttgagctcctggccttaagctatttgcttgcctcagcctcccaaagtgctgggattacaggcatgtgccattgagcctggccaataattattccttaaagatgaaaataataggtatttttaaaatcattttcagtggttccttaagaggggtgaatcactctcctcccctgataacatttggtagtgtctgttgacaatgcggtgttggggtgctgtggtgctgtcagcacctgataggtgaagaccagagatgaacaccctatcatgtgcagagtagtccccccaaccaagaattatccagcccagaaggtcagttgtactgaggttgagaaatcctgtttcagatttttcaatgtatttattctcctcccaacatatttacttaacttccttcagcttgaattttcttctttctttgttttgttttttttttttttttttttttgagactgtgtcttgctctgtcccccaggctggagtgcagtggcacagtctcagctcactgtagcctccgcctccccgcctcagcctcccaagtagctgggattacagggcctgccaccgtgccgggctattttttatatttttagtaaagacaggatttcacaatattggtcaggctggtctcgaactcctgacctcaagtgacccacccacctcggcctctcaaagtgctgggattacaggtgcgagccactaccctcagccaaaagcttgaattttcttt

SEQ ID NO: 22262 - DNA, 1025 bp, Homo sapiens
ttgctgcagatgccttgggatggctgttgtgtgatgcagagagggagttcatttcctctccctcggcctttttaaattttttcctattgaacattttagcatagctaatttattgggagaacatggggaggaggcaagggaagaggattagaagataggctccacctatctctcccctccctcatgagattattccttttagaataactccccacttttgtttttatgtttgttttattttttctttttctttcttttttctttttctttttatttttggagggggcctccaatttttacaatttcctcacagggcagagttgaatgtgctctagtttctccttccctggtccagggtggagatgaattcagcttctgggaaactcagctgccctttagaaagctgccacatcccctttccacctgacagaaaccccttggtcaaactgtgccttgtcttcttattccatccatgaatagaaacgctatcagtcaacgaccccccggacgttctggacaggcagaaatgccttgctgccttggcgtccctccgacacgccaagtggttccaggtttgcattttgttcttctatttgtcttttggtagagaattcctaagttttaacttggctaactgtcaccataaagattccttaacattgacgatagccgtgccgagcttagcacctgcagctgcgcaggtcctaaaggagtgcacctcaacaaattcgaccccaaaagaggctgagactgagttggtgggctgctgctgctgctgctgctttgtgttaagagtaacactctcttgtacacgtagtgacattgcggctggccacagccttggtggtcgccagtgttgactgtttacccttggcaaagcagcaacctgacacttgtgtcgttcatgttgacttgtgccctgggcggtgcctcagactgaagagcctgtgttttgttcccctaggccagagccaacgggctgaagtcttgtgtcattgtgatccgggtcttgagggacctgtgca

SEQ ID NO: 22263 - DNA, 1050 bp, Homo sapiens
tgtctccacccctagtgcggcctttccctcagatgccactgccgaggtgagcacatggtgggcgctgggagtgactgcctggacagagcaggcagccatgtgtcctgtcagtgaggtggttactggtccttgttaatttgccccaaaaagtggacctttcaggccagaagtccgcacaggaagctgggtgctgccctccgagccgtgtcggggagggccttgtggatgttgtcccagcatcctataggctacactggggtggccttgggttgataacgtgctgttcagaggggaggcacaggaagggggcacattgctggaaggccctcactagagtcagtggagactctggcaagggctggcagtgtatgaagagcagaggccctgcctcagtcctgccactcctcccatgtgactggaatgcccatagctgagtttgtcggtcttcttttctgttttccctgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtgcgcagcctgaagctgcctgctggggcagtcccatggggaggcctggggtccccctgcccctggagggaggcactgagtcatctccatctgcactttccaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaaggtgagcagtggcccttgaacctccttgcccaggcatgggttcttctgcaatgtgagcacgaagggaatgtcacttccctgtgttctcttctagccacataaccctggcttcggcatgggaggccccatgcacaacgaagtgcccccaccccccaaccttcgagggc

SEQ ID NO: 22264 - DNA, 1026 bp, Homo sapiens
tttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagccctcggcccttgcgtcttcattcattcccggcttcaggcggggcgaggtggtgtgctcagtgcaggacactggggaagctggggctgtggggctgtggggtgtgggtcct

SEQ ID NO: 22265 - DNA, 1051 bp, Homo sapiens
gagccacttggaaatgacatcttctgtttccagtgactttccttttgggcaaagacaaattgcatcttgaaaaggccatacatggccgggcatggtgactcacacctgtaatcccagcattttgggaggccgaggcaggcagatcacaaggttgggagtttgagaccagcctggccaacatagtgaatcccgatctctactaaaaatacaaaaattagccaggtgtggtggcgcatgcctttagtcccagctatttgggaggctgaggcaggagaatcacttgaacccaggaggaggaacttgcagtaagcggagatcacgccattgcactccagcctgggggacagagtgagactccatctcaaaaaaaaaaaaaaaaggaaaaaaggaaaggccatgcaaggctcggttagggtggtctgcagtgctgggcctgctggaattggtacagtccagagggatctgtgggaatatggaaggcttggttctgccacacaccaaaaaagtgacctcacttctctgggcctcagtttcctcatctggaaaatgggaacatggtggtctctgcctactgggagtggactgagaatcacgtagcaaattgttgtgaaacaggcagcatttgtgatctcgttggttggcttttgtctccttttatctgggatcaggactctgatgacaggtgtacgtttcttttctcttgctctgtcccccagactggagtacagtggcgtaatcatggctcactgcagcctccaactcctgggttcaggtggtcctctcacctgagtctcctgagtagctgggactataggcatgagccaccacacctggctaattacaaaaaaatttttttggcagggagcgatggctcacacttgtattcccagcacttggggaggccgaggcgggcggatcacggggtcaagagattgagaccatcctggccaacatggtgaaaccctgtctctactaaaaatccaaaaattaggtgggtgtggtggctctcacctgtagtcccagctgctcgggaggctgaggcaggagaatc

SEQ ID NO: 22266 - DNA, 1051 bp, Homo sapiens
aggtgcagaggcctcgcacacacccggcccgctgagtgccccctgcggaccggaaaggaccagtaggcacgtgagagttaggacgctgcccgtggaatgccgacttttctaaatttgaattacgcaagtagagcgtggagacagtgttcttggaaaaagggaaaccattacagatgaggaagagcacactgcccagcccgtcccttcctccagctctacctgggagcaccactgtcacttcagggtatgtctagccagacccctctggtgtttctgtacttaggtacatgctggtacctatagagaatacgtggcaccattatgggtggttattttttttttttttggaacaggtctcactctgtcacccaggctggagtgcagtggcacagtcatggctcgctgcagccttgacatcctgtgctcaagccatcctcctacctcagcctcctgagtacctgggacaacaaccacatgccaccacgcccaactaatgtttataatcttttgtacagatggggtttctctatgttgccaaggctggtctcaaactcctgggctcatgcgatcctttcacgttggccccccaaagtactgggattgtagacatgagccacctctcccagccacgtgcatatatttgttgaatgaaagtagctaaaggctggaagtggtgactcacgcctgtaatcccagcactatgggaggccgaggcaacatggcttgagctcaggagtttgagaccagcctgggcaacatggtgagacctcgtctctaccaaaaatacaaaaattagcaggcgtggtggtgcatgcctgtactcttagctacttggaatcccgaggtgcgaggatcccttgagctagggtagcggtggaacttgcagtgagcccacactgtgccattgcactgcagcgtgggtgacagagcgagaccctgtctcaaaaaaaaaaaagtagctaaaaaccagaatggagtgaatttcactgcacagtcatggaggggaccaggcagaggacagccctgggtcttggttttggagactcacagc

SEQ ID NO: 22267 - DNA, 1084 bp, Homo sapiens
ttgtatttttttttagacggggtttcaccgtgttagccaggatggtctcgatctcctgacctcatgatctgcccgcctctgcctcccagagtgctgggattacaggcgtaagccacctcgtccagccatcttctgtgaatcttatcaggagtataggataccaacaagactgataaattattgacagtgataactgatgatgctgaccttgatctcttggctgaggtaggcttgctaggtttccccactggaaagttactagttttcttcttttcatactctatcctttgggatcatggaaaattttatttttattttatttttggagagtctcgctctgtcatctaggctggagtgcaatggtgtgatattggctcactgcgacctccgcctcccggattcaagcgattctcctgcctcagccgcttgagcagctgagactacaggcgcccaccaccacgcccggctaatttttttttttcaagagatggggtctcgctgtgttgctcaggctagtctcaaactcctagactcatgtaataatcctcttgcctctggctcccaaagtgctgggattacaggcattaaccactgtgcccggccttttctggcactattgaaaagaccatcctttctccctaaagttgcttttgtctggaattagttggccatatttgtgtgggtccaacctgaactgtctgttctgtgacgttgatgtatggctctgtcctttctccaaaaccacatatctttcttctctttttagatagagatgggggctgggcacagtggctgacgcctgtaatcctaacactttggaggcaggtggatcacttgaggtcaggagtttgaaactggcctggccaacatggtgaaactccgtctctactaaaaatacaaaaaaattagctgggcgtggtggtgggtgcctgtaatcccagctaattgggagactgaggcaggagaatcacttgaacacgggaggtggaggttgcagtgagccaagatcgcgctattgcactccagcctgggcaacagagtgagactctgtctcaaaaaaaaaaaaaaagaaaaaaagaaaaaa

SEQ ID NO: 22268 - DNA, 1034 bp, Homo sapiens
tatgtgtggattttttcctgttctttccttccctgatctcagtgtatttctattcttcccacccgaggctgacatgaggtgggcgtatatcccagctggaaaccccctcgggcctccttgggaaggatcttgggtcagaagctagacccgggagaggtaagggtctccgtgccccttccctgctaatctgcaacatcagctctgggcgttcaacactcagtttgtgttaatgtcttcttgcggcccttttaaatactctcacactgggaaggcagctgacacacacacccccattctacagatggggaaactgaggcttagccatgctgcctgcctttccaatgggccccagatctgggacctgcatccaggcagatctgacctcaacgccagctctcagcttggcctcccaagactcctcactttcgtcctctggccccgcccaacctggcaagaaggcgtgtctccagtgagagacagcagccgatgggcccaccacctcttctttatgagctctgctatttcgtacgccaccgatgggccaatgggctgccacctctgggttcaggcgtccaatcagctgtgccaggaatgggcagccccaaagtcctgagagtcactatagaaatcagtgttggtagttttctgtttctcattgagcaggatggggacagatgtgcaaactgcatttttattttattttattttgagacggagtctcactctgccacccaagctggagtacagtggcgggtgatcttggctcactgccacctccgccttccaagttcaagcaattctcatgcctcagcctcctgagcatctacaggcatgagctaccacgcccggctaattttttgtgtttttagtagagacagagcttcaccatgttggccaggctggtctggaactcctgagctcaaatgatctgcccgcctctgcctcccaaagtgctgggattacaggcgtgagccactgggcccggccacaaactgcatttttaatgagtccctggtgatgctgccagtctctgg

SEQ ID NO: 22269 - DNA, 1065 bp, Homo sapiens
gcccaggctggagtgcagtggcgccatctcagctcactgcaagctccgcctcccgggttcacaccatgctcctgtctcagcctccggcgtagctgggactacaggcgcccgccacctcgcccggctaatttttttgtatgcttagtagagacggggtttcaccgtgttagccaggatggtctcgatctcctgacctcgtgatccgcccacctcggcctcccaaagtgctgggattacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggggttactttaccaagcatcttcccctggtgagcctggtccatcactctgccattccatctgcagccttgtatctagagagcagaccaagctggcgtgcgtcaggctgtgggctggctgggatgcctgcccaggctgacaccttcccagtggcaatttgtcctggactgggagatatttgcgtattgcctcggattagagagaactcaagggctaaatgggcatgggaagtgttgtgtgctgtgcccacttcttggtctgctgaaggctctcaaaagtcctgcatgagtggatcctgcctgctggcgtggtagctagggtctcctgatggtggcagatccccaagttgttccccctggtcctgcctgccaacagcaggtttgggaaaggcagatctcctctccttgccttcagggccagcctcgtcattgtgttctttgctgggggaacggtgagaagatccagggcagagccccagtgtgcaaagcactgggaccctagcccagcccctgagggttccctgagactaacagctgagccgtgtttgtgctcctgatgggatttgatcgcagtcatatgggagccccggcactgggttctgtgtcattgcattttggggaaactgaggtgctg

SEQ ID NO: 22270 - DNA, 2008 bp, Homo sapiens
gctccttgaagctccctggctgtcaccccttcttgaccaatgcccggcattctcagacttccctggagccaccgacttctctgtccctcagctccgggaatggcctgaatgccagcgacatcatgagagccagctggggtcctaagtgcccctgcccaccccctgcaccccacgctgtcccccaggggcagcccatttttggatccacttagtcacagtgcctctatgcgctctcgacgagccactgcctccactcagcaggacgcgccgggctcccccaacccgcgccaacgccgcgggcctggttcccagggcagcacgctttggccaagcagctgaaatgcctcccagtgggcagtctgtgcttgcgcgaccacagtgtccccagcgctccgggttgccagggaatttctgcttgagcccctctgttcttagtctggaaaagcccacatttgctgcttaagcttcttcgattagaaaagggagggggaaaacagtccaaacaggttggaaaacgctcgtcctagagccaggtgtcatggacatgaatgttagaggactccgcacaccttggctgtctgtctgtgcaatgacaaccccccgtggcccttctgtaactacaccccagaccgagcccacacccccaaaccccagacctctttgatccgaagcagcttccggggcaaatgcgggcgcaggctcccccatgcatggactaatcagatgactctcgtttcttctcttctctctgtctcctgtcctgcgtgtgtggcctgcactgtccctgggtgtctttctgcctcatcctgccctccgcatgacccaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaaggtaacaggttttgttctcatctccgcatttgtccccgtcctccccctccatgtgttagtctcaacccgagcatctggaaaattcagcctcggcaggaacccccttccgcctaccagttgtcacttagagatgtcgccaccttgcattggcagatggaatggggggagtggcatcacacgtgggttgtggctgcccgtgggggcggtcagcctttgttgttgccaaacgcattgcatttactaagcagtgccctttcctggaacccctagagaaaggggtttcccagccagcaccaaaacagcaaaacacaggaaacacatcatctgtatagccctgcatgttctcacagtctaggccacctgagagtaaccattccattttccccgactcgtggacttgacccacactgcagaagatgggactcccctgtgcatgaggtctggttaagttggtgctgcagatgaagcctggggaggtgggggcatttggcgagtgtgtgccacagatacagtgatcaggagtggttctctgcaaggagttcctatcgaggctgatggcccagatacccgccttaccattctagaacagacgctactcactcacgctggcgaggcccttcagggttcctgctctcacccagtgctgggcaagaggggggtgccctgaagccctgcatggcaaacatgcccctgcttttctgctttcatgttgcctcctgcctcctgccccccggtcactggctggaaaagcagctctgctctcctgctgtctccggtccacggtgcccccactcttctgctcttagctcccagctggactcactgggggccaggagcaaggtgtgggctcggtgggccccctcatatctcattccccacccccctccgcattttctacctgtgtggttcatgttgcttcccgtgccacgaggaccccgccaatgcgaccactctgcttgttcccccagctcagttcctacccccggttgcgagaggagacagagcgaatcgtcaccacttacatccgggaacgggaggggagaa

SEQ ID NO: 22271 - DNA, 2028 bp, Homo sapiens
cccagctatttgggaggctgaggcaggagaatcgcttgaacccaggaggcagaggttgcagtgagccaagattgtcccactgcactccagcctgggcgacagagcaagactccgtctcgaagaaaaaaaaaaaaaaaacaaaaaaaacaactgcacattattaaacccttggcagttgggcctcctgtcaccccattccacagctcagtaacgtgaggcccagggtcacacggccaattagtggctcaatcaagactccagaccttggggacagcggccctgcctgtgactggcacattgggctgcgtggctgtgctctgttgtcccaggctctgttgcctatgagggtgtggggagtgcgacgccagcccctgttctcctgtctgggaagcctcctggttcccacgccttccctgctggcaaggccaggaaatgctcttgccgctgcccccccttgccaggcttggccttgtactcacagtgacccccgctctcccccagattcttctgctgatcgacattgagcagtcctacatcaacacgaaccatgaggacttcatcgggtttgccaagtaggtacttttagagactggctggtcgggcggcaccaatcctcactctcagatccaaggaggtgactgagttgggattctctgagagggcaggtgtcagacagtctctgtcgggggtcctggggtgaaggcagagccaactgagaatatctggaagctctcctgggctgatagtggtccactgtccccaaccaacacgccttctgtgaggcatccccatggttagtttagggagagggcagtgctatgttcagatctgcagggagagggggaagccagccagctgctgcaccccctctccttcaggacttctcagagcctttagcgaccagtgtgcagcttttcccagactctgccacttcatggacagcatctcatgggctcagggctccggaagctgctctttgggaaatgctgcctggggtctccctagcttcaaggcatacactgtagatttaaaccagaaccttccgtggcacccagatgagggcccacatcggggagccctgatttcagcaggatgtcgattcagtgtgcgtggtctcaggcatcacccgctgattccttcagccccttggcatgcttaggcctcactcagattgttggagaggctcacgcaggccttcctgcctgaggcaggccgggtggtgccgctggtatgccctctcgctgggccctgtgatagagcagtgggcaaacccacacccagctccccaccctcagaggaagaccacatgcagggaaccgatggggacccagggcgttaaggtgtagtgtgcttagtgctgggcggggccgtgcagggcttgtgggtgtccagagggcggccactgggccttgccttgaggggtcaggcaggcttcctaggggagggcctctagagccaaatctcaggctatggagtcaccagatacaacatttatcggtgcacctgacaaagctgattgaggatctgttccgtgctgggcaccaggtaggtgaggagaagggaggaaggaaaacgaaggaatgagggcctcatcagaacccctcctagagatgagccgaagtccctgactgggcctcccctgcctgtgggtggcagcccccggccctgtgctcccggccgccgggtgtgtgtgggctcacagcgctggtccccatctttggtttgctgctgttttcctcaccttgatgtctctgcttctcacacttcatccacagttccttctcacaatctctcctgtttttcctttgaccactctttcctctggattcctgggccttcccacttaccccagctgttactatactgagcagctggtgacctggtgggtattgcctgctgtgtgcctttgccctggtgtgtgaacggggtacgccctggctgggtggccccagccctgggtgggacatccctggggcccgctgaagagctacggggtgctctctcagagccagggccagtgctgggcct

SEQ ID NO: 22272 - DNA, 1059 bp, Homo sapiens
tggttcccatctctacccgggagactcaggccaggaccctcacccaggaaagagactggagcagcctgccagaggatccctgctttgccgccccctgcctgccctgccacccataccgccccatgtgcctgcctgcctgtcactgtgcaccctagcccgcaacggcctgccgcctcttctgtctctcccacccctacttccttctaagcccagtcccattgggatgtgtcccttggatgcaaacctgactttctgctgaggcctggctgctccctttctctggctcacaagtggtggatggctaacgggcctttgtttgccacccacagcttgcagctccctagggtgggattttgtctctgaacccgtgtggagaagggcacctcagggcttctgccagacgtcctgccccaaggcttggtgtgccatccccagcatggccccgatcagtgccctggccctgtggccatgcaccccaaagtgtagcgtgggccctgtgctccagctctgaccaacactaaccccggctggaggcaggagagccaggccaccgaggggtgtgcgggcacatccctctccttagaaaccgggccaggcctaggagtatggaggcctcacatttctctgggggagcaccgacagcctgtctccctgttttccctcacctggttgtcattcagtcatggaaccagggtctactaagcactcgttctgtgcccagctctgggctgagacaaggcagtgcccccaccccgctccccccgggtgaatggaggcattcccagactgccagacctttggtgctaacaccaggacgtcctggacagaccaggaagagctcgtcactgcgttcccagaggggatgctgtgacctcacaggggctgctggcctcagccccctcacccaccaccaggcagcccgtgaatggccagatgccaggggtcactgcctgctccaaacaactgtgagagtcctgtctgctcatcccagggagggataagtctgtacccttggccttaacaaggggcgcccggtggcatctcatgctgtccccagcc

SEQ ID NO: 22273 - DNA, 1223 bp, Homo sapiens
ggcagagttgggatgtgaacccaggtttggccctgatccgttcacttggccatcagccctgcagcccctcctgccacttttcccactctctgactcctccacagggcagtgcaaggccatggaggaagtgcctgcccaaggcttacccctgctgctcctggtccttgtcctgtgtcaccgtgttggccatagcgacctcttccagagctcgccaaagccagggtcccgtctcccctggttcctgccgtgtgcctgatttctttgtggcatcagtagtgtctgcccccttcgcctgtgccacatctggaatcacatctggcgaagcagcctgcaggtcctggggcggaaggcggccttcctaacccaaacatactgttctctgagccttggtggggccagaagggctcctggagcgccctgggacctggcagagggccttcctgcagctttgtggcccaggacatcctgtgtctctggctgatggtcaaaacctttccttattctttatttttttttaaatgttttactttttgtagaagcagggtcttgctttgtcacccaggctggtctcaaactcgtggtcccaagccatctctctgccttggcctcccaaagcactgggattacaggcatgtgccagcatgctctgactcagactctttcaagaggtgcactaggcagggacttcaagtgggcctcagccccagggcagcttctccctgacccaacttcgatttcctccattggaggctgcctccgctccagcctctctggagcgcccccctgtactcccctcctctgggtgaggcccttttgccagcctgaaggcaggccccagcccagcttgctgcactgagctctctgtccttggcaatgagagccagggtgtggagggtcccagtcgctctgggagatgatccccctcagcagcctggggtcttcttgccgctccatgacacgcctcattcagcccgaccttccaggccactgtgggtgtctcctctgcaaagggcctcctgctggcctagtccccatagagagctgcagcccagctcctgccatgtgtcacaatgtgacagaccctctttagcaccaggaagcaggcttgattgcctccttgtagtggtgaggctcaggggtcaactagcctggcctggcattgcccaggcccagagcacaggtagaacctggggtcccctgagcgtggcccccagtacctccca

SEQ ID NO: 22274 - DNA, 1054 bp, Homo sapiens
ggttttttttgctttgttttgtttttatttttatttttttgagatgagtctggctctgtcgcccaggctggggtgcagtggcgtgatctcggctcaccgcaagctccgcctcccaggttcctgccattctcctgcctcagcctcccgagtagctgggactacaggcacccgtcaccacacccggctaattttttgtatttttagtagagacggggtttcaccgtgttagccaggatggtctcgatctcctgaccttgtgatccacccgcctcggccccccaaagtgctgggattacaggtgtgagccactgcacccggactttttttttttttttctgaagcggagtctcactctgttgcccaagctaaagtgcagtggcgctatctcagctcactgcaacctccacctccctgattcaagcaattctccctgtctcagcttcctgagtagctgggactacaggcacccaccatcatgtctggctaatttttgtgtttttagtagagacggcattttgccatgttgaccaggctggtcttgaactcctgacctcaggtgatctgcctgcctcggcctcccaaagtgctgggattacaggcatgagccactgcacttggccagctttttgtttgtttgtttgtttttgtttttgtttttttaaagaggtggagtcttgctatgttgcccaggctggagtgcagtggctgttcacaggcagtcatagctaactgcaaccttgagctcccgggctcaagcaatccttccacctcagcctcccgagtagctgggatctcaggcatgcaccaccatgcccggctaattttgtttatttttttgtagcgatagagatggggtcttactatgttgcccaggctgaccttgaactcctggcctcaagttatcctcccatcttggcctcccaaagtgctgggattacaggcatgagcctgtgcctggccctggctatctctttgttgttgagttaaaaaagttcttggcccagcccagtggctcatgcctgtaatcccagcactttgagatgccgaggcggac

SEQ ID NO: 22275 - DNA, 1079 bp, Homo sapiens
aatcaccagccctgtatgttcaagggagaaacgtcaggacatacggccatccagaaccttccctcccagatggccacatgctgggttgctgaccgccccccggtgacttggcttccctgttccagatttctgttccttctacaacatcctgaaaacctgccggggccacaccctggagcggtctgtgttcagcgagcggacggaggagtcttctgccgtgcagtacttccaggtgggttgtactccccctcagccaggccgcctccccccggcagcccccctgccactcacccgcaggaggccacacagcacagggaaggcccacccaagttcccgtcctggctctgtcccttactggccatgtagccttgggcaggtttcctctgctggctgggcctcagtttcctcatctgtgaagcggagatgcaggtgcctgcctgagagggttgctggaaggatctgagcacaggtggagctcagggccacaggcgttgtgaataacggtagagcagttacaatgccctgagcgctccctgcatgccaggccctggtctaagcgctgtcacatgcacagaagcacttggaccctcccaacaacgctaggaggtaagtgctattattgtccccattttacagatgagaaaactgaggctcagagaggttaagtgacttgctccaagtcacacagctatatgcaacagagccaagatgggaagccaggtctgcctgatgccaaagtctgtgcccctgcccaggtgccacgctgcctcccgatcgcccgttgtcttacagagagacaccacacctcacctgcctggcgctctgagttctagggctctgttcgatctgcttctcttcttctttggggccctcaagatgaggcaggtggcccccgatgccagaaccctgcctgtggcaaatcttgagttctcctgggcggcttccaggtccaggcggcatcagctgttgccatcggctgcagtgatagtggcggtgtcctcctgggggctgccctccggcttcctgctccctctcctggagctgctagtggggcccaggcagagggtgcacgacctccc

SEQ ID NO: 22276 - DNA, 1031 bp, Homo sapiens
tgccaggtctagtaataggacataaagatgagccaccagcctcccagtctcaggtggaattcgtgagctggtgcaggtcaggtacccgtggtggtgatgaaacactgatcagaataggcgctcggtgccactgtcacaggagtgcaggaacgaatggatgacaggctgggagcacccagggttgggggtcttggggtcctttggaagctctgccaggcagtgtgggatgtgtcacctgacgccagcacccctccctgccccactcccaggaaacatgtttcctaccattggtgacgtccaccttgcacccttcacggatgaacagctctacatggagcagttcaccaaggccaacttctggtgagtgtgccctgggtgtcccgcctgggccccacagcctgccttctcagggacagccccagctccccagagagcctgcactcctctttttctgaaagacttgggctagatgagggctgactgggagagaaggcagggctaccccacctgcctcttctgcagccctgaccttgctgtgggggtggggcctgtccacaggtaccagccatctttccatggagtggacctgtcggccctccgaggtgccgcggtggatgagtatttccggcagcctgtggtggtgagtagggcctccagggtactgctgcagtgatcacttgccattgctgtgcagctgtgcagccctcaggaagctacagcccctctctgagccctctcctctgccctgcacagcgctctcacagagatttgggccaaaagtgtcaatgcatgtagacacttagcacacagcacacatgcaatacatgtggaacattattaggtgaggctaaggcagagggggcatttaggctcaggagttcaagatcagcctgggcaacacagagacgccatcgctatttttaaaattaaaataaataaataataaaaataaaaaagaaccattactagatgaatttatccttggtgagctgatgtgatttattgattgattttacttgagatttttgata

SEQ ID NO: 22277 - DNA, 1048 bp, Homo sapiens
gtcttgaactcctgacctcaggtgatccgtccgcctcggcctcccaaagtgctgggattataggcataagccactgcacctggcgttgagcctcttattagcggctttctgcttggtgtcttagcctctgatgccctgcctcgctcaaagctcaggagttggccaatttcacaagcgcactgagtgtgcaccgcccaccttgccctcctgcacttatttccctttgctttgacatcacagccccttgaatccgagctgccttggtaaccctgagctcccattttgctttccccacccaaggaagctgctgaaaggtcgaggtggccgttttctgccctccccatggggaaaaggtagaggccagaaagggctccctccagaaagggcatttccctcctttccaggagcttgatccccaaaatcctggccgctctggttggtcaccagtgcttccaacaactggtttattcttttctttggattttattcggtttacatagttcatggcaggtgtgttagtcggatataaacattgctgggagtggacagcagcactagtgttgttgttgtttttaagagacagggtctccctgtgtttcccaggcttgattcacactctcgggcttaagcgatcctcctgcctcagcctcctgagtagctggagttacaggcatacaattccacacccagctagcacctagttctttaacttgcttttttggttaacttgcttaatgatttagcttggagatctttcctcatctgttcataaagagcctcttcattctttctcacgtccgcatggtctttgatgggagagccatcactggtttaattagatggtttccagtgtgtcgctaccacggacaatctaattatacatgtaagtttgttgatgtgttcatgtatctggaggttaaactcctgtagtgccaaatcttttatgtggataaacacttgtcatttggagagctgtcacctgattgccctcggtggcgttgtgccggtcccctcctcacggcgtgtctgggaagagcaagctcgtttt

SEQ ID NO: 22278 - DNA, 1043 bp, Homo sapiens
agacggagtctcgctctgtcacccaggcttgagtgcagtggcacagtctcagctcactgcaacctccgcctcctgggttcaagcgattctcctgtcccagcccccacaccgagtagctgggattacgggcgcctgccaccatgccggctaatttttgtatttttagtagagatgagttttaaccatgttggccaggctggtctcaaactcctgacctcaagttatccactcgtcttggcctcccaaagtgttggaattacaggcatgagccaccaagcctggtcctaatttttttattattagtagagatggggtttcaccatgttggtcaggctggtctcgaacccctgacctcaggtgatccacctgcctcggcctcccaaagtgttgggattacaggcatgagccaccacgtccggccctgaatacttttttttttttttaatataacacttccactttctatgtgacattgtgtcatgtttggctatttctgtcactctgctgtccactcctccaggtaggaattgtgttgttctctgccagatgcctggtgtttggaaccagcttggtgcattcagcgctgttcgtatttgggggtagtcatcagtaagtcctctgctgtggcggtggggaaggcctgtcacgagtgacactgggcaggtatggattctgcatctccctgcccactcttggcctttgcatgcctctgttgtggggactcctcttgccgtctccacacagtgtcactcctcacgctcagtgttgcgtatatagctgataacacagcagacccggtggtggcgcaggacatccatccagtgggcctcggccagccgaaaagaaagaataggggccgggcacagtggctcacgcctgtaatcccagcactttgggaggccaaagtggacggatcatcggctcaggagtttgagactagcctggccaacatagtgaaaccccatctctacaaaaaatacgaaaattagctgggcatggcggtgtgcgcctgtagttccagctacttgggaggccggggcagg

SEQ ID NO: 22279 - DNA, 1087 bp, Homo sapiens
atgcaggtggatcaggagttcaagaccagcctggccaacatggcgaaaccccgtctctactaaaaatacaaaaaatatatatatatatatattttagccaggtatagtggtgcgtgcctgtaatcccagctactcgggaagctgaggcacgataatcgcttgaacctaggaggcggaggttgcagtgagccgagatcacgccactgcactccagcttgggtgatggagcaagactctgtctctaaataaataaataaatagatagatagatatctcaatagccagtaagcatacagaaaggtgctccgtgccattagttgtgagggacatgcaaatgaagaccataagaagatgcgattggacattggcaacattgttaaaagttgtaaggactgacagcagcaagtgttggggttgatgaagagcacctggaatgctgtccctgtgtgggaggtgggaccgtgtgtgtagatgatacaactattttggaaaactagcaaagctaagtttatgcctccctttataaccaccagtttcattcttggacacccaagaagaaccaatgcatgtgttcaccaaatgactctcatagcagcttgatttgtgctggccagaacctggtagagtacaatgtctatgaaaatgagaatgctcacataaaaagaacggatgactctcccagacatggtgaccctgtgtgattgtcttttttttttttttttgagacagggtctttctctgttgcccacgatcatggctcactgcagccttgacctcctgggctcaaacagttctccctactcagcctcctgagtataagctaatttaaaaaaaaaaacttgtagagacagggtcttgctatgttgcctaggctggtcttgaattcctggactcaagcgatccttctgccttggcctcccaaagtgctgggattataggtatgacccactgcccccaacattatattatttatatgttacatatattatatgttataagtatatattgtatattatataatatatgtattatagacgtgacccaccacacccgtcattttattggaagttcaataacaggtgaaagg

SEQ ID NO: 22280 - DNA, 1841 bp, Homo sapiens
cccgagtagctgggactacaggcggcccctcaccacgcccggctgattttttgaattttttttgttagtagagatggggttttaccatggtctcgatctcctgacctcatgatccgcccgcctcagcctcccaaagtgctgggattacaggcatgagccactgtgcccagccctaatttttttatttttatttttagtagagacggggtttcaccgtgttagccaggatgatctcgatctcctgacctcgtgatctgccctcctctgcctcccaaagcgctgggattacaggccaatattctaggttttaaacaagccttgcggggagatgtgtccaccatgctgctgaagggtcagccttctcttttgtgctttcctgcaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggtatggtcctgccttcttgacgtgcgctcttctacatgtgtagctggtactgcgggctccaggggtcactccccagggttacgccaaggcatttcacagctcggagttagaggtgggacagagggaaaagagcaggcgcgggcttgggagtcagtcctgggctcggatatttgctgatctctctgatcatcagaatgactgtgtgacctcaggccacttagccggctcctctgccttctctggaaaatggaggtggtgcccccttccctcgttctgtgagagccaggtggtgtgatccagacccccgacccctagcataaacatctctgaccatttatttgtgactgagtcgctggttgggcagatattggcagcgtgttctgggccaggtgctgctctgtgtacggggacatggcccctgcctttgtgggggctcctggttgtgcttgaggggcagatacgcgaatgaagcaaacagagtagtggatggtgaccgctacagtgaggagggggaagtggagtggaaggggagggacagggtagtaagtaaaagccttgaaacagaggcccaaagggtggccctgatgcacaaacgcagagacccagggaaggagccccaggcagtgcggacaaaggttgaggtggcaggcagccatgtgccagggcagccggtagccctgggctcccagaacagcgttgtgtggggcaggaggtgaggtcagagcttacaggggcaggtgggaggtgggacctttcagaccattgggaggactctgggttgagttctgatcatgaaggggagcctcacccgggagggttttggctgtggggtgatgtgatctgatgtattcttagaaaggtggggggctgctgtaggaggtggtgggagggatgcaccttggacttggtggagagaaggcttcgggtttggggtgtatttcgtggacagagtgggtaggactggctcatggcctctgtaaatggctgctggcgggactgtctgcctagcgggtgcccttggaacctagcccttggtgggttttgaggaaatgattcctgaatgaggagtcgattgccgtgtgaagggctggtggcacggcacccgcgtgagctacgcgtgccctcagtgcgcttctggattgactggccatgggtgctcacagacatgcacattgtgccaccacattgcagtaacccccatgcttttgtaggctgaagatgaggaggggtaccgcaagctcatcgaccagaagaaggacaagcgcctggcctacctcttgcagca

SEQ ID NO: 22281 - DNA, 1061 bp, Homo sapiens
tggtacatgcccaccattcctggagcacttccttcctcatcagacttttcttctgctttccctgcctgagctctctggagccaactctttctccagggagtcctggttccttttttttttttttttgtctgtcaagacggggtctccctgtgtcacccaggccggagtgtgtggtggtgcgatcatggctccctgtagtctcaacctcctggactgaagcgatcctcccacctcagcctcctgagtacctggggctacaggcgcacgccaccatgcttggttaagtgttctgtatttttttgtagagacagggtttcaccatgttgcccaggctggtctcgaactcctgagctcaagcaatctacctgccttggcctcccaaagtgctaggattacagacatgagccactatgcctggctatatttcgtattattacagaagaatatttacatgccaagatctgactttgggggtgcttcctgctagtgggccatcactgcttctaggccctctgagcagccggatctgggaaatagatgtatgtacacatactcatctgcattgctgtttgtatatattaaaacttgtggctgggcatggtggctcatgcctgtattcccagtactttgggaggccaatatgggaggactacttgagcccaggagttcgagaccagtgtgggcaatatggcaaaaccttgtctttataaaaaattttaaaaattagttgggtgtagtggcatgcacctgtggtcccagctacttgagaggctgaggtgggaggatcacttgagtccaagagtttgaggctatagtgagctgtaatctcaccattgcactccagcctggtcaagacagtgagaccctatctcacacgcaaaaagaatcttgaggttatactgacacctccaattctaatccaacagcacagggttaatttttatcctttccgcctttccataattctaaaatcagcaacctgatttcccttagcaataataggcttacttacctgctccattttagaatacacagaaagtacgttccaaagtgctaatgga

SEQ ID NO: 22282 - DNA, 1050 bp, Homo sapiens
ccggctcttactggtccagttcaagtcacatgtccagcaagcagacagtcaccggcctgggggttagtctggtctgattgggcaaacttcagcatagcatttggtctggccctagagcacagcccctaactccaaccaggcactcattgggaccactacagccacgagtcagcagcggacccccaactcctggcaggctggggagcggcatgcccatgctccaaccccatgggaaaatgcccttctgcctataagacagccaggccccatgggtcacacacccatagggtaggcctgacgtcctgactgttgcagggaggactggaggaaaggtgaggaccccagaaccctcccaggtttactgtggaactgtttctttcttctatctccctgcttcctacgtggcgggtagaacagactgctctgaaggagcagggcgtccttgtgcacagcgctgcaggtagctgcacctcccctcgtggtcagacccagattgctacagcgttcctgctgcacctgcctgagctctgtcccctgtctgtgtctggaggctgttccttccggctctgcccacctcctggctcccctctgcccttcttcccctggaggctgatgggtgcagtggcagtcgccctctgcagttcccgattttccctcctttcacttacagacttctcagatcaccatctctgctggaacgccgctctccagggtgctgttgttttgcagccttggttcttagttgttaattttttgctttaaaaaatttttttaaacttttcattttgaaatgatctcatttatttttatttttttttattttttgaggagtctcgcactgttgaccagcctggagtgcagtggtgccatcttggttcactgcaacctctgcctcctgggttcaagcgattctcctgcctcagcctcccgagtagctgggattagaggcacgcgccaccatgtccggctaacttttttgcatttttagtagagacagggtttctccatgttggctaggctggtcttgaactcctgaccccatgatctgcc

SEQ ID NO: 22283 - DNA, 1050 bp, Homo sapiens
cactgttgctagcctggctctgggcgtgaagcctgtgctctgaagctgcattttcccggcagcaggtccaggcttccccagccctggcagcattgtttctgtcccccatcacatctctgtgtccctacttctcactctaaagggccttgccctcttttcccagtggcctcccttctgtcctctgaggcagagcccttcacgtcctcgccagtctctcttcctccctccctccctcagctgccctaaacacagtttctctgcccactcggagggctgtggccatgttggcctcgcccctgacagccagtggctatgggtttgcacagtgagccattgatgagagaccggcacttgactctcatttccttgttccatcagaacgctgtccaactgggcgtacgagtttgacaagtgggccccctccgtggtgaaggtgtcttacaaggtaggtcacagccactgaggtttcctctcttgctacggaggtgcaggcggtggtgggcaggacgtccacacatacctctggacagtgaacctgagaatgctgggtctccagtcgcatggagtctccaggacagcctggaactccagtcacatggatccgggagtttggactgggcagggacagggcagattagctcactggggaggagacaggagtgagcatggtggccagcactcagaggccagctcaggcgcctgagatggggacccaggaagaggggagcctgtcagccaccaggaatgtgcagatggcggtgcaggctgcgtggttccctcaggccccggccgccgctggcctgcactgcttcctcttccccctgcagcgcgtgttctgcgtggtgaggtctggggacgcgccagcggccctgccagcccctttccccactacccctgtgaggacgagccctcccgccgtgtcactgggcagttgcagggggtgcctgtgcccctcttgccacctggccacccggctccaaaagccgagctgtgcatcctgcttcccttgcagggatccccagcagcaagacgggcctttgtcccccagct

SEQ ID NO: 22284 - DNA, 1214 bp, Homo sapiens
catgcttcaggtgcctcctttgtggctcacccctgctgactccttacaaagccaggccgttggcaggcacaggaaccaggctctgaaaccccgtgctcccctgccagtggctcagttgatgtaatcaccctgcagtgggagtgctctttgagtgcggccactgcgccccctcccgacccgcatggccctgtatgtagtggcgctggcccctaccccatggggcccacattctgaaccacaggctgctcattagaaatgtaccgtcaccaacccagttcccctgagaccctccacaccagcaggacaagtcccccagtcagcaagatgtgtcttctgccagaacgtgctcggcatttttctgtgctgtagattcatatgtgtgattttgcagggaagccagattgcttttttgcaatttgcattgttcacctgccaatagtcatggggtcacgggcctgtctctgcccaaggcttgcaagaggctacgttgtgtggctccaactcggtgagtcagccccggggcaggacgtcaggcctgtgctctccacccagctgcgctcttccacctggagccttcctggctgctgggcgcagagtgggagattctccccatgtgccgggccacctgctgccccctgccctgattgcccactctggggcccgcagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtgggtttgcccagctgtgcccatgctgacggttccaggtgcggctggctttgctggttggaacgtgttgagcaccagctacagctggctgggcctgtgctgggtgcctggtgagagtctgcatctgcatggagcaggggagccctggaacccaaggctggggcagccacaagggccccaggggagcagggcagaggtcatggtggtgaatctcggaatgctcggggcgtctctgaccctatgctccaggtgcagagtggatggtgaggaagatggccctgaggcagctgtgggaccgcaagcgt

SEQ ID NO: 22285 - DNA, 1047 bp, Homo sapiens
cttgtgttgcgagcggcggtgttgccggcattggccgctgtgtcttccgctccccatggaatggcacagggtagagtagaggagagaatccagggctgtggtggtggtggctgtgctgacgctggacgctgtggcctagctgtgggctgggtgctggactctgtgctccaggcccacctcctctagttctcccagcggggcctgttttcatttctgggatgtgtggagagacgttttgtggtgaaacactggaaatccagttattcgccagtggcccacaggcccgtgtggagagtgcggagccagggatctggggatgctggcaggtgctgatcctgctcctgctctcagaagcaggtgttccttggtgtccccactctacccctgaggtcaccccgctgaccctgttctcctctgtgcccgtcaggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggtaaaagcgggccgggccccaggtcgaggagaaggaagggggtgcctgcaaaacctcgaggagacggccctggcttgagggtcctccagcctcctccacattgtcttggaccccaggagccgggaggagctgcacccatatctccataggtcatcagggagaaaagaggcggggtcctcctgtttcccaaaatacaaacagcctttccctctgattgggaaagcagtgtataagccatccgtcggtttggtttttcttaaatcttggaatggcacccatgaggaggtggaaagtatcctgatcaatctgcgccgtcactgtggggcggcccctgcagtgtgccctgtgagcacacacactggcgcttgttcagacacaattgggggtaaactccatgccacttcgtttacttcctcctcttgttccataaccatgtacccctcatgggcctcggca

SEQ ID NO: 22286 - DNA, 1028 bp, Homo sapiens
tcttttctgtacagagaagatagttctttttttttggtcaagaaattcaaccattagttttttaaagacaagcttgggtggggtgcctgctgggggcagtgctggtctttcactgcagcccaggcaccccttgagagtcccagtgtgtgttatgccccgagccagtcaagctgaagggagagcgggtgcgggggccctcctccgtgtcccagcccggcccctgggattgcgtcgcggcctctgcttgtcgacctgggtgctggctgtcctattttactactattgaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacaggtaagcgaggaggcggggagggcgggggctgtaggggtccccgtgggagcaggcctggcatctgcactctgactctgcacactcaggcttgggccgctcactctttcactcatccacaaacactgactgaatctctgtgtctttgagcctggccctgaggaacatgctttctggaacagggaagcacacatgtatctgcggtgatgagagggaatgtcacatgtggtcgagaggagaggcaggggtgcgggtctcggagaaggggacattgcagcagagccttgagagaggggaggttggggagagtgcaccagcagaggccacagcaggcggagaggctctgccaaagttgtggcctggtggcctcaagggatgaggtgggatgaggggttatatggcagtaatgggtgctgcccgtgtggccaggaggttggggacaagaggctggcatgtctggagcagagaaagtggcagccctct

SEQ ID NO: 22287 - DNA, 1097 bp, Homo sapiens
gaccatgcgggccaggcgcaggcgctcacatctgtaatcccagcactttgggaggccaagccgggctgatcacttgagctcagaagtttgagaacagcttggccaacgtggcaaaaaccccgtctctattaaaatacaaaaattagccaggcatggtggcactcgcctgtaatcccagctacttgggaggctgaggcaggagaatcgcttgaacccaggaggaggtttcggtgagccaagattgcaccactgcactccagcctgggtgacagtgagactacgtctcaaaaaaaaagactgtgctagacggtggtgttgaacttgaacttgatgcttgtgctgaggtcaggagacacgtgcacagcttcagggctagaggggcacaatggctgcagactatgctcgggcagctcggaaagacggtgacgggtccaggctgccgcagctaagcctcacaagagctctggccccaccaggcgggccctctgggttccattcccactccccactgcctggaggcagcagccctgtggttactgtaggagggacctgaatgcagtgaagatctgcactccacacctgtctctgtgcctcagtctccacgtctgcagcacaggggcctgactgaaataacgtggccaggcacacagcccagacgccagcactgtgtgcactgtgggaggggacgatggtccctagcccagggcctgagctgctgccttgccaattcgtggtgacagctttggcctgggtctggcaggggctggctgctactgctgaaggcctgtctgcactgtttccctgcctttccacaagcactgtccctcctggctcttcagagttgagtggttataccttgtgcaagaaaaacaatgaaacagattgtctgaatgtttcagacctgcctgaaacattctgcaggagaggtcatcccaaggcttgaaagtgtttgtcacactccttcaagcccccagggcagggcccctgagggaagggtgcaggtggagggtgggcaggagtgggagccattccttggggacaggggggctcctcagggctgtctggcccttggcctgtggttccaggtctatggtctg

SEQ ID NO: 22288 - DNA, 1265 bp, Homo sapiens
cctgtggggcggtgctcccacgcccccacgctgcaggtgggaaagctgaggcttgacctgccatggctgaccccaggtcacacagccagtatgtggcagggctgccactcaaagccaagcctgtgtgaccccggaaccagctctcagtacccgtgggtgtctggggactgggggacacgtgagtcctcaggacaggcagcaggcggtcccagggcaccagggctcctgggctgaggccgggcaggccagggcttgattagggttgggtaggaggtgctaggattggggacccaccagacagtgccccgtctcctcagtggcatagagaatgggcagaaacgccaagaccacagtggatagtttttggggtgcagtggggagccggagaagatccacttgctggctttaaataatctcacctctgtctctggcccttcctggctgtgggacctggcaggtcactttgcttctcaagcttcagtttcctcttatgcaaagcaaggaggctgcatggattagggggctgcccccaccgaagggcctggctcccgctgaagcccagcgaatgccattttgtcatcacagaagcagcaaatttcagtgcctgggaattagtctgacgaaagacgcacgtgacgtttgaggacattcatgaagtcctcatgtggaggggaggcccctgtgtcaggcaggagggtctgggctgtgatgctgtctctcttgcctaatccagagcagggtgttttatggcccatgccaggctgtttaaaaaggttttatgaggccaggtccagtggctcacacctgtaatcccagcactttgggaaactgaggcaggaggctcacttgagcctgggaggtcgaggctgcagtgagccgtgatagcaccactgcactccagcctgggcaacagagcaagaccctgtctttaaaaaaaaaaaaaaaaatatatatatatatatatatatatatatatatatatatgaaagagcaaagatctttcacagtcaggaagaaccaagatggtttggaagctgtaggtcaggggccaagggccaggcaggtgacatgggacagagcagggaaggcacgtggagcctcgaaggtcccgagagggccgagtgtggtcacagggactcgtcctgtagagaaacatgaagtttgggcatggccatggcgccatctcggctcactgcaagctccaccccccgggatcgcgccattctcctgcctcagcctcccaagtagctgggactacaggcgcc

SEQ ID NO: 22289 - DNA, 1408 bp, Homo sapiens
gccacccaggctggagtgcaatggcaggatctcggctcaccgcaacctcctcctcccaggttaaagtgattctcctgcctcagcctcccgagtagctgggactacaggtgcccgccaccacacccaactaatttttgtatttttagtagagacagggtttcactatattggccaggctggtcttgaacccctgacctcacgtgatccacccgccttggcctcccaaagtgctgggattacaggcgtgagccactgtgctcggcctcagtgggtctttcctttgagtgacagttcaatcctgtctcttctgtagtgtctgtcacctgcaaatccggggacttcagctgtgggggccgtgtcaaccgctgcattcctcagttctggaggtgcgatggccaagtggactgcgacaacggctcagacgagcaaggctgtcgtaagtgtggccctgcctttgctattgagcctatctgagtcctggggagtggtctgactttgtctctacggggtcctgctcgagctgcaaggcagctgccccgaactgggctccatctcttgggggctcataccaagcctcttccgcccttcaaatccccccttgaccaggaggcattacaaagtggggatggtgctacctcttcgggtttgtcacgcacagtcagggaggctgtccctgccgagggctagccacctggcacacacactggcaagccgctgtgattcccgctggtcgtgatccccgtgatcctgtgatccccgccccgtgaggctgaacacatagtgacgcttgctagccaagcctcaatgacccacgtaacatgaagggggaaaagccagaaagttctgccaaggagcaaggccaagaatcccgaagggaaatggactttgaagctgggcgtcttcttggctgtcttaatacaagtggcacatccaaatccaaaaccccgaaattcaaagtcttgagcacccgaaattctgaaacgtcttgagcactgacctttagaaggaaatgcttattggagcattttggatttcggatttttaccactgagtgtggagtcctaattaggaaaaaaaccaggctgaccgaaccaaaggaaagcaataaaagaaggcagatagggtcaggcacggtggctcacccctgtaatcccagccttttgagaggctgaggcgggtggatcacttgaggtcaggagttcgagagcagcctggccaacacggtgaaaccccatctctactgaaaatacaaaaactagccaggtatggtggcgtctgcctgtaatcccagctactcgggaggctgagacaggagaatcacttgaacctgggaggcagaggttgcagtgagccaatatcacgccattgcactccagcctgggggacaagagcgaaattctgtctcaaa

SEQ ID NO: 22290 - DNA, 1103 bp, Homo sapiens
tccatggcagccggcagtgtgaccgggaatatgactgcaaggacatgagcgatgaagttggctgcgttaatggtgagcgctggccatctggttttccatcccccattctctgtgccttgctgcttgcaaatgatttgtgaagccagagggcgcttccctggtcagctctgcaccagctgtgcgtctgtgggcaagtgacttgacttctcagagcctcacttccttttgttttgagacggagtctcgctctgacacccaggctggagtgctgtggcacaatcacagctcacggcagcctctgcctctgatgtccagtgattctcctgcctcagcctcccgagtagctgagattaaaggcgtataccaccacgcccggctaattttttgtatttttattagagacagggtttctccatgttggccaggctggtcttgaactcctggtctcaggtgatccacccgcctcggcctcccaaagtgctaggattacaggtgtgagccactgcgccaggcctaatttttttgtatttttagtagagatgcggttttgccatattgcccaggctggtctcgaactcctgggctcaagcgatctgcctgccttggcctcccaaagtgctgggattacaggcacaaaccaccgtgcccgacgcgttttcttaatgaatccatttgcatgcgttcttatgtgaataaactattatatgaatgagtgccaagcaaactgaggctcagacacacctgaccttcctccttcctctctctggctctcacagtgacactctgcgagggacccaacaagttcaagtgtcacagcggcgaatgcatcaccctggacaaagtctgcaacatggctagagactgccgggactggtcagatgaacccatcaaagagtgcggtgagtctcggtgcaggcggcttgcagagtttgtggggagccaggaaagggactgagacatgagtgctgtagggttttgggaactccactctgcccaccctgtgcaaagggctccttttttcattttgagacagtctcgcacggtcgcccaggctggagcgcaatggcgcgatctcggctcactgcaacctctgcctcccaggt

SEQ ID NO: 22291 - DNA, 1055 bp, Homo sapiens
tcccgagtagctgggactacaggcacccgccaccacgcccggttaattttttgcatttttattagagacggggtttcaccgcgttagccaggatggtctaaatctcctgaccctgtgatccacccgcctcggcctccctaagtgcttggattacaagcgtgagccaccacgcccggccccctttttattttttattttttgagacggagtctcgctctgtcgcccaggctagattgcagtggcgtgatctcggctcactgcagcctccgcctcccaggttcaagtgattctcctgcctcaacctcccaactaattaggattacaagcatgtaccaccatgcctgactaattttttgtatttttagtagagactgggtttcaccatgttggctaggctggtctcgaacccttagcctcaagtaatctgcctgcctcagcctcccaaacagcggggattacaggcatgagccactgtgcccaacccaaccctggatctcttttaaacaagacaatgctcgctgttgccacagaacaatgggtggggtacatgtggcccagtgtgtttggccacataactgccaggccagagggaaagagactctcagactgtctccactcagatacaaatgtgtgtgttgtgtgcgtgtgttctggtctcatatttgtttgttttgagacagggtgtcgctctgtcactgagtctggagtgcagtggcgcaatcagagttcactgcagcctcaaactcttgggctcagttgattctcccacttcagcctcccaagtagctggaactacaggtgaacaccactgtgcccagctaatttattttatttttagtagagatgaggtctcactatgttgcccaggctggtcttgacctcctagcctcaagcaatcctcctgccttggtctcccaaagtgctgggattacacgtgcgagccattgcgcatggcttgtgttcttgtgtttcttcctttttctttcgagatggcgtctcagtctgccacccaggctggagtgcagtggtgtgatcatagctcactgtagcctcaa

SEQ ID NO: 22292 - DNA, 1026 bp, Homo sapiens
gggggcaggaggcaaggaaggcttcttggaggaggaggcctctatctcacatgaaatctgttgggtaatttggagttagccaggtagagtgttccaggctgaaggaacagcatgtttgaagaaccggaggcagaagagcgtttgggggtctgaatgttgtcagggcgactggatcctagtaagatagggatggggcaaatggggctggagaatcaggcaggggcctgattacctgggcccttgcgggctacattgaggcgtttgggcttctctccagagggctacagggaaccccagctcgggagagagacccagcttggtgtgtgttttggaacatctccctgctgccctgtggagtagaggcagggaggtagtagtcaatgaggaggaggcagaacagaggagagctggtctcttgccttctgcccacccagaaaaagctcattgagctacaggctgggaagaagtctctggaagaccaggtggagatgctgcggacagtgaaggaggaagctgagaagccagagagagaggccaaagagcagcaccagaagctgtgggaaggtatggcagaaatggccaaggactcaccttcagtcctgggtgggagcaggtctgggcctaggagtctcccgctcattatctgttgtcagtttcagcaggtttttgatcatgctgcccatcgccttgtgtgctttgaggttcgcttggattgtggcatatgtcaggagcctcctttttaaaaattgtttaaataatttgttttttgaaacagcgtctccctctgccacccgggctggagtacagtggcgtgatctcagctcactgcaacctctgcctcccaggttcaagcaattcttgtgcctcagcctcctgagtagctgagattacaggcacctgccaccacatttaactaattgttttgtatttttagtagagacggggtttcacaatgttggccaggctggtcctgaactcctgacctcaagtgatccacctgccttggccccccagagtgctgggatt

SEQ ID NO: 22293 - DNA, 1052 bp, Homo sapiens
acacgtggtggcctagatcttgacaccacccccaacacacacaggccctcctcagtggggacacacagacagacgccacctctttctacgaccgcgtctgggccgccatcagggacaagtaccggtccgaggtcagtggaggagaagggaggggacttggtcctcccaccacactgcccccaccccgcctcacaaaggagctgcctctggttctggcacctggccaccctggccagctgggtggccccagcaccccccaccgagaccccccgaccccagctgtcggtcctccctgcaggccccgcaggaggggcagagacaccgaggctgccccttgggctgtggtgtgagcctgagggtgtgggtggaccctgagtccacaacaccgaccgcactgctcacccgccaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaaggtccgtgtttgggggagaagtggagacagagagggtgggggaagggctactcactgaccctgcccctgccccaggaggccccaccgccactgtcacccccgcagccggccagccctgctgaggaagacaaaatgccgccctacgacgagcagacgcaggccttcatcgatggtgagggtgggcgggggccaggctcctcgggtgggcccagcgtttcctgccgtggtggcacaggtcgagggaagatcctgagcttagaccctgctctgactcggccagcacaagccccagtatcttggggagtccaggaagggggcctagggtaagccagtcccaccctcgccagccccaaggggcccttctgcctccccaagggccgcagcttgtttgtgtcactcctggccccactcgctcaggagctgggagcctgggcagcaagtcggggctgctctatagctggtga

SEQ ID NO: 22294 - DNA, 1017 bp, Homo sapiens
tttgaaactaaataggccaggcgtcgtggctcacatctgtaatcccagcactttgggaggctgaggtgggcggatcacttgaggtcaggaggttgagaccagcctgaccaacatggtgtaaaaccccatctctactaaaaatacaaaaaaattagctgggtgtggtggtaggtgcctgtagttccagctgctcaagaggctgaagcacaagaatcacttgaacccaggaggtagaggttggagtgagccaagatcatgctactgcactctccagcctgggctacagagtgagactctcaaaaaaaaaaaataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaacttgtctgtgtctgcctcgctttgctggggtgtggaccggggtgtgggcaggggttgagcgcaggggacgcagctttctgcagatcccacccgggcctcccccaccatctggggatcactcctgaagataccaggtggatggaccctggaccatttctgtcttgagcatccatccgggcccgtgtcccaccttccctgggtctcatctgtgctctgtggaggcca

SEQ ID NO: 22295 - DNA, 1035 bp, Homo sapiens
tttcatgtgaacttgagaggaatgtgtattctgctggtgttgaatgaaggattctataaatacatattaattaaatgcagttgattaattgatacagtttggctgtgtccccacccaaatctcatgttgaattgtagttcccataatcctcacctgttgtggaagggacctggtggagataattgaatcatgggggtgtttttccccatcctgttctggtgatagtgagttagttctcaagagatctgatggttttataaggggcttccttcttcgctgggcactcgttcttctccttcctgccaccatgtgaagaaggacgtgtttgctttcccttccgccatgattgtaagtttcctgaagcatgtctttattagctgaatgagaacggactaatacattattgatgctgttgagtttagctatatcattagtgatttttttgttgtattgacctattaattatggatagaggtgaactgttggcttccaactataattttggatttgtatattttgtcttatagttttatgtttttgtcttgtatcttgatgttatattttatgggcatacatataagtaataaagattattataccttatgtcttttttttttgagacagggtccccatctgtctcccaggctggagtgcagtggcacaatcacagctcactgcagctttgacctcccagtgcccaggctcaagtgatccttcagcctcagcctcctgagtagctggtactacaggcatgtaccacgatgcctagctaatttttgtttttttttgttttttttttgtagagacaaggcttcgccatgttgcccaggctggcctcgagctcctggactcaagcattctgctcaccttggcctcccaaagtgctgggattacaggtgtgagtcattgcgcctggtcctattatgtcttcttgcaggattgacctcttcactgttacaaaatctcttttacaaggcaatgatggtccggcgtggtggctcacacctgaaatcccagcactttgggaggccaagg

SEQ ID NO: 22296 - DNA, 1060 bp, Homo sapiens
acgcgtaagccaccgcgcccggcctatttttaattttttttagtcatggtttagcttgatcacccaggctgttctaaaactcctgggctcaaaagatccttcccgcctcagcctccctctggggtagctgggaccacaagtacttgccaactcacccagccttttattatcagtgcctaatgcttaaggaggatgtgggctaccttttactttcagataaaaaacattgaggtgagataattctgttaattttttttaacacaaaggttcataacttgaataggtagtttcttgcctaaatcatttaattaaaaaatttcgttttcattttgtagtctcttggatcttggagttgattgaaatgtatttttaatagccaagtagattcacttttatatggttttaaaattgttgtgtatataaggggcatttgaaacattagatttttgtatttgctgtgactttcctactggccagtgtgccaggtaccggatatcctccgggaactgcaggcaggcccgtctctctttcacgggtgagagccgcagcctactcttggcggaagcggaaaccctttcctccatcacgtttcgcccattccaggccagaagcaggccccgctccttgctgctcgcctgtgagcatatttcgtcgaatcccggctgggcggcttggtcgcagtgtgcctgtgctgggcccggagcgcgttcatcgcccacagccgctccagttcttgcgagtggttgttcctgcacgccaggagccgtgggccgggccatcaggccatacaagtgctgcgaaagcggcctcgccttcggctgcatcatctcggggatgtttcacttgtctcttctcccagttccagccccagcccctcgaactcaccgggtctccacagcacactctgatcaatatcccacaggtgaggaatataaaatactctttataaagtggaagctagtaagtcgttcttttcaaactttcacaagaaactacagatctttttaaaagattctgattcagcaggtcattggggaaggcctgatcctctgcatttctg

SEQ ID NO: 22297 - DNA, 2088 bp, Homo sapiens
gcctgtaatcccagcactttgggaggccaaggcgggcagatcacttgaggtcgggagttcgagaccagcctgaccaacatggagaaaccccatctctactaaaaacacaaaattagccaggcatggtggcacatgcctgtaatcccagctactcgggaggctgaggtaggagaatcgcttgaagctgagaggcagaggttgcggtgagccgagattgcgccattgcactccagcctgggcaacaagagcaaaactccgtctcaaaaaaaaaaaaaaaaaatccttagcagtcttatgcctataattccagtactttgggaggccaaggcgggcagatcacttgaggtcaggagttcgagaccagcctggccaacatggtgaaaccccatctctactaaaaatagaaaaattaaccaggcatgatggtgtgtgcctgtactcccagctacttgggaggctgtggtgggagaattacttgaacctgggaggcggaggttgcagtgagccgagatcatgacactgtactccagcctgggtgacagagcgagactctgtctcaaaaaaaaaaaaaaaaaaaattccttaactgtatccttcacaaagcaaatttttattttaatgaagtttaatttctcaatttttaatggattctgcatctttgtcatatgtatgcaattgtaacgtaacccaaggtcaaataatttcacccacattttctttacattttatagtttagattatacattcagttttgtgatccattttgagttaatgtttgtatatagtgcaagacacagatctacagtctttactttttgcatatgcatattctattttttagcattatttgttgagaagagaaattttgactcaattgttcactttgattaaaaaaaactactggaccacatgtgtagaaatgttactggaacatttattctgttccatggatatatttgtctacttgccaaagacattgtcttgattaggattgctaaattttctttgtttttttttcagaattatttggctatttgtttggttatttcaggtacttttcaccttttttttttttttttttttgagatggagtttcactcttgttgcccaggctggacaacaacgacaacgcgatctcggctcaccgcaacctccgcctcccgagttcaagtgattctcctgtctcagcatcccaagtagctgggattataggcatgcgccaccatgcccagctaattttgtgtttttagtagagatggagtttctccatgttggtcaggctggtttcaaactcccgacctcaggtgatcctcctgcctcggcctcccaaagtgcttgggattacaggcatgagccaccacgcccggccttcatcataattttataacttcataatacattgttctttttctttttcttttttaaaagattcaatgattttttttaaagcaataaaaaatagtaaaaaaccctttgtgtttactgaagtggttatcatttctggtcctcttctttctttccggatttccacttggcttcatttttctttgcacccatgcagtttagggatgtctcttatggagcaagtatgctgattacaaacactttcactatggctgaattaataatttattttcccttcatttggaaagatattgtttgctggatataggattctcagttgatatacttgttctttcattactttaaggtagttgttctatggtctcctgatctgcgctgttgctggtaataagtatgtaatgaatcctatctttggttcagtgtagttaatgtgtctttttcctgttgccttaaagctattttaattgttcttgctgtgaagtagtttactgatgatgtgcttggtgtagatttatatacatatatgctcatggtttgttgaacttttttgatttctgggtttataattttcatccagtttggcaaatgtgaaaccagtatttgttgaaatattttttgtcatgctctttcctctgccaaagagtcttgttatttgcatattatgtcacttgtaattttcccactacacagctcactgattttctgttttttgttgttgttgtt

SEQ ID NO: 22298 - DNA, 1027 bp, Homo sapiens
acccctctaaatgcggctcctactctgtagctgacagacacccacagacgtgtctgtagcatcctctgtcacactgggacccgtactggcagcaggagccgtagggaggactgggacacctggaagccaggaattggtgagtgtgcggggctgagggtcccgagactaggatgggactggttggaaccggcaggaatagaccgtggcgggacccgggcctcttcgtagttgactctgggttctgagacccaagtccccctggcgcacctcggccctggttcctctcaggccgcagggtggggctgcgacggcagccgagacccctagccgtccggtccagtccctgtgcaactgactgtggccccaggcccagcgccctctctggtcagctccgcgcccgctgccccagtcacgcccgctgcctccgtgtctccccagattgtacgggggccactagagggtcatgggggaaatcctgcctcgagtatggggttcgtgtgagaggagctgtaggctgtggggtccccagttccctctttctcaccaggggcttttgtattttatctgagtttcccaaatatacgcgaagcagggtctcaaatccgcgactgtggtccctaggctaccttctcctaaggctggcagcaaatttgggatttcctgatccctttccgcattttataacacggatttcctttagttcacaacagtatcacttcttcgtcctccaggctatgtttcaaacacaggcagtattttaatcgtcatttttttagagggcagtatatggccgttttaaaaatatttgttttgtgtttgtgaacgtttcagagaaaaaccacctgacactccgctgtaaacaatctttgtgtctctttttatctgccctaggcacagacaccttctgagaatgtcttgggttgagattcccctttggaaactttacagtgatgcgacctcagcccaccctctgccttttcctgatcctgggtttcaggactacctggggctggcccaagatgcctac

SEQ ID NO: 22299 - DNA, 1052 bp, Homo sapiens
ttgggcaagtcactgcgcctctttgagcctgttatttcatctgtaagaagctgagataattaatatatcatagataatgtagtgttctcagtagaaactgaaacagcactctgagatcaaactcattaatattcctacaacaaaatgagtaaatacttgaaacagaacaaaacagccaataaatagcctcttatttcttgatgtcaggttcatgcctaccttacaaaatagagttgtcagagctttttggttcgtagaactgaagaaaagggactgtagactcatggaagtgtctaatgtcagaaagccagatatgtcaaagatgaatttctgaaattaaaacattttatttgggaagaaatacttgtaattcagggcatacacacagaccaagtggtctttggtatgtcttaaaaacagagaacattggaggtttcatgaaaaggagaagtgttacatatggttcttcaagaaagttcattggcactagtaaggtttttgggagttggaaagttctgatcgggaaatgatggcaatgagtaaaactattcttagagccacagcaagttgtttcagtaactattagataaaaccggtttcaggatacaactggctgtttcagcagcttggcagagaatgacatgcttggagcattggtacgtgccctgagtgcttttcccccttggcctgttgactcttatagttgagtttggcaagaatgacccaatttatgtgatcaacattcagtttgctaattcacaacaaaacaattttctgccactccatgactaatgtttttaaatagccctcagcctttggcttgaacttaccaaaggacttttcaaactaaaccatgtccactcttttttttttttttttttttttgagacagtctcgctctgtcgcccaggctggagtgcagttgtgcaatcatgattcactgaagccttgacctcctaggctcaggtgatcctcctgcctcagcctcctgagtagctgagaccacaggtgcatgccaccatgcccaactaatttctatagagacaaagttt

SEQ ID NO: 22300 - DNA, 1030 bp, Homo sapiens
gagtggctgggattacaggcatgtgccaccacacccggctaatttttgtatttttagtagagatggggtttcaccatgttggccaggctgttcctgaactcctgacctcaagtgatccactggcctcggcctcccaaaatgctgggattacatgtgtgagccacctcaccaggccagaaggtatgtttttatttttagtttacaggttgaaggctggacttttataaggtacatgaggagacaaaccagataaatgcttgattggttgcagagatgcagtcaccttatttggacttgtcaacccgaaataatcgaaagtttcagatttcaactggaagagtttattcaagcaaaaagatagcaatggcccatttgggaaaaacacagactccagagaaatggactcagtactccaaaattggaagttaagttcttgcttatattactgggaaaagaggtcctgatcagatcccaagagagttcttggatctcatacaggaaggaattcaagacgagtcggaaagtacagtgcaaagagagtttattgaaagctactctgggccagcatgatggcttaggcctgtaatctaagcactttgggaggccgaggtgggaggatcacttgaggtcaggagtttgagaccagcctgggcaatatagtgaaaccccatctcttccaaaaataacaaaaattagccgggtgtggtggcctgcacctgtagtcccaggtactcgggaggctggatgggacaatcacttgaacccgggaggcagaggttgcagcccagctgaggacacgccactgcactccagcttgggtaacagagtgagaccccatctcaaaaaacaaaaacaaaacaaacaaacaagacagagttcaagaccaacgtggccaacacagtgagaccctgtctctatttaaaaaaaaaaaaggaaagaaagaaagaaagcctctcttacagagtagggcatcctcctaaagcaagtggaggaacgtactgtctaagtttttcttatgtagggatcttgt

SEQ ID NO: 22301 - DNA, 1045 bp, Homo sapiens
cctatcctgctgtggctttagcccttgttcagttctagcatcacaattgctttatgaactagccaggtgtggtggcacatgcctgtggtctcaactactcaggaggctgaggcatgagaattgcatgaacccaggagtaagaggttgtagtgagccaagatggtgccactacactccagcctgggtaacagaatgagacgctgtcttaaaaaaaaaaacaactgctagctgggcatggtggctcatgcctgtaatcccagaactttgggagcctgaggcaggcagatcacctgaggtcggcagcctgaccaacgtggagagactctgtctctactaaaaatacaacattagccaggcatggtggcatatgcctgtaatcttagctactcaggaggctgaggaagaagaagtgctagaaccccggcagtgagccgagatcatgccattgcactgcagcctgggcaacaagagtgaaaaaaaaaacaagttgctttgtggaagaaagtaagtatacacagggagaaagagatctgatgaccaaagcagggaatacgtgtttggagtccacggcatcctgagaacttcttgggaatagagtctaggcccccagtgctgtcactctcacccatcttcttctacacatgtgagatgtttcaggacccagtggcttttaaggatgtggctgtgaacttcacccaggaggagtgggctttgctggatatttcccagaggaaactctacagggaagtgatgctggaaactttcaggaacctgacctctttaggtaaggatgacaatattccttccctcagtccattagtgaaccagtgtttctagctcattaatgctgttgagtgatttagaacatagacaggaaatactttgatgaataaatgaggtatggctgcagtaaatcatgggcgtagaatctaataattttttcacaattttatactgcctcaggactattttttctgtgtctgtattttaggaaaaaggtggaaagaccagaacattgaatatgagcaccaaaaccccaggagaa

SEQ ID NO: 22302 - DNA, 1508 bp, Homo sapiens
aaagaaagaaaaagcttctctgtttcagagtagggcatcctcatacagcaagtggaggaacgtactgtctttaagtttttcttatgtagggatcttttctatgtaaagaataaactacctgtgcctatgtgcatgtgggctgacagcatcacaaaatttattactctgttgatttaaagaaaactatcctttacattttagcacccaagtgcattaaaacataactataattatcttgaaagcacatattgttataggtattgggacatcaggacattctattgttgtgggagtgtaaggatacttgcaggcatcttcaggctgttttcttcatgggaaacattttgtgatcatgggttgtgactgacaaggagtgtttcttgttagtgtcaagatggagctgaacttaaattggtgttactctggctcccctaggcacctgcttccctaacacttgtataggcaaaaggcaaataaatgtaacaggattatgttttccatagaaggctgatgtatgagatacaacaattttttttttttttgagacagtatcttgctctgtgacccagcctagagcagtggtgcgatgatggcttactgcagccttgacctccccagctcaagcacctccgcctctcaagtagctaagactacaattgcccaccagcacacctggctaattttttattttttacagaggttaggtctcgttatgttgcccaggctggtctctggctcctggcctcaaacagtcctgcttccttggcctccaaaagtgctgggattacagatacagatatcagccactgcacctggctaacaacttaattcgtaatggtttacttttttcccccagagcttgttttcttttctttctagctggtttttatttccttttcaatttaagagtgaatttaacattccatctgaagacaatctgatagccatgaaatctttgtgtgagaaagtagtctctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcattccagcctgggcgacagagcgagactccgtctcaaaaaaaaaaaaaaaaaaaagaaagtagtctctgtagtcttactacagagatcagtagtgaagaggggcctggtaggatggctcacacctgtaaccccagcactgtgggaagccaaggcaggtggatggcttgatctcaagagttcaagaccagcctgggcaacatattgagaccccatctcatttgtgaaaaatcatattaatataagttaaaaaaaatagtggagagggaaagggtctttcctgtttc

SEQ ID NO: 22303 - DNA, 2014 bp, Homo sapiens
ttacaggcgtgagccactgcacccggccaatatgtgatattttatattggattttatttaaactcagttatgaaccttacatggaatgatagttaattcactttcttatttagttgattttattatttagaacagtggttgtttacccaaaacattgagcagataatccagagttccctcatttttcttccaagctcatagttccccctattttaaacatcttgactggccaggtgctgtgcctcatacctgtaattctaccacttagagaggctgaaatgggaggatagcttggactcaggagttggaggccagcctaggcaacatagcaaggccctgtttcaaaaaaaaaaaaaatgttttaaaccaaggaaaccatattgactgtgtgtagtgtatcctataattgatgcaagaatatattacatgtgaacacgatgaaaattgaagaagccaatattattattacctaaagtccatcttttacatgaaacttcactctttttgggctgtggtttaagacaactacgtgtgtcatgtatccaccatcacagtcttatacagaagcgtgtcacaggcctcaaaatcccctgtgctcttcctaatcatagctctcccctccctcttctgccacccctatttatccctggcaacaaatgataatgttcctgcctcggttttgcattttccagaatattaaatatttggaatgatgctgtaagtggccatttcagacttgcttcctcgatgtaaaaatatgcattgaaggtctctcgatacctttgttgcttgacaactcatgtattttttatttttatttatttatctaaaaaaaattttgtttttgaatggtgtgaacccaggaggcggagcttgcagtgagctgagatggcgccactgcactctagcctgggtgacggagcaagactccatctcagaaaaaaaaaaaaaaaaaatttgtttttgttttgttagagacagggtctcaaacaccccagctcaggtgatcctcccacctcagcttcccaaagtgctgggattccacttgtgagccatcatgtccggccactcattttctttcatcactgagtaacattacgttggatgggtgttaccatagtttctttattcacctactgaaaggctcatcttgagcctggtgtgatgcctcatccctaaattcccagctacatgggagacagaggtgagacgattgcttgaggccaggagttagagaacagcctggtagatacagtgtgagacctcatctatttttttttaaaaaaagactcaccttgtttgagtctagtttttggcagttatgagtaaggctgctaaaaacgtctgtgggaggacttttgtgtggacatcagttttcagttcatttgggtcaatattgtaggattgagactactgaatcagtaggaccatgcttattttcttcagacctccgcagactgtcttccgaattggctgtagaattttccattcacatcgatagtgaatgagtgttcattgtcattggcattaggaagtgtcagtgttttggattttagctactgcaccaggtatttgctgctgcctcattgttttcttttttttctttttttctttgtttgtttgtttgtttgtttggagatgcagtttcgcttttgtttccctggctggagtgcaatggcgcaatctcagctcactgcagcctctgcctcccaggttcaaacgattctcctgactcagcctccagagtgtctgggattacaggcgtgcgctgcctctcctgaccaatttttgtattattagtagagatgaggttttaccatgttggccaggcaggtctcaaactcctgacctcaggtcatccacctgcctcggcttcccaatgtgctggattacaggcgtgagccactgcgcccggcctgttttcatttcgctctttaatgacacgtgatgtagagcatcctgtcatatgtttgccataattacagtctttggtcgggtgcggtggctcacgcct

SEQ ID NO: 22304 - DNA, 1044 bp, Homo sapiens
ctcagttcaggagtttgagaccagcctgacaaacgtggaggtttccatgtctactaaaaatacaaaattagccaggcgtggtggcagaggcctgtaatcccagctactcaggaggatgaggcaggagaatcgcttgaacccaggagacagagattgcagtgagccaagatggtgtcattgcactccagcccaggcaacaagagcaaaactttgtctcaaaaaaaaaaaaaagaaaagaaaagaaattagtccagcctgggtaacgtggcaaactttgtcaatacaaaaacatacctggtcatggtgatgtgtacctgtagtcccagctactcaggaggctgaggtagaaggatctgttgagcctaggagtttgaggctgcagtgagctatgattgcaccaccacactccagcctgggcaacagaatgagcctgagaccctgtttcagaaaaaaaaagggaagaaaagaaaaaagaaaaaaatgagtttcaatagagtatgttgtcttttaaaaattacattcaacaggttgtggctgataattgaaattcactgagatttatttttgtataaagtgtgcattctagaaacttagtaaaaatattacatatgcacaaaatacataaaagaattgcacaatgaatccaaataatgatggagccagtattgggaataagataattgccttactttttatactttcacaacctgggtatgcatccccatcagtatattttatttttgcacattttttatgcaaatgataaccaatgtgtgatattttatattggattttaactcagttatgaaccttacatggaatgatagttaattcactttcttatttcattgattttattatttagaacagtggttgtttgcccaaaacgttgagcaaataatccacagagttcccacatttttcttccaagctcataattccccctgttttaaacatcttgactggccagatgctgtgcctcatacctgtaatcctaccacttagggaggctgaagcaagaggacagcttgaactgcagtgttg

SEQ ID NO: 22305 - DNA, 1057 bp, Homo sapiens
agaaggagtcttgctctgtcgcccgggctggagtgcagttgcgtgatcttggctcactacaagctccacctcccaggttcacgcaattctgctgcctcagcctcccaaatagctgggactacaggtgcctgccatcatgcccggctaatttttttgtatttttttttagtagagatggggtttcatcatgttagccagcatggtcttgatctcctgacctcgtgatccacccatctcggcctcccaaagtgttgggattacaggtgtgagccaccgtgcccaccccggtaaagggtcttaaaatgtatcttcccttgctgcagaagctattttgaagtgccatatttttcattaagcattaagtagagaacatcaggataaattagtaggatcatcagtattacatgaaacattagattgctgaatgaattgcataatttaactagaaacactttattctcaagtagaaaagttgtttgctttggagaatttaatcatctgttacttgttcataaatattcccccgaagggctctgacctctccctccagtgtgagcctaattcctaaaactgaataattatttgctgctgcctgtttcacaaacacacatggatgggtcagatgtgtctccttttcctcaaccttatatgaaggaaggagcatctgagcacagcacagaaatgatccaaaccaagctactgtgaagtgtaaagagagcagcatggcttttccaaacaggacagcatcacaaaccctcccaagggtacaaggagagcagttagaacagaaggaaaggtgacccgcagactgttaggactggtgaaaatgattcattgaaaatctaagaaagaactcttgtctttggagccctgtgcccatttctctggagtgtgtcttttcctgaatggccattcccagcttttcacttgaataaactcttcacaactcagtcctacgtttttgcatgatgtgaggttgacgggacacacacccaatacccatggactctatgctccctgccaccaccttcctcttccctcctggcctgcacaaatg

SEQ ID NO: 22306 - DNA, 1031 bp, Homo sapiens
actggctaattttttgtagagatagggtttcaccatgttgcccaggctggtctcaatctcctgagctcaagtgatcctcctaccttggcctcccgaagtgctgggattttaggcgtgagccaccactcccagctccttttttgtgatttcaaatagaatcctagagtgtagccttgagaaggctacagggagaaaaagctcagagaaatagggagaatcactcttcattatggcttcacataactgaatctatctatctatctatctatctatctatctatctatctatctatctatctatctatgtttatcttgagacagggtcttcctcttttgcccaggttggagtgcattggcacccatcatagcttgctgcattctcatactcctggtctcaagcagtcctctcacctcagcctcctgagtagctgggactacaggcgtgcaccaccactgctggctaatttttaaatttttctgtagagatggaggttctcactgtgttgcctaaactgatgttgaattcctgggctcaaacaatccttctgcctcaacctcccaatgtgatggaattacaggtgtgagccagttcacccggccactgatacattttgatgagaaagtaggtagataaattggtgaattcaccaatttattttcaccaatttagtgaagattcatcaagctgggtgtggtggctcacgcctgtaatcccagcacttcgggaggccaaggctggcagatacttgcggtcaggagtttgggtccagcctggccaacatggtgaaaccccatctctattaaacatacaaaaattagctgggtgtggtggcacgtgcctgtactcccacctcctcgggaggttgaggcgggataatcccttgagcctgggaggcagaggttgcagtgacccaagaccctgccactgcactccagcctgggcgacagagcaagactccatccaaaaaaaaaaagagggctgggtgtggtggctcacgcctgtaatcccagcactttgggaggccgaggtg

SEQ ID NO: 22307 - DNA, 1033 bp, Homo sapiens
gtagaagctatatgtatattttgttaattagtggctcatatttaaaatagttctctgactatggatttcaaatgcttaatctcacaaagaaatgttaaattgatataatcctgtaagtaatctgaaagcaatagtgcatgaatttcataggtagtgttgttttaggtcagtaaataaaatatttgtctttccattttgaaatgtgtttaatccaacaatgaatttaaatgtgtttctcatattcaggtatgttaaattgtatatggttgcttaattgttctgtgattgaggaccactgaaaaataagtcttaataaatgttggtatgaacctacttgcttcatttagcaggttcttgattccctttccacattatatacattccatcatatttattggaacagctccttttttttccttttttcttttttctttcttcttttttctttttgagacagggtctcgctctgtgctctgttgcccaagctggagtacagtggcatgatctcggctcattgcaacctctgccttctgggttcaagtgattctcccaccttagcctcctaggaagctgggactacaggcatgtgccaccacacctggctaattttttgtatttctagtagagatggggtttcaccatgttggccaggctggtagaactcctgacctcaagtgatccacccacctcagcctcctaaagtctgggattacacgtgtgagccatcacacctagcccattttttttttcttggctcaaataattttattttgcttcctattaaagagttgttgttaattctaagtatgtaaagtttatcacagactgtagtctcgtgaattattattttaacctgttgttctttactccttgttatttattctggctgctctttgtataattgattttgggataaggagacagctatgatagaataataaaatctaaaatgggagatgcctttcatggattgtgtcatgtcaatctgggtaatgggaactaaacttttcagacttcatttctttctttcttt

SEQ ID NO: 22308 - DNA, 1045 bp, Homo sapiens
tggtgaaaccctgtctctactaaaaataccaaaaaaatcagctgggcgtggtggcacgtgcctgtagtcagagcagctcgggaggttgaggcagtagaattgcctgaacccgggagacagaggttgcagtgagccaagatcacaccactgcactccagcctggcaacagagagagactgtctcaaaaaaaaaaaaaaaaaaaaaaatagctgggcatggtggcacgtgcctgtaatcccagctactcaggaggtcgaggcaggacaatcacttgaactcgggaggcggaggttgcagtgagccgagatcgtgccactgcactccagcctgggcagcagagtaagacttcatttcaaaaaatgggaagaacagcaaacattttaactagctcagataagcatcctccttcacaaggaaaagccgcattcagaaaatgaatcacgttcccaaccttaagagccaggttctgactgctgtaacgcagccccagaggggatcagtctgtgagttcctgtcccctcagtgtggaaatgctccctccttcaggaccttaattttcaccagcaggaaactctcacctggaatcagcttaaggttctgatctaaataaactgtcaaaatcataaacccattctccagaagacaacccaaacaagtctttctctaaacctgaactaaacagatttttttagagggagtctagctctgttgcccaggctggagtgcagtggcgtgatctcggctcactgcagcccccacctcccgggttcaagcagttctcctgcctcagcctccccgagcagctgtgactataggtgcacaccaccatgcccagctaatttttgtatttttagtatagacggggtttcaccatgttgaccaggctcgtcttgaactcctgacctcaggtggtctgcctgccttggcctcccaaagtgctgggattacgggagtgagcgactgcacctggcctttttttttttttttttttttaaacaagatgggggtctcactatgttgctgaggctggtctcgaagtcctgcc

SEQ ID NO: 22309 - DNA, 1101 bp, Homo sapiens
aaccagtattaccgtgcttctaattttttacagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggaatgtgcaaaaac

SEQ ID NO: 22310 - DNA, 1045 bp, Homo sapiens
atgatgaaaccctgtctccattagaaatacgaaaattagctgggcgttctggtgtgcctgtagtcccagctacttgggaggccaaagcaggagaatcgcttgaacccgggaggtggagattgcagtgagctgagatctaccactacactccagcctgggtgacagagcgagactccgtctcgaaaaaaaaaaaattacagcacagatgtgcaatatatacttgataataaatggctaagttactggtttatatatttacaatcctgttttagaatgtattcctgtgtttttttaacagtaagacagtctcaggcaggtccttaaggagatattcccggaaaaactttgttatgataggcgatgacggctccatgtgcaggactgcccctgaacgtattctggcgggacaaaacatggaggcagaagacaatgatattgatgatcctcaccccgtgtagtcctacactaatgtgtgtttgtgtcttagttagtctttaacaaaaatagtttaaaaaaatttaatagaaaaagcttatagaatatggacataaaatatttttgtacagctgtacaatgtgttttaagctaaattattacaaagtttttaaaaataagtttataaagaaaataatgtacagtaagttaaggtttattcattattgaggaaaaaatgtttttatgaatgtagtgtagtccaagtgtacagtgtttataaattctccattagtgtacagtaacatcctgggccttcgcattcactcaccactcaactgactcacccagagcaacttctagtcctgcaagctatgttcatggagtgtcctatgcaggtgcatccttttttatcttttatactgcatgtttactctgtgtattttctgtgtttagactcataaatacttaacattttgttacaatttcctacagtgttcagtacaacaacatgttgtatggtttatagcctagtagcaatagactgtaccatatagtctagatgtgttgtagctataccatctagatttgtgtaagttcactttgtgatgtt

SEQ ID NO: 22311 - DNA, 1038 bp, Homo sapiens
tgtagtcccagctacttgggaggctgaggcaggagaatcgcttgaatccgggaggtggaggttgcagtgagctgagatcgcgccactgcactccagcctggctacagagtgggactccatctcaaagaaaaaaaaaagagtggcagggagcttgaatgttatggtgcaacttggactgtcaccattgcccaccctaccccagatcccaagacaaaagcgtggttgaaggagcacgtggagcctgtgttcggcttcccccagtttgtccggttcagctggcgcacggcccagaccatcctggagaaagaggcggaagatgttatatggtgggtgtcatggatgtcctgggggtgctatagggaaggaaggagggaggccagcgttcagccctgcctgagagggttgctccctgtgtaagtggtcactgtcatcacctctctcccacagggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaattttatttggtttgatttttttcatttttaaattttatttattttattttattttattttatttttttgagagacgaagtctcactctgtcacccaggctggagtagaatggggcaatctcagctcactgcaacctctgccttccaggttcaagcgattctcctgcctcaatttcccaagcagctgggactataggcgtgtgccatgcccaactaatttttttttttttttgagacacagtctcctgttgcccaggctggagtaccatggcacaatct

SEQ ID NO: 22312 - DNA, 1079 bp, Homo sapiens
acccgcctgcctcggtctcccaatgtgctgggattataagtgtaagccactgtgcccagtctgtttttgttttctgagacagggtctccgtcacccagaccgaagtgttgccatgtgatcttggctcattgaagcttcgaatgcctgggctcacagggtcctcccacctcagccctgtgagtaagtggaactacaagtatgccaccacgcacagccaatttaaaaaaaatggctgggcgcggtggctcacgcctgtaatcccagcactttgggaggccgaggtgggtggatcacgaggtcaggagatcgagaccatcctggctaacacggtgaaaccccgtctctactaaaaatacaaaaaaattatctgggcgtggtggtgggcgcctgtagtcccagctactttggatgctgaggcagaagaatggcatgaacccgggaggcagagcttgtagtgagccaagatagcgccactgcactgcagcctgagtgacagtgcgagactgagcctcaaaaaaataaataaataaataaaattaaaaaaaatttggtagagacaggatcgccctgttgcccagattggtctctcaaattcctgagctcaagcgatcctcccatctcaccctcccaaagttcttgggattacaggcgtgggccactgcgcctgccctgctctcttttttgagacagagtcttgctttgttgcccaggctggagtgcagtgttgcaatcttgacttactgtgccctcaaactcctgaggtcaagcaaccctcctgcctcggccttcaagtagctagcactgcaggcgtgtatcactatgctcagctaagttttttatttcatagagatggggccttcctatgtgagaggaggcctagcactttgggagtccaacggtatgttgtgttcttgagatgaggtctcactctgtcacccaggctggagtgcaatggcataatcttggcttactgaagcctccacctcccgggctccagcgattctcctgcctcagcctcccaagtagctgggattacagatgcgcacctccatgcccacctcggcctcccaagtgctggg

SEQ ID NO: 22313 - DNA, 1031 bp, Homo sapiens
ttgctctctagcccaggctgcagtgccgtgcagagccactgcactgagccaatttttttatttttagtagagacgtggtttcaccatgttggccaggctggtctcgaactcctggcctcaagtgatccacctgcctcggccttccaaagtgctgggattacaggcgtgagccactgtgcctggtccccccattatatattctgaagaggcatcaggtgcaaccattcatgtaggacctgaacatcacaccagcttttgcaagatgtaagccctgggcatgtggaagaagctccactcccccgtcacagaccattcgatggcttctgcaggacatatgggtgtgacaatgcaagttgtgcctcaaccccctactcccgtggctgctcgaccttgcgtgaagtaagagggctgcgtgttggaggcaggagggcatccaacgccccgctccctcagcctggctctctcgtcaggcaaatcattcatttccaagccttatctatatcatgggtccaatctcttctctgtaggactattctaagggtaaattgagatacagatggtcccaacttactacagttcaacttactacatttttgacttacagcattttcaactcacaatgggtttattgggacgtagccccatcataagtggaggagctcctgtgctgtgtgtgaatggcctagcaccgtgcctggtgtacaacagacaccatcagtggttcattccctccccttttgcataaggaatcccccctctcgctgggtggagtctgtcaccttggtcttcaggctgttcctgaagttggtcatgagtgcatggtccttttgccggctcttgttgatgttttcgatcagctcctgggctctcttctgcaggatgtcaatgcttgagtccagagaggagaagtagagtcccgacttcccttccaggaccgtcagctggcaactggcactggaggtggcgacacaagggcaagaaacctgacttctcagagtacaggaagcggccaggtgtagtcgctcatgcct

SEQ ID NO: 22314 - DNA, 2017 bp, Homo sapiens
ctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacc

SEQ ID NO: 22315 - DNA, 2047 bp, Homo sapiens
cgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccctcctgtgtctccttctggggaaagacagacttaaggaaacccagcagtggtctttttggggggggggggggtttccagtatatctcctttttcagctattgctagagaggttgctgagtgttccacaagattccagggacccttatttaccccataaccctcaaaaccaacgggggaatggctgttgctgctgtaaatactccacatactaacttactgaatccttgaacctaactggtaagttttggttctgcttatttatttatttttaagatagactctcgctctgttgtccaggctggcgtacagtggctcaatctggttcaccctgccccttaaactggcctttttcatgcttctattcctttggggtcctgtggctcagcccaacccctctgggatgcctccaggactggtagatccaagggagaattctgtatttaatgtagtgaggctttgaaagttaacatctttaaatacttctggggtcagattaggtatagtacaacaaagtactcctgcccggagacccaagaatgaaaattgtaggttcattccaaaactccagatccctaaagaatgaatgaggctacaaaatggcac

SEQ ID NO: 22316 - DNA, 1011 bp, Homo sapiens
actgtcccctttattctgttaattatactttatactacccgaaattacattttcttcacattagtgttctctcattgagagcagggacttacttgtgttgagtttgttctgtgctgtggcctctgtgtctaaaacagcacctggcacataatgggtgtttagtataagtaaatactgtgttgaatggcatgatgattgaatgaattcaaatctagcatgctttagatgctgagaaagcttaaaaaacccagcgtgcttgcctttctgccatcagggctggcagtttctctgtcctaaactagaagggaaaagagaatcttggggtctccagtgactgtctgtaccactccctctaggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaaggtgggtgacgtgtgctggctgggagggtgggtggacgagctggggagctggcaaagagcctgtgtgcccaggagagattagctgtgaacagggcggggccacagcggagcgggttgttgggtctgatagggttgctgatgccagctccctttttcttgctgttgcagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcagggtaaggcgggggcagcagtcccagcttgggccctgtcctcctagcacattccagcgtccacataagtggtcccacacacctggagggagggcaagccgccagaagccagggtccgatttctctctcttgaatttgcagctctgt

SEQ ID NO: 22317 - DNA, 1055 bp, Homo sapiens
ctaattttttgtatttttagtagagatgggatttcaccctgttagccaggatggtctcaatctcctgacctaatgatctgcccgccttggcctcccaaagtgctgcaattacaggcatgagccatcacacctggctgactgaaaagcactttcttctttaatgtgaaaatgatcagatgcatacaatggtagagttatatcagagcttccagatacccaggtagggcacagtggctcatgcctgtaatcccagcactttgggaggctaaggcaggcagaccacttggtcaggagttttagaccagcctggccaacatggcaaaaactcgtctctactataaatacaaaaagtagctgagcatggcggcaggccactgtagtcccagctactcaggaggtggaggcaggagaatcgcttgaacccaggaggcagaaattacagtgaaccgagattgccccactgcactccagcctgggtgacagagtgagagtgtctcaaaaagaacagaaacaaaaatgaacaaatgaacttccagatacctaaatccaacacccagatgagttcactttttttggtttgggggctggtaggtgggaatagagacagggtctatgttgcccaggctggttttgaactcttgggcccaagcagtccctcctgccttgcctcccaaattgttgaggttacaggcgtgagccaccacacccggccaagttcacctttctaaaagatccacagaccacgtcttttcccatgtaactgtcaccaccgtggcttccccctgctctagaaaatgggtctgacttgggccttcctctctggtgtcattgtctgcctcctcccccttcccttgttcgctgttttttgttttttttgttgttgttgtttgtttgtttttgagatggagtttcgctcttgttgcccaggctggagtgcagtggcgtgatctcagctcaccgtaacctccgcctcctgggttcaagagattctcctgcctcagcccccagagtagctgggattacaggcatgtgccaccacgccctgctaattttat

SEQ ID NO: 22318 - DNA, 1027 bp, Homo sapiens
tgttcattagacgtgaacttgtcgattgggcaaattgtttttggtctccaactgccgggggctctccccaccctccctgctcgcccggttccctcctccccttggacgcagccattggctgctcgtggatgtctctttgccaaataggtggatccttctctctctttctctctctctctctctctctctctctgtctctttctccccccacccctttttactggcttggcacaagcaaatggatggggattgagcctgaaaggagagagagagagggagtttgagagagagaaaaggagcaaaaaaaaaaaacaccccaaaaacccaaccagtgcgcacacacacgcgcacactcacacacacgccccatcccatccacgtcctccctcgatcctcgatctctccctcccccccttcttcctttcctccctccctcgctccctctctctcttttgcacgcgtctgccagcaacggtctgcagccggtcagaactcgtcctcttccccgggaatctgcgagctcccccttttcctccgatcaggcagctcgaagtttacacccctgtgccgctgccaaagccgaaagcctttttcttcagctgccgctttttccctcctgggttttgtttttgtttttgttttgcacgggggtggggtggggtgcgttgttggttgtggggagatggtgggaggctggttttgatttttaaattttgcatttttttctttttttttttttttaaactggaagaggatgcacaggggaagaaattgaaaaaaaaattttgttggcttttgtttacctggcgtgtgtggcagccggctcgctccctctctctgcttgctatccctgacctttctttctttttgctccttttcaaaaaaaatattaatttcccccttctgtgcaatggagcatggggggggggaggagggggaagggtttgagaatccacccaagcccggcccctattccccagaacaccaataataaccccctttaaaacatttaccttcctcccctgct

SEQ ID NO: 22319 - DNA, 1042 bp, Homo sapiens
agggacccttgggggtcaccgtggcatggcagtttcctctcagcttctggccttgggactgcagaagtggctcttgagactgtctggtggtgagcaggtgctggccatggtatcttaatggcagcagcccccaggtccacttctgaggtgcaagcccatgctggccgccagcacgtgccagagagctcctgaggaagcagctgctgctgacacctgaggccagctgcgcagtctgccacaaggcccctggggctgccaaggtcgcacatgtcctcccaggacttgaagggggaccaggggagggtgagctgttgctgtggactgtggactttgacatcactcatagacaccccctctctcacccttgcatcccagacagtgtcccccagggccatgcaggcagggacacacagcccccttgtgccctgccccaagtccctgtgtgtaagtgagcatgctctcatcagacttggtccccactgccatggcactcttatctgtgtgcctgaatatgcatgcttattcatctcgaaaactgggccgtagggccaggtgtggtggctcatacctgtaattctagcactttgggaggccgatgtgggaggatcatttgagcccaggagttcgagcctgggccacgtagcaagacccccatctctataaaataaaatttaaaaaaaaagaaaaaagagaaaatcgggccttatatcattttctacatcctattcggcccatggaagcgtaagtgtcttcagcctctgttgacccttgtcccccaccctttctctgtgatactccaccttacccagaacctgactgtcctcaggccctgggtagtgggagctgcctcaagactcctgaggccccacaagaggcttttgaattgcagcagtggatgtgggtagttgtgtaggacagagggaggcgacagcatcgtttctcccctttcttccttcagctggggctgtggcatggcagtgtgggccatccagtgtctagagggcttgtggccacgcagtcgtgggtgggatgcatatgttca

SEQ ID NO: 22320 - DNA, 1051 bp, Homo sapiens
ggcacctccgtgtgtgtgcgcgcgtgtgtgtgtgtgtgtgtgcgtgtgtgtgtgtgtgtgtgtgtatgtgtgtgtctgagtctgagcatatgagtgtatgcatccaagtgtatgcacatacctgggtatgcatatgtgggttcagctaaggccaaatctgtgcacacccctcagcctccataaaacttgttaggccaaagtccgtgggggcaattggccagcaaattatacatggcccctttcacagtacaagtttgtttcgagcaggagctgagggcagtgttggctgtagccagcaggaattcctccctcaccctagtgggagccataactacctccccatctgtaggtggaaaatatatatatatatattaaaaacatgcatccgggcacggtggctcacgcctgtaatcccagcactttgggaggctgagacgggcggatcaccaggtcaggagatcgagaccatcctggctaacactgtgaaaccctgtctcttctaaaaatacaaaaaattagctggtcctggtgacaggtgcctgtagttcccagtactcgggaggctgaggcaggagaatggcgtgaacccaggaggtggggcttgcagtgagccgagatcgcaccactgcactccagcctgggtgacagagcaagactccatctcaaaaaaaaaacaaaaacaaaaacaaaaaacaaaaacatgctgtcagttggagtttatgtgcaatcccaggctcctcctggctgctggagcttcccctccagagctctactgaagaggcagtgtcctcttggaaacacgcacaagcacacgtgcctgcaaacagcagaaggaagaggggggtgctgaagaggtgagggggaggcaaaggaaggacagagggaggggagccaagggagacagggaagtaagatcagaaatggggatccaaggggaaaggcagctgaataaaagaagtaaggtggggacttgttccaggggctgagaaggggagctggtgtgggtgtgagaagggcaattttgcaggagaactttgtggctgttccagag

SEQ ID NO: 22321 - DNA, 1076 bp, Homo sapiens
tgggcaacatagtgagacctcatctttacaaaaaaatttaattttaatttgtttttcacccgtgacacagccctcaggaggtcctgagaacatatgtctctcgtctttgcaaaaaattgttttaattagccgggcgtggtggcacacatccctagtcccagctactcaggaggctgaggtgagaggataacttgagcccaggagtttgacgctatagtgatccaagattgcaccactacgcttcagcctgggtgacagagcaagaccctgtctcaaaaaaacaaaacagactgggccattgataaacaacagagatgagctgctcatagttgtagagggtgggaagtcccatatcacggtgctagcagattccgtgtctagtgagggcccatctctcatagatagcaccttttaggtatctgcacagggtggcaaggacaaacaagctccccctcttttatacgggcacagttcgtattcatgaggacagagccctcctgactgaatcaactcccgaaggccccacttttttttttttttttttttttggtgagacggagatttactcttgttgcccaggctggagtgcagtggtgcgatcttgactcaccgcatcctccgcctcccaggttcaagcgattctcctgcctcagcctcccaagtagctgggattacaggcatgtgtcagcatgccaggctaattttgtatttttagtagagacggggtttcactgtgttgcccaggctgatctcgaactcctgatctcaggtaatccgcctgtctctgcctcccaaagtgctgggattacaggcgtgagccactgcacccagccctttttaaatttttgatcaacaacttcttttttattttgagatggagtcttgctctgttgcccagcctagagtgcagtggcgtgatcttggctcgctgcaacttccacctcctaggttcaagcaattctgcctcagcctacctaatagctgggattacaggcgtgcaccactgcgcccagctaatttttgtatttttagtagagatggggtttcaccatattggccaggctagtctccaactc

SEQ ID NO: 22322 - DNA, 1241 bp, Homo sapiens
cgtggccggagcgcaaagccccgcccctccgcgccccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaaccagggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtg

SEQ ID NO: 22323 - DNA, 1027 bp, Homo sapiens
ggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacgg

SEQ ID NO: 22324 - DNA, 1050 bp, Homo sapiens
aagaaaagaataggggtttggggcttctgggaggatggtggtaacacaagttatgggagggtaaggggagaaattgtatgatggagaaagtctgtcttgttaagcaaataaaaaagtcttgcaggtaataaaagttgtctcagagcagccctcagaaggatacatgattgggaatggtttcactcttccctagttaataagatcgtaggaaagcattcctctttctgtctttaggcagataagagaaattcagagaaaacctctccttccctgcatttgctgttcccccaagtgcccttattttgaagcaatcagcagacaaaagcgcatatccctgtgttccaatgaaattttatttacgtacgctgaaatttgaatgttttattttcataagtcgtaaaatagtttttcccccacctaactatttaaaaatgcaaaaacagagcagtggttcacgcctgtaatcccagcactttgggaggcaggaggattgcttgggccctggagttcgagactagccggggcaacatagtaagaccttgcctgtgcaaataatttttcttgagacggagtcttgctgttgttgcccaggctggagtgcagtggcgcgatctcggctctttgcaacctctgcctcccgggttcaagcaattcttttgcctcagcctcccaagtagctgggactacaggggcccgccaccacaccctcgctgaccggctgcagcgcgcaggacagcacgcctgggagggcggtgccaggaggcgggcctcggattgggcctcacgtagtgggctggacagaggatggagcctcttggcgtaagcgcggttgggcggggcattcctggattggcccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcaggtaagtgccggcgggcggag

SEQ ID NO: 22325 - DNA, 1058 bp, Homo sapiens
ccccaatccagggcctggaggccaccaagcccacccagcagagtctggtgggtgtcctggagactgccatgaagctggccaaccaggatgaaggcccagaggatgaagaggatgaggtgcctaagaaggtttgagggttggggccgggcgcagtggctcacacctgtagtcccagcactttgggaatccaagatgggaggatcgcttgaggccaggagtttgagaccatcctgggccacacagtgagacccccgtctctacaaaaaaattttttaaaattagccaggcatggtgggactcacctgtagtccctgctacttgggagactgaggtgggaggatcacctgaactaaggagttcaaggctgcagtgagccatggtcatgccactgtacgccagtctgggtgacagagcaagacctcatctccaagacaattaaaaaaaaaaaaaagtgtttggtgagaattgcttgaaccgggaggcagaggttgcagtgagccaagatcgtgctactgcactccagcctggacgatacagtgatactctgtctcaaaaaagaaaaaaaaaaaaaaaaaggtgtttggggccaggggctttgagtgaggcaggggagtagcaaagtcctgggagcccactaaatgaccactgttgtcaccatcagaccctgatccttggggactggactcatcacaggcgctacgaaatctctaacatcctctctcttcctctacagcagaacagccctgtggcccccacagcccagcccaaagccccaccctcaagaactccccagtcgggatcagccccaacagccaaagcgccccccaaagccacatccaccagaggtaagttccccctccccgccccagctgcctgttgcctggctgtggcctgggcagcacccatagcagctcctatgcccacagcccagcagcagctggccttcctagagggccgcaagaagcagctcctgcaggccgcactgcgagccaagcagaaaaacgacgtggagggtgccaagatgcacctgcgccaagccaagggactggagcctatgc

SEQ ID NO: 22326 - DNA, 1096 bp, Homo sapiens
acaggaccattcctttttctctgagcatcatttttctcagagaagtggggatggccacccctgcctcaaagaaagacagccaggattcctcatgtgatagaatagtactcataataggaaacatttgaggagcttgaactgggcgcccagcaaaggccacccagtttaaggaagtgacatcacttttgcttgcctcccattggcccaaacagtcacatggctacatttagcctcagaggagcctgggacatgtagtctttgctggacactggagacatggccttgagcaaaaaaggcaaaaatccacactctctctggacatggtgggtcacacctgtaattccagctacttgggaggctgaggtgggaggattccttgaggccaggagctcgaaactagcctgggaaacacagtgagactcactgtcatggagtggatgttctaattgagagaccacaagaaacacacaaataaatacagcaccttatcacggcccatgaagactgcaccatctgccccatcagctcccttgcctggtctctttcttgtttttgttttgttttgttttgttttgagacggagtctcgccctgtcatccaggctggaatgcagtggcacgacctcagctcactgcaacctctacctcccaggctcaagcgattctcctgccttagcctcccgagtagctggaactacaggcacacgccaccatgcccggctaatttttatatttttagtagagatggggtttcactatgttggccaggctgggcttgaactcctgacctcaggcaatccacctgcctcgacctcccaaagtgctgggattacaggcatgagccactgtgcccggcctgccccttctctttcacccaccccctcgctcactcttccccttgctgtctggtagcctcaaacaccaggcactctgcaacctcagggcctttgcacatgcagttcccactgcctgaatgcttttcccacagacacctgtgtggttcactttctcccatcattaggtctctgctcagacatcacatctccaggaggcctaccctgagctgtctaaaatccctccctgtcacccagatccct

SEQ ID NO: 22327 - DNA, 1035 bp, Homo sapiens
tcaagactaccatcctggctaacatggtgaaaccttgtctctactaaaaatacaaaaaaataagctgggcgtggtggcgggagcctgtggtcccagctactcgagaggctgagacaggagaatggtgtgaacccgggaggcggagcttgcagtgagccaagtttgcaccactgcactccagcctgggcgacagagcaagactccgtctcaaaaaaaaaaaaaaaaaaaaagagaaatgaagatggcaggctgggcacggtggctcacgcctgtaatcccagcacttttggaggccaaggcgggaggatcacttgaggccgggagttcaagaccagcctggccaacatggtgaaaccccgtctctacaaaaatacaaaaaaatcagccgggcttggtggcgggtgcctgtaatcccagatactctggagactgaggcagaggaattgcttgaacccgggaggtggaggttgcagtgagccaggatcgtgccatcgcactccagcctgggcgacagagagagactctgtctcagaaaaaaaataaaataaataaataaataaaagaagaagaaatgaagatggcagtaaatgctcaggcacaccggacagcagtcatgtggtttactcccacacacactacactggggagtgggcgccatcatccctattctacagagggaaactgaggcagagaggcccactgtctgggatttgaactggggatgcctggctcctgtctgttttcttagccactccccacacaccccaggtcagaagagcagcagctggagctgagacccccaccaggctcatggcccttccctactcagttcctgaaactccaccctcaagccgagctcgggaggctgaggcggggaggatcgcttgaggccaggagttcaagatcagcctgggcaacagagcaagactctgtctgtaaaataattttttgaattatttttaggccggccacagtggctcatgcctgtaatcccagcactttgggaggccgaggtgggtggatcacgaggtcagg

SEQ ID NO: 22328 - DNA, 1095 bp, Homo sapiens
tctccataggacaggccaggccagggccctgagtcctgggtttgccttgctggccctcaggtgacccctgtgccttgggtagaagtgagtcactcaggggaggagaacccaggagcccagcctccctccctctgtgcattacagacctcagctgctggaggtggggctgagggaggccacctctcctctctgcctggacttccccagttgagctggccccgctcttggctgtgtcctccctctgcctgctggggatggggtggggccttctgagcgagggtggtatttggtgagcctgggcttaaattccagcgctgacacttcctcgctgtgtgtcctgggcccagtgccttcgcctctctgagcctcggttctgacctaggaaaaatgggactaagagggtgttcatgggagagagagagaccgagaccttgccagcacttggcaggcagggctgctgtgaagtcgttactggtaagcgtcctggtcagcagctcagggtgtgaatctgtgtccttattgattgatttactgatttatatttatttattttagaggagagagtcttgctctgtcacccaggctggagtacagtggtgcgatcctatgtcaccgcagcctcgatttccaatttccggggctcaagtgatcttcctgcctcagcctcccaagtagctgggacaaaaggcacagaccaacatgcctggctaatttccttttacttttgtagagacagggtctcgctctgttacccaggctggaatgcagtgacgagattcttgttcactgcagcctcaaacacctgatctacaggactacaggcatgcaccaccacacctggctaatttttttttctttatttttttaaattgagactggggtctcactctgtcacccaggctggagtgcagcggcatgatctctgcctcctagactcaagccgttctcccaccccagcctcctgagtagctgggactacaggtgcacaccaccacgcctggctaatttttgtatttttagtagagtcagggtttcgccatgttgcccaggctggtcttgaaatcttgagctcaaagtaacctgcccgcctaggcc

SEQ ID NO: 22329 - DNA, 1160 bp, Homo sapiens
cccaccctacaaaaaaatgcaaaaaacaaaaccaaactaaaaaaagcattgttttggtagactcatccattttgttgtgacaagctatagttaattcatatttattcctgtttagtaatccattatgttagactgagccatatcgaattgcctctttctgaaagcaaaaaaatagttaaatatcagcaatttcgtacttcagctactaagatggtatagcagttttaaaatattaattctcctgttaatggactgtgggatgcctctattttggactgttacatacactttatataaatgcatctcctgatgtatacccacatgcatttggctagggtaaatcctcaggagtgcctgggcgcggtggctcacgcctgtaatcccagcactttgagaagccaagaccagtgatcacttgaggtcaggagttcaagaccatcctggccaacgtggcaaaaccccatctctactaaaaacacaaaaattagctgggcatggtggtgtgcgcctgtagtctgagctactttggaagctgaggcacgagaattgtttgaacccagaaggtggaagttgcagtgagccgagattgtgccactgcactccatcctgggtgacagagagagactctggctcaaaaaataaatgaataaataaatccttaggagtatgtggctgggacttccatgtagaataaaattgaatttggatccctgcctcacatcacaccatgtaaaaaaatcaactggattaaaggcttcaatgtcaaatgcaaaactttacagtgggagaaaagttatggaggggaggattcattttaaaaagatagcagacagctaggcctggtggctcatgcctgtaatcccagatacttgggaggctgaggcaggagaatatcacttgaggccaggagtttgagaccagcctgggcaacataacaagactcatctctactgaaaaaaaaaaaaaaaaagaaaaagataatagacatgcccctttctgccaggattttctttctttttcttttttttttttctttttttttttttttgagatggagcttcactcttgttgcccaggctggagtgcagtggcgtgatctcggctcactgcaacctctgcctcctgggttcaagggattctcctgcctcagcctcccgagt

SEQ ID NO: 22330 - DNA, 1012 bp, Homo sapiens
tggagaaaccttgtctctactaaaaatacaaaagtgagccgagtgttgtggcacacgcctgtaatctcagctacttggaggcagaggttgcagtgagctgagatcatgccactgtactccagcctggatgacagagcgagagtctgtctcaaaaaaaaaaaaaaaaaaaaaaagggaagcttcaaactcactgttcaaagtgaccttgaaggaaaaaataaattgttattttgctgtgttgtttgttattctctgccaacctttgccaagtacccatagaggcgatagctacagggcttctgggtgggagaagcagttgtttcccggcccagcggattgcatagcaagcagattagtttaactgcatgtgtgtattgtaggtcagtaaaaatagaaaggatgctttcactcacacttaacaagcaatttgagaaaaggtttgtctacatcaaagaatatatttctggccgggcgaggtggctcatgcctgtaatcccagcactttgggaggctgagacgggtgaatcacttgaagtcaggagttcgagaccagcctggtcaacatggtgaaacctcgtctctactaaaaacaaaaaaattagctgggtatggtggcacgtgcttgtagtcccagctactggcttcgaggctgaggaatgagaatcacttgaagctgggaggcggagttgccatgagctgagatcacgccactgtactccagcctgggtgacagagcgagactctgttttaaaaaaaataaataaaggatatatttcagctgggcacagtggctcatgcctgtaatcccagcactttgggacaccaaggtgggcaaatcatgtgaggtcaggagtttgagaccagcctggccaacatgatgaaactccgtctctacaaaaaataaaaaattagctgggtgtggtggcgcacgcctgaaatcccaggtacttgggaggctgaggcaggagaatcacttcaacctgggaggtggaggttgcagtgagctgagatc

SEQ ID NO: 22331 - DNA, 1078 bp, Homo sapiens
tctcctgcctcagcctcccgagtagctgggattactggtgcccaccaccacaccccactaatttttgtatttttagtacagacagggtttcattgtgttggccaggctggtcttgaactcctgaccacaagtgatccacctgcctgggcctcccaaagtgctgggattacaggcatgagccaccgtgcctggccataatttttgtatttttagtagaggcaaggtttcaccatgttggccaggatggcctcgaactcttgatcttaagtgatctgccggcctcggcctcccaagtagctgggactgcaggtgtgtatcactatgtctggctgcttttttttgtttgtttgtttgtttgagttggagttttgctcttgcccaggctggagtgcagtagagtgatctcgattcactgcaacttccgctttccggtttcaagccattcttttgcctcaggctccggagtaactgggactacaggccacacgctgctaattttggtatttttagtagagacagggtttcaccatgtgggccaggctgatctcgaactcctgagctcaagtgatctgcccaacttggcctcccgaagtgctgggattacaggtgtgagccactgttcccggccagtgcctggctaatttttaaaggatttttcttggtagagacgcagtctcaccgtgttgcccaggctggtcttgaactccttggttcaagtgatctcctgcctcagcctcccaaagctctgggattctaggtgtatgccaccgtgcctggctggcaactggcttcttctggcctcttggccacaagccctgggtccatcctgcccgtggctgtcctgttccccatcatctcaaccctcctggcacagcggcccttctgagatggaagctgccgagacaacactgggcactcaccgcacaggttgtgggcaggtcctgctggtccaggccttttcccgtcataggaccctgcctctgttttccagtccatcacttattcattagttcatttgttccaacatgttttttccctcttatcaatgctaagaatcgtgggatgaacgaaccacatt

SEQ ID NO: 22332 - DNA, 1062 bp, Homo sapiens
gggatcccatcctgcacccctctcccaggggcctgcagagatgccccagtgtggcccaggcttctggggcgtgactggggcaggcgcctccacgtggcactccgcaggaacgcccttgctaggctctgggaaggacaagatcctgcttctgcccgcgctcttctggcttgtgtcctgaaaccgcacaagcctgagggtttgcccccaggtgggaggagctgtggagtcctggggtccttgcaccctgggaaccctgagaagctggcacagtggctgggcagcggaccggctgagccctgccaggctgtgggctgtaactgccctgttctccccgcagatccgcagtggtaccccgcccgccagtccctccgcctggaccccagtgagtacagctgtccactcggcccgccccctgggctcctgggtggcagtgggagaaggcccgggtagcccctgagccctggcccgcctctctgcagagggcaagtccctgaaggatgaggatgttctgcagaagctgcccgtgggcaccacggccacactgtacttccgggacctgggggcccagatcagctgggtgacggtgagtcctgaccctacccacggcctcttttcccgtcagccacgttgggtgactcatcttgcccccctctactctcaggtcttcctaacagagtacgcggggccccttttcatctacctgctcttctacttccgagtgcccttcatctatggccacaaatatgactttacgtccagtcggcatacagtggtgcagtaagtggggcaggtgggaggagggtaggggaaggcagaagacctgccggaccagccccagctgagcctgctccccccgaccagcctcgcctgcatctgtcactcattccactacatcaagcgcctgctggagacgctcttcgtgcaccgcttctcccatggcactatgcctttgcgcaacatcttcaaggtgagagcccgtccccgcctcacccctaagccccgcctttctgccccaccccgccccgcccccaccgagccccaccccaaggcccttcctgtctg

SEQ ID NO: 22333 - DNA, 1067 bp, Homo sapiens
caaggccaataagaacaattccagcaaccacaccagctacaattggaatgatgtctggaccagtgggacactctggattctccacaacatgaaccatgacctcgttgttcccattcactgaatacgtaaaatagaaccaacagtcgtcaacatccttctccttacaatgggacacaggatcaggttggaccggctggggtaatttgtcccgactttctaccttggtaatgttaaaataggaacattcctgtgtgcatgtgtctttcttttctcctttattgaaggctctgcactgaacacattctttatgctcagcacagacaccaaggcaggtctgacacatctcacacgtttgcccttgaaacttcggatctgtacacttacagacaccacactcgcagatgccccggccattgcagatctgtccgttgctggcttcacaagtactagtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttttgctaaaaagtccttgatttagcactattta

SEQ ID NO: 22334 - DNA, 1028 bp, Homo sapiens
aaacgcaagatccaggccctgcagcagcaggcggacgaggcggaagaccgcgcgcagggcctgcagcgggagctggacggcgagcgcgagcggcgcgagaaagtgagcgccccggcctcgggccccgcacccgcagcctcctcccccgcgcgccctcctttcttcccggcttcccgcgctgcccgcccgcgcgcagtcctcgggccgcctttttacgccctcggacgccgatcgccgacccacatccctgcgcccgcagccaggaccccctacttcctccgccgtcctccttcctgggcctgggacaggggagggggcgccgcctccgggtcgggcggggccggccaagcgggaaatggggggatggggcggagggggtgagcgatctccgggtggagaagtggagcggcgggagggggcgtatcgtgcaggctccgactccggggctggcgccggggtcccgggccgaggggaacccgcgaccggacttgtgggggagaatgaggatgaaaacgtggagcttccattgtctagggtttgaccggccgacagggatttcgacgggggaccggggatctggggagggggtcgcactttctcgcctctttcgcggcttcccggcttctgcttgcttccctgaccgttcccaggggcgcggcggcgacgtgtctgctccaggcggcgggggggatggggggtggaggaagttcagccccaagccgcccgcctttctccagctgattcctgcgggaaccggggcggcgggaccctgcctctctccagaaggccccgggaacgctggcgcggggccctgaacccacgatcgtttgagcgcctgctgtgcgcctccgccgcgagtcgcagggcccgagataaacaatgggtctgaaaaaggagggagtttcaccatcctctctgcatcatcctcctggctgtccctcgggacagatggtggcaccgccagggtctggggacagatttggattctggtcccatatcatgccacccacaggcttcatgacttggta

SEQ ID NO: 22335 - DNA, 1031 bp, Homo sapiens
ccctagagaggcaaaagatgcccagccagatggaattggtggtgtgaattgccaggactggaaagagcccagatgggggctgcagcatgggccttggttgaagcctctaatcctgtaagggctgctttggcccaagaggccttagaaacccggtgtaagcctcaatcggtagccggtctggcctctttctcacacttaaccgacacagctcttgctctgatctcatcccaagtcatctcgctggaggacaattaactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttccgtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttcaaaaatacatatatatgtatgcatgtacagatatgcgtgtatctcccaactccagacagctgaaaatctgccaaaagcgttgtttgccaggattcagaatttcccacataagggctactcacttcttaaaagacaactcatgaatcaagcacctctgtttgatctttaaaatcaattcctcgactgctaatgggtacacagttttttgtttgtttgtttgtctttggcgggttatgaaaatgtcctggaattcgataatggtgttggttgcagagtgtttttgcaacatcagttcctggcccagttactgaaggtggta

SEQ ID NO: 22336 - DNA, 1031 bp, Homo sapiens
ggaggtcaggaattcgagaccagcctggccactacggtgaaaccccatctcgactgaaaatacaaaaattagctgggcgtggtggcacgcgcctgtagtcccagctacttggaaggctgaggcaggagaatcgcttgaacccaggaggtggaggttgcagtgagccgagactgtgccactgcactccagcctgggcaacagagggagactccgtccccctgcaaaaaaaagaaacaccagaaaaacccatgttgcagctggtctaggggtctgggtggggcatcattgggggctgtctgcagtggatgggagaggacacggctggtggggatcgggctcagctgggcctttctgtctctgcaggtagctcgtaagctggtcatcctggagggtgagctggagagggcagaggagcgtgcggaggtgtctgaactgtgagtggcagaacaggactgagcgaggctggctcgattcctggggcggagtgggaaggagctggctgtgttgggaattggctctgaccggggtctctgctcaagtggacgggcgtcaggggctcatggctcatcttttctcttggcttctgtgacaaagaggtggtgacttgttcttactgccatgggaagcactgcccacgtgttgaccctttctgcaaagatatgaggaaataggagtgagacaggaggcagcagggaagcccagaagtcccattttcccagagaggatatctcagggggctgtgccatcttaacagaacactgacctgctccagaaggcaggctcccccggtcagtatgtaaatgcttttgctcctgtcagtgtttggccgtgacacattcctggcgggaaggtgagaagcttaaccagaatcccacaagcaagcaccgaaaaacaaaacacctgtcctcttggccccgggtgaggaattcagccccacagagcatccgggagtgctgagagagatctggtttcacaaatccactccgggcttccttcccggagtgtcccctgcaaactcccattgctctctg

SEQ ID NO: 22337 - DNA, 1033 bp, Homo sapiens
acatggtgaaaccccatctctactaaaaatacaaaaattagccgggtggtggtggcacgcgtctgtaatcccagctactcgggaggctgaggcaggagaattgcttgagcctggcaggtgaaggttgcagtgagccaagatcgcgccactgcactccagcctgggtgacagaatgagaccctgtctcaagaagaagaaaaaaaaacaaatctttttttttctttcatttaacaaagacgcttattaatttatctttccccatactcttaatcctcaccagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattga

SEQ ID NO: 22338 - DNA, 1074 bp, Homo sapiens
gatcttgtctcaccgcaacctctgccccccgggttcaagtgattctcctgcctcagcctcccaagtagctggtattacaggcatgcaccaccacgcccaactaattttgtatttttagtagagacggggtttctccatgttggtcaggctggtctccaactcccgacctcaggtgacccacccacctcggcctcccaaagtgctgggattataggcgtgagccaccacgcccggccctactgttcacctcttaatctgactttgggagtcgggtaggtttaacttgcagttcatcctgcagacattggtagtaagtcaagctctggctgccttgtaagttccaagccatggaagtttctccacttccagcacgttggtgccatgtcaccctttgttcccaagtccaaagtgacactgcatcagcaagcagaagtttcactttcctcctgccttcctgcttctgctcttagcaatcgtggtgaggttagtgactcaaaactcttctaaggactgtagttgaaaaaaaaatgactggtttttttttttgtttctttgtttttttgagacagagttttgctcttgttgcccaggctggagtgcagtggcacgattttggctcactgcaacctccgcctcctgggttcaggcaattcttctgcctcggcctcccaagtagctgggattacaggtgcctgccaccacgctcggctaattttgtatttttagtagagacggggtttcgccatgttggccaggttggcttcgaacccctgaattcaggtgatccacccgcctcggcctcccaaagtgctggaattacaggcgtgagccaccgcacctggcaaaaatgactgtttttaaccactcatgtctcctgctgctggtgtcagaaagtcagcttagctccaagcaaggtgtttctgcacaatccagacgtatagagccctccgggtcccagcagggccgtgggaggaaccctgggcttggagacaaaagacctgagtcttgccctggctctgtcaccaatcagttaggtcacctttaatttttttttttttttttttgacaaagtct

SEQ ID NO: 22339 - DNA, 1056 bp, Homo sapiens
gccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaagtctgagtgtcttctttttttttttcccagacagagtttcactctcttgcccaggctggagtgcagtggcataatcttggctcactgcaacctccacttcccaggttcaagtgattctcctgcctcagcctcccaagtagctgggactacaggcaaccgcgactacgcctggctaatttttgtatttttagttagaaacgggatttttccatattggccaggctgatctcgaactcctgacctcaagtgatctgccgcctcagcctcccaaagtgctgagtgtcctcttatagg

SEQ ID NO: 22340 - DNA, 1060 bp, Homo sapiens
ggaagttggggagggcgctcaggcttgggactcctctggggacaaggctcaggaccttggggagggagtgttcgctgggaaaccttgagagattccgtgtcttagaatgctggagagagggtgcatgcttaggacccgtcggggagcgtggctgacaacagtggggagtggaccttgcgctcctccgaccccctgggggtgaggatccggattgtggggggagttggggatgtagggcaaggatccctcaggggcgcaacactaccgcggggagcgcgtcaaggccctggttagggataggttgcgctcgccggggtagccatacgtgccctgtcctgggaggggaactgacgcttactctcgccccctccctgcaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcac

SEQ ID NO: 22341 - DNA, 1028 bp, Homo sapiens
acctgtttcatgagggactgttcctggtggggagtgatggcctgaggtgagagtgagtgggtgtgcttgaggaacagccaaggagaacggcagggtcaggagctgaaggagagaagggggagagggagccaggagcgtgagaaccactggatggttctgggaggcggttctgctgctgtgctgagaatgaggggtcaggaggcccctgggagaccagggaggggccccaagtgatggaggcggggtagacagtgatggaaacagagtggatggtgacaaggaccagagagggtcccaagtgatgggaacagagaggatggtgacaaggaccagagacaattcccaagtgatgaggacagaatggatggtaacaaggagtagggaaggcctcccgagtgatggggacagaggtggacagcaatggcgacagagtggatggtgacaaggaccagagacagtccccaagtgatggggactgagtagacagtgatgaggacagagtggatggtaacaaggactggagagggatcccccgagtgatggggacggagtggacagtgataaggaccagagaagtgccctgagtgatggggacagagtgactggtgacaaggaccagagggggttcccatgtgatgggggcagagtggatgatgatgtagatcaggagcgggggtgtcagtgagagtgagaagtctgggctgatctcaggatgcctgattctctgggtaaaagtgtgggcccctgctgaggtgcataaggccagggcagttggggggctgctatgtgtctgtgcggtgcctgccatttgaggctctgttaatcagtacccaggcggggctgtgtgtggatgctcagatggacgtgtcggccacgcaggatggttgtcatggtgtgggaggcagttcgaactctgcctgatgaggccacccagggcacggggagagaggaggtgccggaagaaaaagaaaactgggcttgtgctgggtggtttagagcagcacagtcggcaaatggtagcttggaga

SEQ ID NO: 22342 - DNA, 1045 bp, Homo sapiens
gtgcagcataattctggtttagaaacaacagctcctcctctgggggagtggtcctgtcccaccacaacatgggagggaggcaagcttctttctatttttgctcatatcggctgaaaagtacacgcatagagggcattcttggtgggtgttcagggcctgtcttttctcccaagcgaccgatgcaccttattgcgattggcctgggtcttagcaccaaaaatgtcatgtcccttgaagtccccaacaacctggacagtgggtcgcctctaacctccagggtccccatcttatatatcctaccttggcatcactgctggcagcagttgcctttccacgtgaaagcaatcttgctgaaacagattgcaggaggcgtgggagacttctctattatatgcagcccagcacttggcaccacagaggcttaaacatccactttgtacatttctcctgaatgtgaagttttccaaatgcaaggtgctcgttgaacttgttgtgttccttgagtagattggtaaggatcgggtggaggtgagctgggaagactcacctgtgcaccccgccctgcttgcctccaggctctcagaagtaacctttccctgtctctaatacagcttggctccgtgctgagttttttctgttcctgtgcagacagtggctgggcctggtgtttttcacaatctgtttccagtgtcgggcctggcagtaactcattgtcgccttgtcaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccaggtaagaactcagattacaattccttgtgggttttggatttcatccagtttggggccctgcagatattcagattttcttgtcggaattcataaaatcctgtaaaattctaattagttgtg

SEQ ID NO: 22343 - DNA, 1055 bp, Homo sapiens
tcagggcccgcccggcatcggcacagtttctttttttgtttttatttttttgagactgggtctcactgttgcccaggctggagtgcagcggcatcatcacagctcactgcagcctctacttctctgggctcaagcaatcctcccacctcagcctcctgagtgactgggactacaggcgctcactccgacgcccagctaagggctaagaggagacggggtttcaccatgttgcccaggtgggtcttggaactcctggcctcaagtgatccacccacctcagccccccaaagtactgggattacaggcgtgggccaccatacccagctggatggcatctgcattttaaacaaggcccctggtgactccagcctcaggttgtctagttttttcaaatgtaagtttgaactgttgtgtaaattatcctggttttagaatgttggttcagatatttcagggatactgttagagccaaaccaggcagctccagggtccatctggccgtgtgttactgtttctccatctttgtggggctttccttcagactttctctctgccaccttctccctcggggttcttatccgtaaaatggccacaaaactggtggtgccaatgagcctgggttcagtgaggttaactgagcaaccagttcaggcacaagcctgcctcaggtcacccctgggtaactgtcacccattacacagccacgtatgcatgtcctgtgtgtgctgggatgaacagttagtcctgccctaacataagtgggaccctaaaaacgagctccctctgcagagttgcaaagtgtgatgggaactgcaggttcatgggaaacagactcagggtatgacattcaaaaacttcctcagggacacctagaaaaagataggcaccgactctaaacagcagcgccgttacgcgcatattaagtggccgagaattacatgaatgccacagcaaatcgggtactgaccttggaagagacctgaggctggtttgtggatctggtggcagcctgtgaattatgtgaaggccgggaggaggtcatctgaaatcagaca

SEQ ID NO: 22344 - DNA, 1035 bp, Homo sapiens
acttgcttcccttcccacaggctgcagcgggtgcagaggggcaggaggcgccagcacagggattcctcctgctttgcagccgtgcagtgggactctggaagccacgccatattatccgggaggctccggtgctattgcctcttgttctgtgacactcttgggtgtaaaattgatacggacgtatttctaacagccacggcggttttgctggcccgttcctgccttccaacctgggttccctttggtcctcttgttgctttaaggtctggatcaggccattttccttgggtctcagtgactccgggccagtaggtgcctcggcctggaagtcccttcccttcatggcccagcgctccccagttctacactccccatttcccttgggaaggcctggggttcgcccctgaccttgtacttccccggcccacccctgattacagccagcctgtcacctccctgccccctctgttcgtggacactgctgggtccccaccatactcctggacgggacctgcccatggccggggctcaggccatgctgggcagcaagatccacaagtgtgcagacaggaccctgcgggcaggtgctctttcctgagagtcatcctgtccccttcacggagggctgcctgagtgtcccggcccagggcacagcactccttgactaacgacttattttccctttcctgaaaactggcagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctggtgagtgccgagagcccctgcccagcctcgggggcctcagcgaggacggagggccccagccagcttgacccatgtccgggccaagcctatgtaccctccaggccacactagggtcccccagaagctacgcaggttgcagatacccaggggttcctcactgtaggctccacctgcacagcaagctcgtaaac

SEQ ID NO: 22345 - DNA, 1051 bp, Homo sapiens
tgaaaccccttctctactaaaaataaaaaaattagccagacatggtgacctgtgcctgtagtcccagctacttgggaggctgagacaggagaattgattgaacccaggaagcagaggttgcaatgagcaaagattgtaccactgcactctagcctgggcaacagagcaagctgtctcaaaaaaacgaaaacaaaaaaaaatgaccagcctgggcaacatagtgagacctcgtcagaaactagccagaagtggtggcgtgtacctgtacctactttggaggttgaggtggctggatcgcttgagttttcgaggcagaggttgcagtgagccctgatctcaccactgcactcagcctgggtaacagagtgagaacctgtctcaaaaaaaaataaggaagctgaggctcaggtcgaacccctctaacttactctaggacaagcactcataggtgagcttagcgtgctgttaggcggcagccagggtgctccagccccaaagccagccctttgcatgttctctgccttctgggcacagtggctgctgggcttcggtgtgtatttttttttttaactcagcatttcttggaagtgtttcagcatcagatgtgaacccatgtcctcatttttaagcaactgcaccgcttttccttcccttaccagggtctctaacaatggacatttgtctctagtcctccctgtaagtggtgttgacagcaaatgctcctgagtctgcgaccctcatgggtcaagctgagcccatcagaaggcctttccctggtggtctcaggcatgcacgtgttggggtgatcttttcagtgggttttctttcttgggctgctgaaggtctgtaaacgccctgaagaacagcccagagcaggatggtgttactctagtctcagccaaaacggggactcctggggtctgtttgtgacgtgggtggtgggcacacggctgggctttttctgtggatgtggaatgcacattcaccttgagttgcctccactgggcttagaatccagcactctctgagcctgggtcccacctgggaaaag

SEQ ID NO: 22346 - DNA, 1063 bp, Homo sapiens
tggtctagtttggttggttttggtttggtctgatctgatctggtctggttttggtctggtctgatttgatttggtctggtttggtttggtttggttaggttttggtttggtctggtttggtctggtctggtctggttttggtctggtttggtttggttttggtttggtctggtctggtttagtttggtctgatctggtctggtctggtttggttttggtttggtctggtctggttttggtctggtttgggtctggtctggtctggtctgtttggtctggtctggtctggtctggtctgtctggtctggtttggtctggtctggtctggtctgtttggtctggtctggtctggttttggtctggtttgggtctggtctggtctggttttggtctggtttgggtctggtctggtttgggtctggtctggtttggtctggtctggtctgtttggtctggtctggtttggtctggtctggtctgtttggtctggtctggtttggtctggtctggtctgtttggtctggtctggttttggtctggtttgggtctggtctggtctggttttggtctggtttgggtctggtctggtttggtctggtctggtctgtttggtctggtctggtctgtttggtctggtctgtttggtctggtctggtctggtctggtctggtttggttttggtttggtctggtctggttttggtctggtttgggtctggtctggtctggtctgtttggtctggtctggtctggtctgtttggtctggtctggtctggtctggtctggtcggttcggtctggtctggtctggtttggtctggtctggtcggtttggtctggtctggtctgtttggtctggtctgtttggtctggtctggtctggtctggtctggtctgtttggtctggtctggtctgtttggtttggtctggtctggtctggtctgtttggtctggtctggtctggtctggtctggtctgtttggtctggtctgcccacagcctgtcaggattctggtctcttcatccctgtgtcatgcactctccatcctgatgtgtttctggc

SEQ ID NO: 22347 - DNA, 1076 bp, Homo sapiens
cagacacttggtagattcctggggacagaggtgaatccttatgacccagaggacggacacgctaatgcccgcccccgacaactttgcacttcctcttcagaaagaatggagttcaagctgggccgcggtggctcaggcctgtaatccctttgggaggccaaggtgggtggatcacaaggtcaggagttcaagaccagcctgaccaatatggagaaaccctgtctccactaaaaatacaaaaattagcccggcgtggtgatgtgcgcctgtagtcccagctactctggaggctgagacaggagaattgcttgaacccaggaggcggagtttgcagccagccaagattgcgccattgcactccagtctgggtgacagagcaagatgccctcaaaaataataataattaaaaaaaagaatggaattcagatcaggtcatcagtacggtgacagaggggccacaagatattatggggggagaattagggacaaccaatgcaagctttaggacaagggggattccagcaagtttcctcggaagtagtggctggccccaggtcaaacctggaaagataccacgtgttaaaccactccgggtggaagggattgcacaagcagatacctttgaagcccggcctgtacagggcatcccagctctctcattctgccaaccggcagtgcgagggtccttgttcttatcttcctgatacagaaacaggcccaggcaggtgatgacttcagagatggttccttgagctttctagaaacatgcaggatccttagtaacctttaactggggaaacccaaatctccagggccgtttctcacccgcatcaccattgacagttggggctgtgcactgtagaatgtggaatagtgtccctggctgtcacccatgagatgccagtagtattccatcccctccaaggggtaacaactgaaaatgactccagccatggccacgtgtcccctgggggcagaatcacctcccccgccaggtgaaatgtgatgctcattagtaaaacctggttcccctctagggcccatcattgccttggtgggtccttggtgtttgtgga

SEQ ID NO: 22348 - DNA, 1009 bp, Homo sapiens
gaggcagcagggaggccgaggaggggagcctgggcggtcctcctatgcctgagtgcgctcccatccttactctggaactgccacgtaaagaaaagcagagatgccccgtggttcatacctgtaatcccagcacttcaggaggccgaggcaggaggatcatttgagctcaggagttttttgtttgtttgtttgttttgttttgtttttgttttttgacacagagtctcgttctgtcacccaggctggagtgcagtggcgcaatctcagctcactgcaggctccgcctcccgggttcatgccattcttctgcctcagcctcccaagtatctgggactacaggcaccaccaccatggccggctaattttttaattttagtagagatggggtttcaccatgttagtcaggatggtctcgatctcctaacctcatgatccacctgcctcggcctcccaaagtgcagggattacagctataagccattgcgcccggccaagctcgggagtttgaggtcatcctggacaacgtggcaaaaccccgttgctacgaaaaatacaaaaattagccaggcgtgctggcgcatgcctgtagtcccagctactcaggaggctgaggtgggaggattgcaggcccatgatatgtcaaaggcaggatgtgtaaaccaagatggaggtgatgaggagcagcttgtgcccaactgtcaggagcagcaagggtctttgtatcatatgatccctctgggctcagggcagtgcctgctgtggcttccccagacccaaggaggatgccacacagtataccattcagcgttggagtgagcgcccaagacaggctgggcagccaccgctactgccccttttcagagcagattggattcaaaggagattatttagccataaaaaggaatgaagggccattcaggctcacatctgtaatcccagtgctttgggaagccaaggcgggaagattgcttgaggccaggagtttgaaaccaccctgggcaacatagtg

SEQ ID NO: 22349 - DNA, 1040 bp, Homo sapiens
agagctggattccgtccagacacctactcttgcccactaagggcacttctgggagactatacagtttattcatttagcaaacacctctctgcatgaaccccaagctggcacttgtagggatacagccccaggcccctggcccttgaggagcccttgaacttgggggagagtcaagggaaagcagtcgggccagaagaatggacagcggttgagagaagacgactccttttttttttgagaaaggatctcactccgttgcccaggctgcagtgcattggcgctatcattgctcactacagcctggatctcctgggttcagggaatcctcccacctcaccttcaagtacttgagactataggtggttgctaccatgtccccaggctggtctcaaactcctggccccaagggatcctccctcctcagcctcccaaaatgctggaattacaggcatgagccacacctcactcagcccttggagaggaaaggatttttaaagggcggataggggaacaccaggcagagaggagagtgtggctgaaatgtaagatggtgtgtgtagagggttttgcatgcctgatggaagggctgagcaggttttacctggggaaatggggagccaaggatagtgtgtgagtaggggaggggttcagatctgagtatcagaaaatttttcttccttttttttttttttttttttggttctaacaacagaggagaattcttctagggcccaaaatgggggcaagattgccaaagacaagcttgcaatccctgagtttacagattgagaaagcccagagtggcgcagggaccaccccaaggacacgcagcgagcttgaactcaggcctcctcggcttcctgccaagaggcggagacttggctgcagccaggacaagctgccagccagctgtgtgccatctgcccagctcccgctgggggcgggaagaccaaccagccgcttcctgcagctgccaccagctgcgcccggccaccgcggggcaccctctgccggtcaataggagagagaactacagctca

SEQ ID NO: 22350 - DNA, 1018 bp, Homo sapiens
gtactgagttccagccccaaaaagacctcccagggcagtgtcaggggaggagcctggggaggggaggcgtctgcgactttctctatctttcctccttagtcatcgtgacagaaaagacaaacatcctcctgcgctacctgcatcagcaatgggacaaaaaggtgaggcccacagggctctggtgcagggattgtgggtggacagagactgggcacctggcaggggcttctgagcacaggaaggactctagtgattggagcagggccttgagggctgggtaggagtgccctgggcgatccaggagagggaagagcgttccagtggagggaaccgctgtgcagaggccacaggacaccagtgctcaggaggctggaggccaggcccaagtagccgccaggcccagttttccatggctctggcattaggtagactgtattggtatgaactagatagaatattttctgaggccgagtgtggtgacgcatgcctgtagtcccagcgctttgggaggctgaggcgggcggatcacgaggtcaggagatcgagaccatcgtggccaacatggggaaatcccgtctctactaaaaatacaaaaattagctgggcgtggtggcacgtgactgtaatcccagctacttgggaggctgaggcaggagaatcgcttgaaccagggaggcggaggttgcagtgagccgagattgcaccactgcactccagccttgttgacagagcaagactgtctcaagaaaataaaaaaaggccgggtgaggtggctcacgcctgtaatcccagcactttgggaggccaaggtgggcagatcatgaggtcaggagatcgagaccatcctggctaacatagtaaaaccctgtctctactaaaaaatacaaaaaaaaattagccaggtatgctggtgggcgcctgtagtcccagcttcttgggaggctgaggcaggagaatggtgtgaacctgggaggcggagcttgcagtgagcctagatagggccactgcattccagcct

SEQ ID NO: 22351 - DNA, 1031 bp, Homo sapiens
ggactcaccctccctgggcgccccgccggagcaccgtgcccagacacacgccgaatccggttcctaactccgctgctttggacgcgcctcgacgcgaggcccccagcgctcagccacaaaatacagcctggcacgcgcagcgctcctcgcccacctcacgggcaggcccagcgcgtctccaccccaccgcgggctctgtcggtgcactgggccgcgtgcgcccccagccgcctgcacctgcttgctggccgcccccgaccccagattccctccgcgcatgcgccctcagctcggcgcgccaggcccccagcacagccacgctgcccaccccggcgaggacccacgggctcgccacctgcccgtactttggcccgggccgcgagcaggaggccccggagggagaggaggagcaggcggaaccgcagggccgcgagcgggaccagcaccgcctgcagctgccgctcgaggctctgggacagggacaggacgagcaggagctgtgaagggaccgacggacagatggacggacagatggggggacgacaggcagagagaggacgcacagacgacggacaacggacggacagacaggagagaaggatggaggaggggagggaggggctggagagcccttggaccccttgtgccgggtctggcccctcgctggccgccatgggggcaggggggactgccgctggggcgggggtctcacctctttcaagcgctccatgtccttgaggtagaaaccgatgtagaagaggctcaggtacgagttgacaaactggaactgcaggaaggaggcaggcggtggtcatcctgcacccccacccgactccttggagccttccttgtgccccatacagacggcacagcttccccgttgtccccctgcctgtccgatggtggtgactcaccaggacaactttgatgatgaggtgcttctcataggcgctctccagccggtaattttctaggggccaagggggggagtgagggggcagccgcggtccccccaagggtggcagggatcc

SEQ ID NO: 22352 - DNA, 1052 bp, Homo sapiens
ccctttctggctttcggggagccagagactgaccggacacttggctctgcaggtgcagacctggaccagagagacagagagccaaggaagtccacagtggagagagggctgtgctgggggttccaggaagacttcctggaggaggggatcttggagctaggccttgaagacgagtttgtcaaatgaggaagggcatccgaagccgagggaacggcagaagggaacgctggggaggggagagaatctggagagttccggaaaaagcaagtaggactctttccagaagttcgggcaagattttccctggatcagggcgtgggttctccagtactcgtccctcccggtcaccgagatgctctgagtttccggtctgaacctgaacgtaaagaggtgtagtccctcctttcttgaacgggaaaactgaacgcacataggtccttgccacgcctaaggctgcggagtgagcagatggaaaatgcgggactcaaaacctcccctcgctgtaatttgcactgccctgtgccaaactctgtcctttcttccattccttattcctattgtcagcctcgctgcgctaggaccctaaaaatttggtctcatgttgcccggggaacaacatttcgctacacctacctccataccgcctcccgctcccgctctcccttgcaccagccaatggaagcgagtatcttcagacggtgggcaggacgtatcctaagatacccaatggtggtcgagaatagttgagcactttactagtcaagccgcggagtgggcggggccccctgcccagacttgaagccacacaggcaggtcgggcaggcgggtcgcaggttgtaaatccatgtggcgggggctttggaccctggcggcccaagcggcacgtgggcctcgcaggtggggctacaggggaaggggtgcgacagcttggggtgctgcttggaccccagacccactccctgggttttaggggcccaattccctgcggcagagcaatcattcgcgttcttccgtgcctcaatcgttcatgacccttgcggcagagcccatat

SEQ ID NO: 22353 - DNA, 1061 bp, Homo sapiens
tgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgagccccctcccactcccagcctcccctgacccacagtttaagtgtgggtccctcaacttcaatttctgaacctacaaaatgggtacaaccatttccccttcaagggatggttgtaaaaggtcgggagagaccatgtctcttgtctcttccaggtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttcccctacccttccctcctctgtctattgcccaggctggagtgcagtggtgcgaccttggctcactgcaacctccatctccgg

SEQ ID NO: 22354 - DNA, 1051 bp, Homo sapiens
gggtttcaccgtgttagccaggatagtcttgagaccctgaccttgcactaccatatcccatgtctggctaatttcttattttttatagagatggggtctccctatattgcccaggctggccttgaactcgtggactcaagcgatcctcccaccccagcctcccaaactgctgagattacaggtgtgagccaccacaccaggacaacctcttgtatcttaaaaatgactggcaaggccgggcgcagtggctcatgctgataatcccagcactttgggaggccataggtgggcggatcacgaggtcaggagatcgagaccagcctggctaacacggtgaaaccccatctctactaaaaatacaaaaaattagctgggcatggtggcatgcgcctatagtcccagctatcgggaggctgagtcaggagaattgcttgaacccgggaagcagaggttgcagtgagccgagaccgtgccactgcactccagcctgggcgacagagggagagtccgactccgtctcaaaacaaataaacaaacaaacaaaaatctgactggcaaaacctaggggtctttctccctctataagctgaatctttattcattcattcattcactcactccgtgaatattcatcaaactcctgcatccagcattgtacacatcattttattgaatcttcaccacagcacgatgttgtggctattttcttccagttttgcagatgagaaaactgaggctcacaggaatagttacttcctggagtttccccagctttggggtttgaacacaggtctgtttgactccaaatctgagtttgctgagggcctcctgtgcagcaggcaggatgttggggtcacagaggggagcaacaggcttggtccctgttcacattaaagaagtgacaagaggccaggcgtggtggctcacgcctgtaatcccaacaattttggaagccaaggtgggcagatcacttgaggcctggagtttgagaccagcctggccaacgtggtgaaaccccatctctacaaaaaatacaaacattagccaagca

SEQ ID NO: 22355 - DNA, 1050 bp, Homo sapiens
ttgcagagacaatggccgggattccgggagaacttggaggaagtaagataacagagaaggaagggactatggcatctttgaggatcgaataaggtaggtgaagggtccgtcgggattgcagccctcaattgtggagaagcagagagactctctgggggaggggttcccagagctgggtactgcagaatgaataagagtttggggaatcgggccaggtgtgatggctcatgcctgtaatcccagcactttaggagcccaaggtgggtagatcccttgaggtcaggagtttgaggccagcctggccaacatgatgaaacccctgtctccactaaaaatacaaaaattagccaggtgtggtggtgtagtactgtaatcccagctactcgggaggctgaggcaggagaatcacttgaacctggaaggcagaagttgcagtgagccaagatcgtgccactctactccagcctgggcgacagagcaaaactctgtctcaaaaaaaaaaaaaaaaaagagccgggggtggtggctcatgcctgtaatcccagcactttgggaggccaaggcaggcagatcacctggggtcgagagttcgagactagcctgaccaacatggagaaaccccgtctttactaaaaatacaaaattagccgggcatggtggcgcaagcctgtagtcccagctacttgggaggctgaggcaggagaatcgcttgaacccgggaggcggaggttgcggtgagccgagactgcgccatcgcactccagcctgggaaacaagagcgaaactccgtctcaaaaaaaaaaaaaaaaaaaaaaaaaagagagagagagagagaatctgggggatgaagcagggggaaacattctgacaatgcatggcctgtgtgtgtgtacagatcccagtttaaatcccagcccagcattttctgcaggcgggaagggaagcaagacaaggttactctcagttacagcctcagtttcctcactggatccccaggaatcaggagaggctctagggaggagatgagaatacaacacctgggaaacggtg

SEQ ID NO: 22356 - DNA, 1050 bp, Homo sapiens
acgaggcctccagcctctatggcatctcaggtgagcacagagtggggaaactgaggcgtggaagtggagggtgtgactgtcttgagattacacaaccaggaaggatcttcctacttccctctcccaactctggattctgtaaagactgaaggagccaggctgtgcgggttgggcctctgtgggtggggtgggcagttccctacacctcacctcctcccctcgcacgtgtttttcagccatggatggggttcccttcacactccacccacgatttgagggcaagagctgcagccccctggtgagtcggggtctcagggagcctgggtctgcgcctgccatcaccattctgggtgccaggacatccctgtatccagtgccccagcacagagggccacatcctgggttggggctggagtgtgtcacctccaggtggcagctggaaggtcttcagtcttagaatggggagggatccatccagagaaagcagctggacaccagtagctagaggctgtgacaagaagggggagggatgctgggcatggtggctcacgactgtgatcccagcactttgggagaccaaggcaggtggatcacttgaggccaggagatcgagaccagcctggccaacatggtgaaacctcgtctctattgaaaatacaaaaattagccaggcgcggctttagagactttgtctctaaaaacaaaacaaaacaaacaagaaaaataagggggagggatgtccgagggaatattcggggagtgttggggggagggcaggaccccttgaagacgaaggaaagggggtttcaggttgagatcgggcccaaggctgacccacctctgcccgccaggccttctctgcttttggggacctgaccatcaagtctctggcggacattgaggaggaggtgggtgcagggctagggaggaggtgggtgcagggctagggaggaggtgcctgaggggccggcacccgcccctcgtccgccccaggctgtcccagttttccccatccccgctttgccccagacacacaccatctctccaggg

SEQ ID NO: 22357 - DNA, 1027 bp, Homo sapiens
ctggccaacgtggaggaaccctgtctctactaagaatacaaaaataacggcatggtggcaggcgcctctaatcccagctactcgggaggctgaggtgggaggatcacatgaacccaggaggcagaggttacagtggggctgagactgcgccactgcactcctgcctgagtgacagagtgggagggactctgtctcagaacaaacaaacaaacaaaaaacatctggaaggtggaggggcactgagcaggccctggaagatggagtgtgggccccttgcaggaagggactgatactggttcacagccacaggcctgggtatacagtaggcagggaactgaaaaggagtgagatcaagaagggcccaactcagcacgaggctcccttctagggtgacccagggtgagcagagcagcaggcgggcaggcagggcttgggtgttgcctgcagccgcccccggctcctgatggtctcttgagtcacctcccggctgctgctggagaggaaggaagtgtctgtagtctcattgtcccagttggtccttgtggcttcctgacacttcatggggcagaaagtggagctggaaatcctgtctgctgtgtgtgaacttcgtggccacttcccttctttatgccttgatttccccacctgaatggggcaatatccctgtgtggcaaaaagcgtgctaaggctgggtggggtggctctcgcctgtaatcccaacactttgggaggtcaaagtgggaggattttttgaggtcaggagttcaaaaccagctggggcaacatggtgaaaccctgtccctactgaaaatgcaaaaatgagctggacctggtggtgcacacctgtagtcccagctactcaggagcccgaggagggaggatcgcttttacccaggaggcagaggctgcagtgagctaagattgtgccactgcacttcagcctgggcaacagagcgagaccctgtctcaaaaaaataaacttaggcctgacatggtggctcacacctataatcccagcactttggaa

SEQ ID NO: 22358 - DNA, 1033 bp, Homo sapiens
cctagcgctttgggagggtgaggtgggtggctcacctgaggtcaggagttcgagaccagcctgaccaacctggttagcggggcgtggtggcacacgcctgtaatcccagctactctggagcctgaggcaggagaatcacttgaacccgggaggcagaggttgcagttacccgagatcgcgtcactgcactccagcctgggcgacaaaagcaaaactccgtctcaaaaaaaaaaaaaaaaaattattcgggcgtggtggtgggtgcctgtaatcccagctactcgagaggataaggcaggagaatcgcttgaacctgggaggtgaaggttgcagtgagctgagatggcctgggcaacaaagtgagactgtctcaaaataaataaataaggccgggcgcagcggctcaacgcctgtaatcttagcactttgggaacacctgaggtcaggagtttgagaccagcctggccaacatggtgaaaccccgtctctactaaaaatacaaaaactagctggacgtggtggcgggcgcttgtaatgccagctactcaggggactgaggcaggagaatcacttgaactcgggagatggaggttgcagtgagccgagatcgcaccattgcactccaggctgggggacaaaagcgagacttcatctcaaaataaataaataaataaataaataaataaataaataaataaataaagtgtcgtcctgtccaccagcacatcttcctgttgtatttccttttaatccatagccctagcagactcttacttgtttatatgtttatatgtcaatatgtttatattgattcccccaactgtgagcccatgagagctgcaccctctccatcttggttgtttctgggtgcccgctgcccaggacaggacccagtacctgtacccacacaccaggttcttgggaaatgttggttgtgccccagcttggcagcactgctgggtgacctcgggaatgttccttaacctctctgggcttctcctcttccccagtctcagaaataagaaagttggcc

SEQ ID NO: 22359 - DNA, 1080 bp, Homo sapiens
tcccagctattcgagagggtgaggcaggagaatcgcttgaacctgggaggcggagcttgcagtaagccactgttgtgccattgcattccagcctgggcagcaagaggaaactccgtctcaaaaaaaaaaaaaaaaaaaaaaaaaaagcaaataagttagagcatattcgatacttctaagtgctacgaagaaactaaagcagatgacgcgaagacaggaggaggtgacttcccttgaggtggggttgggaacctccctgagggggtgacttggagctaagccccaaagaggagctaggaggtgactgtgaagagagctggggaaatggaactccagactgggaacaggctgcacacagtggctcacacctgcaatcccagcactggccaaagcagccagatcacttgaggtcaggagtttgggatcaggctggccagcatggtaaaaccccgtctctgctaaaaatacaaaaattagccgggcatggtggcaggtgcctgtaatcccagctactctggaggctgaggcaggagaatcgcttgaacgcaggaagcggaggttgcagcaagctgagatcgtgccactgcactgcagcctggccgacagagcaagactccgtctcaaaaaaaaaaaagactgggaacagcatgtgcaaaggccccagggtgggatgaggcttgggaaaaatagaagcagccctcttggcctcaccctctctagctgtgcagagagattgcagtcagaggagcaggtgtccaagaacctctttgggccgcccctggagtcagcctttgaccacgaagattttacaggtgatggggataagggattggagggcatgggtgtggccggagggaggttgggtggggccattgcagagttaggccaatgaggtcccctggaagccaggctggagggaggactagtccgtgtaggggtgggcggggccagagtgcgcgtgggaggggccatagatagggtggggccttggccagtgggcggtgactgagtggatgggccggacatttgtggagagggaagtcaccagaaggtgtagccttgggggcgtgcacaaggact

SEQ ID NO: 22360 - DNA, 1410 bp, Homo sapiens
ccgcgtggagagagcgatgcgtgacctgggccagctcagggatcgcgggggcccaaggactccgggtcttcttcccgggggaaggaataagtcgcgcagcatagaggccctagccccggcacctcgtcgagccgccaagtttctgttttcctttctgcaacgtggacgtggcggtagagcaatagtgtgttttctttctgccggaatggctgtgagaagcagatgaaaattgctaacagtgagccgaaacggggagcgtgaggcttaacgctgtggtacatactggatagaatcaaacggctctatggcgcagagataggagaacctggactcccatggagtgggtgtattatgtccagatctccagcttcggtttccttgctgtcaaaggggcgggccccattgttcccttcctgaacgtgtgccgaggccggtgggtcaggttcacagtaaaagtaggaactgcgataatttgtgactatttttcattgataactagtgaaaagctggcgagtcagtttcagaggtggtttctttgtgccatatcacagagcctggacttgaccaaagattctcacctctgcatctgtaaaccgggagtcttccctgggccaaacgtttggattgcagttgggaaaacggaggcagccgcagctcgcgtggcaacagtgcagggatcccagggctggggagagacctgaggtcttgtcctagttctgcctggaatgggctgtgagatcccatgctggtcactgggcctcagggtgaaagaagatgttggctggatgttttgaggtgcagagtggctgtttgacggcgactgcaaagcaattcaggactgcagcatgaagaaaggaggctgtgggtctaagccacagctttcctggtctgaaacccttagcccaggcaaaggagaggcaggcaactcaattaatcctccctggagacctccctctcctcagttcattttgtgtataaagttgtggtcgggagtgtgacctacagtcaccaagaatccacatggaggccctagggtggccctgcctcctgcttcccgaatctgtggtcactagatgtaggaaagggagtgaggtggatctccacagttgcctctgggtgctggccttaccctcactcctgtttcctttcagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtatggagaggccggggctacgtggggtctggagtggatttgcgcctcttgggacatcgtgcatctcaagaattaatca

SEQ ID NO: 22361 - DNA, 1050 bp, Homo sapiens
cacatcagacatcagagccccgggttgtgtttctgcctgggtcacgggactggagcagagcttatgtgccatttccctgattagaaagccagggacccagggagcgggtgggtggcatggtgggacaccttggttggtgctgtcttccctgggccctgtctgttaagtgaggagaggtgatggctatctggtcagtgggtggtagctaggttggcccagacaggttccaggagacttgagttcaggaactgcatctggggctgggttggtgtccgtggcagaagcctggacttcaggctgttgccatgggaagttcccttacctcacgctccctgaggatgcctgaaggtaggtggggctgggaaactgaggcacaagagtctggccatagagtaggcctggagcctggggtgtgctttagaggcagagggttcagtgaggatggggctagggcacatcggcttgctgctctcacatctccctgtggcctctccttggcaggtgtttgagaagtcccccctgcgggtgaagaacttcgggatctggctgcgctatgactcccggagcggcacccacaacatgtaccgggaataccgggacctgaccaccgcaggcgctgtcacccagtgctgtaagctgcctgtcccgcctccagctttttagaccctccttgactccctcacactgaggcagggcaagtgccagaggttcccagtgcaggagagtctcaggactggtggcggggcacaggaagacaaaaggatgccccaggccccagatggcgcttttctgagagccctgccaggctcggttgtaaatcacatcacatctggaaactccctttttgggtctgcaccttgtttagactgggatccacatcaccactgttttctgggacccactgagaaccgaattgaacccctgcctagtgttgggagctggcaccttttccctggctcacctgccagggtctgtgagacccccacacctccctgattgcacctaaacccaagaatcactgtttcttatagcggtggtttaaacagaggt

SEQ ID NO: 22362 - DNA, 1060 bp, Homo sapiens
gagaggtggaggtggaggcgctggccatacttcagaggcagagccagagaagagctggagcctgtctgccttctgagattccagttcagggtgggccctaggacttgattgggggtaccatgttgtgtttggggtcaggaaatgctggctgctctgctgttattcctacaggggaggcatctgggccaaatccttctgtgctgaatcctgggcaggcttcccagtggaggatttcttccttagtgggggatgagtcagatctcattgcagagggaggaggaaggcactgggctgggaaaggcctggaggctgcagtgagcaggtggatcggagtgggtgtgagcaagcgtcccgtcagagactgcacatctgggaagggtggagtgggatttgaacctagttctggcttcctagaacttagccagcccggaagaatagaggaagggcagctgggagatgggcctgtgaggctttgtgggctgagcaaattgcttggactcatgagggcggcaggggatggaggtgcccccagaagctgcagtggtcagggccgggtgcggtggctcattcctgtaatcccagcactttgggaggccaaggtgggcggatcacctaaggtcaggagttcgagacaagcctggccaacatggtgaaaccccgtctctactaaaaatacaaaaattagctgggtgtggtgacgcatgcttataatcccagctactggggaggctgaagcactagaaccgcttgaacccaggaggcagaggctgcagagagtcaagatcacagcactgcactccaacctgggcaacagagcaagactggcaacaacaacaaaaaaagttgcagtggtcagatcatctgcagcacttacccagtgggctcgggtagaggttggagcagcccctggtgcaagaaatggccatcaagtccccactgtgtgcctggccttggacagccctgctgtccaaggtcatccataacagtggggggaactgaggcacaagggtagagggtagggttgaaggacttaccaggccactgctgtggctcttgccca

SEQ ID NO: 22363 - DNA, 1041 bp, Homo sapiens
aaaaaaactgatttactgagcatgtagtatacctggggcaggttcttgggaactctactcccagcagctccaagggaaggctgtcagtatacccattttacagatagagaagctgaggccctgagagggaccggccccaaggtcacccagtgattcagggaattccaaatcaggatttgggcccatctccgtgttgggggtgagaggagttggcctggctaacgctgccctatccctgtctccctaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggtgagcagcaagcaggggccctggaaaggggggtggtcccctcagaccc

SEQ ID NO: 22364 - DNA, 1006 bp, Homo sapiens
tctttttagggtaacatgtttgctccctcctcccccactcggactatagaagtatcaccaatccactgcagagaaattgggaaaattcagaaaaacaaaaaataaaaagaaatccacctcccattctccctgccctccgcgcccacgcggtagtccgtgctctgtggggggctccagggcagctggtccaggccctggcctgccgcctccttggaggggaggtttttcggttgctcagctccctgatcgcccaaaggcacgcttcctacatgggtggctctctcggaaatacctcctgccttttttccccaggaagagaaaagtgagccacgagaatgtgcggaagcttccgtcactgacttagtattttaaagtaaaaatagccgggtgcggaggcttacgcctgtaatcccaccactttgggagaccaaggcgggaggatcgcttgagcccaggaattggaaaccagcctgagtaacatagggaggccccatctctacaaaaaatttaaaaattagctggatgtggtgtcgcgtgcttgtggacccaaatactcccgaggctgaagtaggaggatcacttgagctcaggaggtcgaggctgtaggaaaccgtatcgcgccactacactccagcctggacgacagagtgagacgctgtctcaaaaaattaattacttaatttaaatttaaaaagaatgcaagcccttgattgtccagagcagcattgggctctggaattagaaatggttgagctgggggaggggctgcgggattggggtattttctttgtgtcaggggagacagagctggtgggagaacgggctaggcttccaggccggtcccactcagaggaaagtccagaggcttccctgcatccctaccctatcgtctacactagacaaataaaaataaaaatgtggccaggtgcggtggtttatgcctgtaataccagcactttgggaggccgagtcaggaggatcactccttgaccttgaggtcaggagt

SEQ ID NO: 22365 - DNA, 1086 bp, Homo sapiens
cctgggcgagggtgcccaactccaggggctgggctgatgaggcaggaatgccgggtataattattacatgcttgttaccactatcatggctgttagggcttaatgagccactattaagactggctgggaagggggtgtgagggaggagagatggacccaccccaccaatactcacaagggatccttaggacatctggatctgacctacagcctctgcatgcacccctccagctccccacctctgtctgaatggagcccacaccctcctttccctgacctccttcccctcactctctctgatccttggcctcccagttgcaggactaatcgtacctctgggcctttgcacgtgctatgctctctgcttggtactcccttcccccagtgcaaagatgtgtcttcaggaagtgccccaccctcagactttactcctttattgtagcctctgaatctgccagaatgatggagtggaccatagtccctgaaggtcagggacattgcctatgctgagcctgctgacagggcctcgcatagaatggatgctcagtattaaaggtgaatgcggggctgggtgtggtggctcatgcctgtaatcccagcactttgggaggccgaggcaggcagatcacttgaggtcagcagttcaagaccagactggccgaaatacaaaaatacaaaaaaaaaaaaaaatacgaaaattaaccgggtgtggtggtgtgcacctgtaatcccagctactcaggaggctgagacatgagaatcgcttgaacccgggaggcagaggttgcagtgagctgagattgtgccactgcactccagcctgggagacagagtgagactccagtctcaaaaaaaaataaaaaataaaggtgaatgcaacaaaaggttgcttgtgtgggtggtctctagcctcagtttgtctgcctggccagtgggcatgcgttactccttttctatcctccttactcacctggctctgcccccaactggggcatgaaggccataagggaggctgtcctcatcaccaagagaggtggcctgtcggccacacgcggtgactcctgcctgtaatcccagcactttgga

SEQ ID NO: 22366 - DNA, 1049 bp, Homo sapiens
taggaaactgaggcccagaggagggatgaagggagttctccgaggtcacacagccaagaaatgggagtggcattgcctcagaagtgccccaggccctggccagcggctacagatctgggtctggagggccaggtgtggatataaacgtagctggtttccaggacacagctgtttatgtggtgctggcgtctactttacctaggaattatccaactctaggatctccctcttttttttttttttttttttttgagacgaaatctcactctgttgcccaggctggagtgcagtggcgcgatcttggctcactgcaaccttgccttctgggttcaagcgattctcctgcctcagcctccagagtagctgggattacaggcacctgctaccacgcctggctacttttttctatttttagtagagatggggtttcaccatgatggccagactggtctcaaactcctgacttcaggtgatccacccacctcggcctcccaaagtgctgggattacaggtgtgagccactacccccggccaggatctccctcctttttaaaaatcttttccattgactcagacaaatcgtgactcaggttggtttctgaacagccaaagtgagaattctctggtatgttttaggcaggtaattcatggttcaggaaggaccaggcaggaatatgtggggtggggtggcaggggaacatatcttgaccttgtaggaaggggtacagtgagcctcgctgtcatctcctcgcagctgggggaggaaaagatggcatattaggggccgaggggggctgtcattcctggtgccctgaagaagatgccagtctgcaaaacctttctagtttcttttccagatggagtattttgtagggacaggctggggagcaatgcacagagagaaagacggaagtgttttctcgttatataaatcagatcggcagagaccagagccaaacccctgtttatcctagcctatgagctgcctgatttaaagtaacctctgttcccattccagaatcctagatttggagaaaaatctaagttga

SEQ ID NO: 22367 - DNA, 1279 bp, Homo sapiens
tcctgcctcttctgcctaggctgacttgggatgccccacccctccacaaagatgcctgtcccctctgcccagcctctgggtcattttggagaagaggctcttctggctagaaggtggtaggcaaatgactgcactgtcaggcctcccttgcctgtgtgcagttaggaagatgagctccatttccaagcacccttaagcccaaagactttttgaaactggcctctggctcctgctcaggtcggaagcaggaggtgtctgccatggtcacccctggacccctggtctgtctcctgtgtgtctccaggcagctgctggctctggaggcatccacccacccagtgggaatcgggatcgttcactgattcagcatatctgccctgggtgtccctgggtgtggcagtcgggaaggcaggctccggtcgggatggcagggtcggtggccctgaagaagcccccaccccagcagggaggcaggtatccagttagcaggagaaagcaaagtggatgatagatagcgaagggtgaggggatgtcaggtggagggcacagcaagtgcaaaggccctgatatgggaccaggaaaaggagctggggctgggcccaggtggaggaagaggcagcctgcaagagtgccagatgggccccagtgggttgtgtgtgcagaagtgcgctctggctcccaggtggagtggggcttataggggtcaggaacagaggctgggaggccctggggatgtggacacagttgtctgaaagagagctggggaggccgggcgtggtggctcacgcctataatcatcctagcactttgggaggccaaggtgggtggatcatttgaggtcaggagttcgagaccagcctggccaacatgatgaaaccctgtctctactaaaaatacaaaaattagccgggcatggtggcgggtgcctgtaatcccagctactctggaggctgaggtgaaaggatcgcttgaacctaggaggtagaggttgcagtgagctgagatcgtgccactgccctccagcctgggtgacagggcgagactccatctcaaaaagaacaaaaaagaaaaacagtgaaagagagctggtggcagcctggacccaagtaagaaggaagagatttcataggtttgagccgggggtggtagggtgagggggttagctgcattcctggcccccttcccatactgtcctcccactccccaacctgcccagcagaggtgctttggggacactggcctcgggactcaaggctctcggaagtccctcagctgccag

SEQ ID NO: 22368 - DNA, 2638 bp, Homo sapiens
aaaatgaggcgctgcatatccttccttctctctctggccccaatcctgagccccttctggctgcccttggagcctacaggccttcccggcttacactaggtctcggccagctggctccagaaagggaccgagcacctggtgggtgcctgccctcgggggctcgcagcagatggcagtgactgtggagtgcaggggcagcagagtgggctgagggaggctggggtctgagtgggccacttgcaagaagaggggcatgtgtatatccttcagcactcaagtgttgccaggcaggttgagaagaggtccatgaatcacagccatggttggtgttgcctggcagctcgtgggtttctcccgggcttgattttgagccggcacatggatgtcggtggcttgttcatcagcctggcaggtaagccagggatgggattcacgattggacgtggtcattttggcccctggctggaaatggctatgaggggcaggtgtggagggtagtaaggagaggccgccactttgccaagaagctgccagaggcctggcctttagggttggcagaggggagggaggacggcgagggttggagggtcaggagtgagacctggtgacggatggcaaggtgacacaaagccatgagtggcaggtgtctcctgccccagcagcatctgtgtctaggaaggcgctgagcagggagcatccattgcagccattctgggtaattatggtaactcgcgtcattacggtggtagctgtggtacatttcaggccaccaggcgctagcaccccatcctggctctgcttccctgcacagcctcatgctcgctccaggtccaggcgccccatgtcctccgagtcttgtgttccttctgcagggagagctgcctgctgctcttccgggtgcctccctgttttcctttctggccacctgcctgtgtgacacagggagccctcataggtgacaggccctgagaggttgtaccggcccagggcaggtggccggtggggggcagagggcatgggtgatttgcatccagagcccttccctataactgagctcagggccccaaccggtggcgcccccagacctggcccccggagcagtcctctgggaggggaggaccttgtaggtcccaaaactccctggccgaacagccaggcttcaaaacttttcacccaaaacaataacaacccacagttcttccctggagactgaatcctgtttaaaataaaaggaccaatgtggaagggaaatcagcaaaaccgaaaacttcctttggcctcccatcgctcccaggataaactcccaaatcctcagtatggacagaatagctgctgaccttcatcagtacttaccccatggttcgcctaatcctcccggcatcccaggagggggtccccgggccggtttgttcattcactggggtgactggggcccaggatgcccagctccattctaaggtcgttgcagtgagcagactccaagtccccgccccacgtcaagctacattccattgggggcccaagacagagactctcagatggaggagacggagcagggtgggggcttccatgtgacagtgaagccccgagaggtgacactggagtctctgggtggaagtgccccaggcagggaaacagtgcgcagaggccctggggtgacagggcagccagtgtgtgggtcggggcggggggcggcacaggagggtttgaacaaggaacatgggggtggggggagcagcacctggaggggactctgtcgtaatccaggtgggagacggtgggtggcctggcccaggtgtgcagtggaggtggggagaggggcccaagtcaggaaagagatttccttcggtgtttttttaaacgcagtgatgtttggggacagctgggtggatctcacacaggtgcacgcctgtgcgcacgccaccagaggctccttggacaggatgcatgtgtaaaggccaagctgacagtctctgagcagggagggggagaatggggaaggggtgggggctcagggtgtcgaggctgggcctctagatgtcaagtgaacagggaatcccaagtttggggaaggtcaggccatagcaccctctggacagcccctacttgaaggcatcatcaaaacaggacgggcggccacacagggagagcagaggagaagacagagctggtagccgggggcgggggctggaggcaggaggacagcaggagggggcggagagggcggggtgggctctagggggccacctcctgggttaggcacttatggggacagtcgaggaacaggagacaaggaaggcaggtagaacccttcgcagccccctccttcaggagtccccctgggccttttggacagccgtgccctgggtgtggggtacccagaatgcagcctcagcaggacctcccgctgcccccgccctcccggggccgctcaccagcgttcctgcaactctgtcttaccccactctggcctttcatgccccctgctctgacccctaagtggctggggtgggaactctcttccacacctggcaggtgggttggcactgggctccccaggctagtcggtctgcccctggaacctgctcaccctggccttgtgtgctccccttccactgatggacgcaggcctgtcagc

SEQ ID NO: 22369 - DNA, 1106 bp, Homo sapiens
catgaggcgcaacctaacccacccctacggccaatgcctggctaagacgtcactgttgttcccaggccacgcccacatcgcgctcagcactgcctctggcctgcctgctgtctcctttctgagagagcctctaaactgaatttcggactcttcctacacaaagcactgcccctcgtggttctacccgggcactgcctttctgggtgcctctgttttttcctgaacatccttggagggcagggggtgggttctgctcgtggagacatccttcgtgttgctcattcccccaccaggtggccctgctgcagttgatggagacgccagagctggcggggcaggaggacgctgtacggatgcagcagctgaaaatgaagtgagcgctgctgcccaagccgcctggctatgctcgatttgcaccagggttggcacggtcaggacgctgccagcagaggaaccctctgccagtgcacaatggtgttctcacctggtggccctcagatgtacacttccccagagggcacagccgtgaaacttcacatcagtttcgctgtgcattgctgggacactgctgtatacctcgacacatgccaatcctgcacacgtggctgtccgtggagcttggacatgccccactgagcacagaccttcagatgcctgtcctcagcccccaagcacacacactcatgtacacacacatttgacaaagtcacacttcataacctcctaatggtacacaccccaccaagatggccttttcttttcttttttttctgagatgcagtctcactctgtcaccaggctggagtgcagtggcgcgatctcagctcactgcaacctccgcctcccgggttcaagtgattcccctgcctcagcctcctgagtagctgggactacaggcgcgtgccaccacgcccagctaattttttgtattttagtagagatgggtttcaccatgttggccaggatggtctcgatctcctgacctcgtgatctgcccacctcagcctcccaaagtgctgggattacaggcgtaagccagcacgcctggtcctttattttcttttcttttttctttcttttttttgagatagagtcttgctctgtca

SEQ ID NO: 22370 - DNA, 1051 bp, Homo sapiens
cagagcccaggcggttggtggcctccacccagatctcatagggcgtaaagagagccaggtccttggggatgtggcaggagtggggccccactgtgtggtactcctcacatgtgttgtcctggccataccacctgcggggatgggagggcgacaggacgcatgagggttccttgtggcccccagacctcaccatggcagcctcagggtgcagacaacacatgggggctcagagagggtccgcgttggtcaaggtcacgcagccagcctgggacacacacatcgccctcaggccaccaccaacctaagcttgtacttgagggagtagttggtgtggaggaaggtctccccgtgggcccctggcgtccagcggcaggtcaagtccttcatgttcttggaccagcagctgatgttgacgggtttctctgggggcactgggagaaggggagggtgcaggaagcaggctgagggtctggactagctgagcctcggctgaggggttgctgcccacccaccaggcccccaccttggagtggaaggagggcagacaggacagtctcagccctgtgctgagaaatgccagcacagttggtgtgacaactgcaagggctcttgagaggctggtgactcgatctccgggttctttttcttttttcgaggcaaagtctcgctctgtcccccaggctggagtgcaatggtgccatctcagctcactgcaacttccgcctcctgggttcaagcaattctcctgtctcagcctcccaagtagctgggattacaggtgcctgtcagcacgcctggctaagtattgtatttttagtagagatggggtttcgccatgtaggccagcctggcctcgaactcctggcttcaagtgatccacccacctcagcctcccaaagtgctgggcttacagacatgagccaccttgcccgaccgggtctccaggttctcattcccacctgaaagacctgcatagccatgccagtgtgcccacagctcatccccaggccagaaggcccacaattcatgcctcactccagagggagatgcc

SEQ ID NO: 22371 - DNA, 1022 bp, Homo sapiens
cccaggtggggatcagggaggtggggtggctgatgagccgtagaccgaggctctcccagcgggacctggcaggcaccgccccttcatctgtagagtggggttccctctcttgcagggcggctggaggactagtggggtaaatccacattcttgcctggggccggccttgaaaagcccctgtcttgctcttcctgctgttcagctccatgtccatcctcccagctcaggcagagccttggcgagctgtctcagccctctgagcctcagtctccccatctgtgtgatggtcacgatcagaggcccacccacctgggaccggggagaggtcgaccagcacccgtgtgttggctgaggaaggcctcctttggccaagcctggtgtccccctgcctctgtttactgtataactttgggccagtggccgaacttctctgtgccttcatttccccatctgtaagatgggatggtagcagtgccccatcagagactgcctgccacaaggtgggccaggagccaagactgcacagactgggtgctccctcggtccgtgaagactgttctgatggagacgccccagcattgtcatctggacatggagagccaggatgggaggggtgctgtggaggcagagagcttgctgctggtcagggaggtggggtctgaacacccccttgtcttctgggcctttgtttggatggtggggcttcctcttgttggccttgagaagtggctggagtttggcaagtccgggatgggggcgctgtgcataatgtcttcctgtccattggccgcagtcagagccccacacatcctggactcctggtggcattggtcagaggctgggattagggcaggacatcacagcccggccttgagggcactgggcttatggtgacccctgaggagcaggtgaggggtggccacacgtatccatcatccacccacccatgcctccagcctccttcctcatctagaacacccccatgctcctgagatgacagcttgcaaaccactgcacctcta

SEQ ID NO: 22372 - DNA, 1059 bp, Homo sapiens
tggggccaaggagccttccgtctcctcccgctttcttggaaagatcagtgcccgcattcctggcctttgcttacaggcaggcgtgggtcccaggaatgggagagcaaattccagagggcagaggccaccaggacagagcagggtgcctcagcccggtgggggtgggggtcttagaggggactgatcctggaggtggcaccagggtccaccccctgttgtgttctgaggaagaagtggtgtgttaacggctcctaagctattaattcattgatccgttcaacagtttccccaaatgaaatagcaaaggggtggtggggctggagaagaggggatgagggggcagtaggggcagtgggggctggaccacagagggctcgtatactctggggtgcagggggctgtggcggggcttgcaggggacttgagaaggctcccgtgtgtcctttggtttttttattgaagtgaaattcacgtgacataaaactgtctgaaagtggacaattcagtggcatttagtagattcacagtggtatgcaaacaccacctctgtctagttccagaacattctcatccctccaaaaggagaccccaccccatcagcagtcactcccccctcccctcccccagcccttggtggcacccatctgcttcctgtctctgcggatttgcctgttctgggcatttcacgtcagtggagtcatacacagtgcggccttttgtgtctggcttcttgcactgagtgttgtgttcaaggtaatagtgtgtgtgtgaacctctgggccatgtccccacctctgctttccccgcagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcaggtaagtgctggccccaggcagctggaaggggcggctgcctgttgggacagggacagggcagatggca

SEQ ID NO: 22373 - DNA, 1044 bp, Homo sapiens
aaacgtccgtaacacacggacctccaggagcagtgagaggtggcttagaagcccctggtttggggtgggtggaggaggagggcacgtgtctgcctcccctggggtgccctccttcccccatcccaagctgctgaggggaggccctggtcatgcctcagttcctgccttcatctgctttccggaggaaaaaccatatcaactcctagaaacgctccttaggggcttgggaccttccatttggcactgagcatcttgtggggccttaactggctgagacatcccggccctctacatttgccctgttggccaggcagtccccttcccgcaattggagggcgacgctaacttcagaatcccatagtggcgcttgccgcaggtctggtggggtgtcttttttctcctccctcctttccacccctccgcgccctgccactccctggcctgccctgtttttgggtcaacattgctacggagccagcagtgaggcctttcccttcaagggctctgtggtatctctggccacatttgttctaatgtctgaacctctaaatcttttctttttgattggttttactgtttttaagaagccagcactgctgtctcatagatgggatttgtactcttggggcaacttaaagtgtctctctcgctgctaacagacgattgatgtcttgtctctgtgacccactcaccatgtaaagaattaacctcctatcttagcagacatcgtctcctaatatttccctttatttaataaaaatgttatggtgaagagatggagccggcccagcactgagcttgtgcggcttgggtctgattggtcacagattcctcgtgtgtcctccgcgtgtctgggggctcctctcccccgcctcaaccttttccagcctttcagaggagtcggcagtgggctgggctttggctcaggggcgcagaggcagcaggaagcgtggccaggactttcaccctggcgttttttgttgttggtttttttgtttttttgagacggagcctcgctctgtcacccaggctggagtgcagtgg

SEQ ID NO: 22374 - DNA, 1027 bp, Homo sapiens
gccaggtgatgttcctcccagtggaacaggggatgctgaccacagcccctgccctctcaggaccagggtggagggccaggtctgcctcaggtggctgggcgcatttggtgtgcaggggcaggccaggttctgccaggctcctgtctggcagagcagataccctgcaaatctcacctgggaagttgctgtgggccaggagcaggggcttggggctggtgtctgagcacggcaaggcacccgagttcctcaggcctcagtttcttgtcaggcattctagcaagaccttcctcttggggcagggtggtgagcacactctgcaaaggtgatgctgaatctccactttgttcttgcagtgtggtgagacctctctcctgcatcctggggccttggggagggtttgggtgggctttgcagatgctcgtatccctggtttccagattcagccactgatgtgactggctcaggtagacttaacctcagtctctgattccttaggtagcactttcagtctgtgttactttgtaactagttgtttgtttctctgagagattgtgaccttatagactaggatttgtgtcttcatttctgtgttggtaatgattgggagctcactgtcacccaggtactgctttaggcatgctcggtgagtgtgccacatctgtcctcccagctccaagcagctacattcttgctcaggatgtagagaaagagatggctggtgaatgaatgaatgaaaaaaaaataagaaaatggccaggtgtggtggctcatgcctgtaatcccagcactttggaaggctgaggcagtggatcacctgaggttaggagttcgagaccagcctggccaacgtggtgaaaccctgtctgtactaaaaatataaaaattagccggacgtggtggtagctacctgtaatcccagctactggggaggttgaggtgggagaatcacttgaacctgggaggtggaggttgcagtgagccgagatcatgttactgtactccagcctgggtgacaagagtgaaactc

SEQ ID NO: 22375 - DNA, 1040 bp, Homo sapiens
ggctgcgaccagggtgggcaagcttattcccagtttgactggccactgcacagtccaagtggcatgtccgccgtgcctggagcaggtgaatgaacctatatgatgtgggcttccctcctgcagccatggcgcgctgcctcccatactgtagacagcaggggtttggccacacctgcagccaggtgaggcatgatcgggtcggcacctgctcctctcctttgaattccaaaggacagcatgtcactcatgcgtgtctgttcacagttgccggtggtgatggcacctgaggtgtcttgctgccgtggaaggccagtcagcagatgtttggctagaagacagggacctcaccagggcacaagcactgaagggttgggggacagggcgtaaagtcgggagactgtttgcaggtcttggggcggaggggtgggtgtgtgggcgttccctcccactcttaggcttgggtcagcgtgacaggcaggctgtctatggcgctctgctgtgtgacactgggtgggtttctcaacccctctgggccgtagaatcctgagttgtaaagttggggcagcgcgttcattccatcaaatgacaattttcattgtctggcatgtctcaagagcctggggtgctggggctcctgcagtgtacagggcatacggggctgtgttcttggggagccagcatagttttaggggggacaggagagcatcaatgcatccgaatgaagcagacgccctcagaaggtggcacacgctgggagagaagtggctcagccacgtgctaggagtggctgggacaggggtgacacagcatccccagagagcagggaagagcacttcagattggggacaggcacagtcagagccttgtggtgggaatgacttggcgagtttgagaatgggtggaaagcagggaggagggcaggtgaggctgcaagagcttggatctcccctgagggaggggtctgggaagcctccctgcttgttttgtttgtttgtttgtttgtttgtttttttgaggaggagccccccctgtcgcccagg

SEQ ID NO: 22376 - DNA, 1032 bp, Homo sapiens
cagtgcttcatttctttctttcttttctttttctttcttttttttttttttgagacagagtcttgctctgtctctcaggctggagtgcagtgagccaagattacgccactgcactccagcctgggcgacagagtgagactccatctcaaaaaaaaaaattgatggccatatatatatatatatatatatgtaatataacacttaccattttgacgttttttaagtataaaattcagtggcattaagtttattcccagtgtggtgcaccgtcaccggcatggctcagtaatagttcatgtcatattccatggtgtgggtctaccccgttttgtccattcatctggccatgaacacgggttgtttccacctttggctgtcgtgaatcatgctgctgttggcatctttgtccacgtttttgggtggatgtatatcttcatttctcagagcatgtgctggggagtagagttgccgggtcctctggtaactctccatttatccatttgaggacgtcgtgtgtctcaggaggatagctgtggctgtgagtgggatgggtgtggtgtgagcatccgctgcaggtgtccagatcagggggaatgatagctggagcaagggggtgacagagcgggtggatttggtggcatttctgcagcagagccacccagacgtgctggaggattggatgttgggggtgaggggaagggaaggggggagtgtcgtctgcttgccaggggttcaggacattggggattcctcgtatgactgatcattgatgacctcagacagcaacacctgggccagaaaaagtacccaggcaagacagtcatggtggcacggtcagggctgaaggagggcactctcctgctgttacctactgtgaagctggagtaaaacgggcccctgggctgcaggcacagcgcagtggtggctcaggttagctgagtgtggagcccgccccccagtcctggctttggcgctatttgtttctgtgccggctgcttcagctgtctgctgccatccgcagcctccatatac

SEQ ID NO: 22377 - DNA, 1034 bp, Homo sapiens
gggagaagaaaaagacagcagggcctgggcagccccgtcacggggctggctttgaatcttacttatctattgttgaggtgaacaccacataacataagattcaccatctgaaagtgaacagttccatggcgtttggcgcattcacagtattgtgcaggcatcacagctatctagttccagaacattctcatcatccaaaggagaccttgtccccattagcagtccctcccctcctctcctccccagcccctggcagttactaatctgcttcctgtctctgtggatttgcctgttctgagcatttcagatcgatggaatctcacaccctgtggccttctgtacctggcttctctcactcagcatcacatgttcagtttcatccacattgtagcatgggtcagtgcttccttccttttttgttgttcctcttgagacagggtctcactctgtcacccaggctggagtgcagtggtacgatcacagctcactgcagcctccacctcttgggctctgtccaacctcccacctctgcctctcgaatagctgaaattattggtgtgcaccaccatgcatgcctggctaattttttttttttttttttagaaacagggtttcaccatattggccaggctgctctcaaactcctggcctcaagggatcttccctcctccgcctcccaaagtgctgggattacaagtgtgagccaccgtgcccagccttcattccttttcatggctgaatcttattccactgtatggacagaccagtcttattcattcatcccttggcacacacgtgggttttcccaccttttggctgttgtccattgtgctggtacacacactcatgtatgattgtcttcatttcgtgggggcatccgtccaggagtgggattgcttggtcataacagcagctcagcatgtcacttgttgaggaaccgccatacagattgggggtttattttaaataggatggaagcctactggtgtgtttaaaacgggagcataacacgatttgaactgaatgaataaaga

SEQ ID NO: 22378 - DNA, 1048 bp, Homo sapiens
ccaggccaatctcaaactcctgccctcaggtgatccgcctgcctcagcctcccaaagtgctgggattacaggcgtgagccactgtgcctggccgacggtattcaggacggtcaccctgtacaggtttgtagcctgggaacaagggccctaccgtctggccgaggtgtgcagaggctctgccatccaggtttgtgtaagttgccctgtgatcctcatgcacagccatgaaatcgccggacaacgcgttttttcagaagtcacccccattgttaagtgatgcttgactgtacttagaatcaacattgaaaaaccaggggaatgcccgtagaacaccagatttctggctgctcttgaagaatcagacagcccagtggccatggccgatgtcttgcacctcgagacgggccacagtgctctggtttgcctcaggccccacccgcccctgtcgtcccacatccataccctcacacgctcctgacgtttgcccctactttgtaccgagcccgacctctgcttctgacctgggcactgagcatctctcggcctgctggacgcacgaagtggcggacactcaggagaagatgagggagtggcccagggtcgtgactctgagtgtgctctgagcaggcttcccccacatcctcccgtccaggcctctgttgatgcctccctggacgccagggcctgcaaagggcgcttgctgcctggggagcagtcaacagcaccaggcttcctcccacagtgcgcagccaagcagagctgccagggcatccgaggggaagtgcaggcgtgaccgagctcgccccggtgagcagctgccctgggcacggacaaggctgtcatctcccctcggcgcttgtcgggtgtgttcccatgggcccacgcacccgccgtctcatctgccggaacaaggttaatctggtgcccagatctcctggggtgagtcaggcggcttcacccccgccttgactgcaggccagatgctcttcagagactgctcctgacctcaccagggcctcactttgaaccggagagggcggctgttatc

SEQ ID NO: 22379 - DNA, 1035 bp, Homo sapiens
ccctaatggaagcaaaaaacatttgactcattctaaccccatattccttaaaatagaaggtggggtgtgaggagaacaggtgtgcacgtatgggtgtttttttcagttttgtttacattttgcgaagggagggagggagagaggagagttctcctgaagaagggagtctgagctgcggaggccccacctccttgtagttttcatgccctgtagacctttctgcttccgcagctgtgaaatgggggtggcagttagatttttattccttttaaacataaaggaaacctagatccatgtgtgagtcgactgtatacgctgtctgtaatctgacgtccagcctgtcggggagactcggtaaagatctctgtggagcagtgagccatgagcgtgacagcgcggatcggggggttggctgggtgtgaaaggtaatcattttcttgtgaatccttttaactgtagcgagcataaaacagcaaacctggggcagcctttagttctgcttttgtttctggcattccgtttgggattaattgtggggcatgtccttctctttcagttgaaacaattgattttttttcctgcacctgaacacactgggctgtacaaaaggagagcattaaaacgctcccctggaggtaaacattgcagttgagctcactagaattctgacgacatcagagggtttgtcctgtgctacttgtaattgacccagatgccccacccacctgttacctgtaatttggatttgtttgtggggaatgggagtggtacccctttgcatcacaaggggaagaacggaatttgggggcaaggaagtctatgaatatcattcaagggaaagcggaagaaagttatctcttgtgtgaattgaaggcagtgtctgctaagatatttgggaagactttccctgtttgtcctcaggagttggccgtgtaaccagctgttaagttgggggctcctggaaactctcattctgcttttttaatttttattttactggggaagtggctatcagctgtcaagtgccctgcagtc

SEQ ID NO: 22380 - DNA, 1525 bp, Homo sapiens
gagtctcgctctgttgcccaggctggggtgcagtggcgtgatcttggctcactgcaacctgtgcctcccaggttcaagcgattctcctgcctcagcctccccagtagctgggattacaggtgcacaccaccatgccccggctaatttttgtatttttagtagagacggggtttcaccatgttggccagatggtcttgatttcctgaccatgtggtccacttgcctcggcctcccaaagtgctgggattacaagcatgagccaccgcacctggccagcatttcattcctttttaaggctgagtaatattccatgggtggaatggtccagatggatggaccatgttttgtttatctcgtcatctgttgatggacatttgggttgtttccacctcttggcttttgtgaatagcactgctgtggccatgagtgtacaggtttctgcgtggatgtgtttatagacctgctgggccgcgtagtaaccttgggtttaatggtttcagtaactgcaagactgttttccagtgtgtagccactttccataccaaccctacctgaactggttttgcgcagttggttttcccttaatgtgtgttgaaagacagtgtgtccccaccgggatgggaaagtggcagcaggggtgactccctgcactcagagctggttcagataacactccttttcttgtttatgaaatgaaactgatatttatcaaagcccttgagatcctgggatgaaaagcgctgacacagtattgccaagtgtccttaagatacagggacagttttcgagcatctgaccttttcctgggcccttctctgctgccacttctcctgctcccaggacagtgaaggtaatttcagaagtcctttgcataatagctggtgttacaagccttttggtctgcctggttggaatatttcctcttgactgtagcttctgccctggatcctccaaacgggaactagagtgaaactcttaagagttggaaatactgctcagtattaagaaggaacaaactattgatacctgcaacaacatggatgtgtctcataataattacttttttgtatgtgtcattcatcatatgatttaattcataaaaaaattctagaaattgccagctagcctgcagcaatagaaagcagaccagtggtggctggacagaaaggtgggaaaggggaggcaggtgacaaagggcacaggaaacttgggggtaatggacgtttttattatcgtgattgtagtgatagttttatgggtgtttaagtacattgatgtatgtcagtttctaaaatggcacactaaacatttgcagcttatggtatgtcagttatgcctcaatgaaactggaaagaaaagtcagggagataccactatccacccatttttttttttttttttttttggagacggagtctcgctctgttgcctaggctggagtgcagtggcacaatcttggctcactgcaacctccacctcctgggttcaagcgattctcctgccctagcctctcgagtagctggga

SEQ ID NO: 22381 - DNA, 1065 bp, Homo sapiens
gtctctcaggaacctggaagggcatgattctccttggacacagaagtttggtaatcgtggtttttggagggtcttgtgcccccatcaataatgcctggtgtcgtacgagggaagctgagacccggagtctggagttggtcatttgaggcctatgaggaggagaaacaggggttctggattccaggccccgctgttcagtttcagtattaggggaactaaaagcagctcctgctttttctccatccactggtgacttctaccatccatcagtccatcctcttccgtcagagtgagtccctcccctgacccaacttgatttgtgtcatcttggtgcctcaaagaatgcgggagagtggctgtcattctgccctttagtaaactttctttttttttttttttttgagacggagtcttgctctgtcacccaggctggagtgcagtggtgccatcttggctcactgcaagttccgcctcccgggttcaggccattctcctgcctcagcctcctgagtagctgagactacaggcgcccgccaccacgcctgcctaattttttgtattttttagtagagatggggtttcaccgtgttagccagggtggtctccatctcctgacctcatgatctgcccacctcggcctcccacagtgctgggattacaggcttgagccaccgcgcccggcccctttaataaactttctagggccaggctcagtggcttatgtctgtaatcccagtattttgggaggcggaggcagacagattactagaccccaggagtttgagaccagcctgggcaacacagtgagatcccgtctctacaaaaaatacaaaaactagctgggcgtactgacgcgggcctgtagtcccatctactccagaggctgaggtgggaggatcagctaagccccgggaggtcgtggctgcagtgagcagtgatcacgccacttcactccagccttggtgacagtgaaaccctgtctcagaaaaaaaagataataaggaaaaaataataaaatttcaggctgtggagtcgtttttttctcacagcagcgctgtgatcctg

SEQ ID NO: 22382 - DNA, 1039 bp, Homo sapiens
ttaatctgaggtaaatccaagcccaccctcagctagtaacaacttgccttgaggaatagatcaaatctttgtttcacagactgaaaagttggaaggagactttattttattttattttatttatttgtttattttgagacggagtttcgctcttgttgccggggctgtagcgcaatggcaggatctcagcccactgcaacctccgtctcccgggttcaagtgattctcctgcctcagcctcccgagtagctgggactacaggtgtgcgccaccacacccagctaatttttgtatttttagtagagacgggttcacagtattggccaggctggtcttgaactcctgaccttgtgatccactcccctcggcctcccaaagtgctgagattacaggcatgagccactgcgcccagccccagataattttttttcttttttttttgagacagattctcgctttgtcaccaggctggagtgcagtggcgcggtcttggctcactgcaacttccgtctcgtgggttcaagcaattctcttgcctcagcctcccgagtagctgggattacaggcttgcaccacatcatctggctaatttttgtatttttagtagagacagagtttcaccatttggtcaggctggtttcgaactcctgacctcaagtgatccgcccatcttgtcctcccaaagtgctaggattataggtgtgagtcaccacatctggccagttttatttatttatttatttatttattttgagacagggtctcgctccatcaccccggctggggtgcactggcgtgatctcagctcactgcagccttgacctcctgggctcaagcagtcctcccatctcagcctcctgagtagttgggaccacaggtacgcaccaccacacccagctaatttttgtgttttttgtaaagacaagggcttgaactcctgagctcaagccatccacctgcctcagcctcccaaagtgctggaactacaggcttgagccattgtgcccagcgtggaaggcaactttagtcctcacttgat

SEQ ID NO: 22383 - DNA, 1080 bp, Homo sapiens
ctgtcacccagcctggagtgtagtggcacaatcttggctcactgcaacctctgcctcctgggttcaagccattcttctgcctcagcctccccagtagctaggattacaagtgtgcaccactgcgctcagctgatttttgtatttttagtagagacagggtttcaccatgttggccaggctggtcttgaactcctgaccttatgaactgcctgcctcggactgccaaagtgttgggattacaggcgtgagccaccgtgcctggccagtttattcttttaaattggcttataaggggccaggtgcggtggcttacgcctgtaaccctagcactttgggaggctgaggcaggggatcacttgagatcaggagtttgagaccagcctggccaaaatggcaaaaccctgtctactaaaaatccaaaaattagctgggcgtggtggcacatgcctgtaatcccagctactcgggaggctgaggcacaagaatggcttgaacctgagtgagaggcagagtttgcagtgagctgaggtcgggccactgcactccagcctgagtgacagagtgagattccgtgtaaaaaaaaaaaaattataagggacaagtgaacacttaagagctttacttgtgtggccataagatatggtgtatgtgtgttttctagtgcaatttacattacattaaaaattagaaagtgttaaatcttctggcccatgtaacttcctatgcgaacaaataattcaggaacaaacactttcatgcctaagataaaacattttcatgcttggtgatgggggtctggcagtgagcaggactgacacagctggccttccagaagcttacatcttagttgcagacaaataaacaagcaaatgaatgaaagaacattgtgaggtttcttgagaatatccctaagtgctgcagctaccctcattgggagcttcaggtggggtttcttggaggtgtagaagtgaaacctcactacctctttaatttcctcactgggctcctgtttcctgtctctaaaaggagacagaaattatggcattttcctacttgattgttggcgatagttgattcatg

SEQ ID NO: 22384 - DNA, 1024 bp, Homo sapiens
atagccactctaacccagggagagtttgctggtgtgtttggtgtttttgtttttgtttttttgagatggagtctcactctgtcgctcaggctggagtgcagtggcgcaatctcggctcactgcttgaacctccgcctcctgggttcaagcgattctcctgcctcagcctcccgagtagttaggattacagacacccataactttgcctggctaatttttgtatttttagtagagatggggtttcgtcatgttggtcaggctggtctcgaactcctgacctcagatgatccacccaccttggcctcccaaagtactgggattacaggtgtaaaccaccgtgcctggctgtgtttgatgtttttattaatacgttcgtttgatgaactgacctcggtagtttgtatgtgggccatctgtctcctgcctcccttccccaaacttttggtcaagtttttagtgttgagtctttttgttgttgtctcttttctgactgtacaagcaacatttcctgatgccgaagtctggggagggggtgggagcctcagatgttggtggtaggagttgcctggtctgcttttgaagttttcttgggcaagtatattaacatatactgagtataggttcaaatgtaattgcagtcttattgttagtttgtatctgtcaggttataggattagaaatataactatttttgggagttgggtagcagacaaactgaggattctacctgggactttcttctgtgtactgtgctctgctgaacccaacactgggcacaaacaggaaactgaggctcaagcggaggaggagtggcctgcccaaggttgacttgcagaaggaatgaggatatatccctgttttctcctggaattagactttcagatctctgttgttcttactgatgtctttgtggcttggtgaattttgttttagcttccttcttactttatttatgtaggtccattggtcagtttccttcctcagggccttgtctttttttttttttttttttttttttgaaaca

SEQ ID NO: 22385 - DNA, 1038 bp, Homo sapiens
tatccaagggaccatctccatacattggaaaagtttgttctgctctgttcctatgaatgaaatagcagcagatggatggaagttcgaggaacacagacttgacttagcctgagaaagatctttgtagcagttggaggtatcgggaagaggctcagtgtgaacccagagccctgggagctggttgggaacccacattttctagatttctgaggattttccagcttgaggttttggacacttttccagaaagacccagagcgattaagacacgtctctgaaacaaccacatgaattattctaacagctgctgcttgctggttttaggaagtttccttgtttcatgcactgctcaaatgttttcagattctagctcttttggcagagtttgggggagaagacaggtgggtgtcccgctgtgacactggttttgagagtggggaggggttgtggtcgccggaaggaaaagagccctggggatttgccacttgggtaaaaatgacttggtatctgactagtaatcaccaagacccaaacagggtcattttggggtggaagtgaagtatcagatgagttaggtgggagtgggctgggatgtactctggctactgcccactccaaaaggcctcctagctgggcctgggctgtctctcagggcctgtaccctccaccatccttgaattcagtggccagggaacccgtcccctccccctggtctgtgcctgctctgctcattgcctcacatgtgtgagcactcggtggaaggaggaagggatgtctgcacacactccctgtcgagggaccctggcttgctcctgtggtgccctaagcatgtagttggcatgcatgtgtgtcacaatgaaaatgaagatgagaattggtcctagtttatgacccaggccgggtagtatttgtcgatccttccagccccttcctgcatctcgtacactggcagacagggactcagaggccaggtggctgttcctgcccatggaactctgagggtttccatgccttctacagctgggctcagtcctggga

SEQ ID NO: 22386 - DNA, 1031 bp, Homo sapiens
tgagggtcaggtcctccccatcctgcctcagcaatgcccgacggacaatgggggaggcctggactgtgaggatgcacgagcagtcccattctggggacagagacaagcagggcctggcttggctgcatgttagtgctggcataggggttaggtagggtctggatctgcttgaggtggcttgagatagagggagggagggccagggaggtgagggcagtaggcctccttggaggaagagaaggctggcccagtgaaagccagttgaatggatgagtgaactaacgcccctgcccctatggccctgcccctcctcaccccttctggcctgtactgtcccttcgcctgtccataccagtttcccagggcatgtcttgcatgtaggttgggttgtctaggcagcgctgtgcttcagtgacactttgtggttgacttgggaccctgaccacactgagagcagcgcgcttctctgggttggatggctgggttctcaaggaccaacggcttagaattgtggagggtggagtgtgtcccggccctgtgtttgtttgcctgcctgctgacatgaagcctgatgtgtgcagccactctactgtgtgcgagggaagaaagacatcctagtccgtgttggacatgggctctgtgtggcagagttcagcctcttgtggggccccgtcttactctgggggtgatgcaggtaaagtctgctgaggacctagcctaaggctgtgtagtctgacagatttcttcagaccttctctctcttttttttttttcttcttttttgagacagagtctcactctgttgcccaggctgggagtgtgcagtggtgcaatcttggctcactgcaacctccaccccctgggttcaagcagttctcctgccccagcctcccacgtagctgggattacaggctcccaccaccatgcccagctaatttttgtatttttggtaaagactagggtttcaccatgttggctaggctgatttcgaactcctaacttcaggtgatctgtcctccttggcctcccaa

SEQ ID NO: 22387 - DNA, 1050 bp, Homo sapiens
ggtgaacggtgttgttgggtttcaccttggatgttgttggccatgtcatgttcccaggattggactggagccaagctgtgtttggatgcagaactagttgaaaaattctagagacagcacaagtttttggtgactacagatggtgataggtcagtgggtctgggcccagggaagggacaacggggcttcctaggggcacctggtagagcccatgcttccggatcaggtgctgacagctgcagagacaccatcactgtaccagccatgggtgccgcaaccccagcaaccccatggaaccggagttccccaggtagtggccagtgtcaggccatgtgtcctttcctcaaattaaaaggacctcgctagcctgagcttgagaggataaaatggcaagaaaggacttctgttgcccaaagtgcagtgacttgatttcatgtaaattgccatagctaccttctcaccaaggctgatcttccctcagtttgagaagtccttgtgtttgggtgggttgtatggtaggggtgtgtgtgtgtgtgtgtgtgtgtgtgtgtgtgtgtgtgtgtagtacccaggtgcaaggtcaaagccaaaccataatgatttatcaagggagcggaagagtctcttatgagctggtaattgtgcacttaagggttacttgatactgctttaaatgtatgggttggagataaaaacagtaaaagctctctgaactcagccagtacggggtggatggcaaaacagtccaaatgatagattagtggaaagcgattacagtgtattttcaagaaatgctgctagttgtgatcatgctgagtggtcttctgcttggtttcctcctctgtgaatcttgcactgattgtattgcagggctcctgcagtgggctcctcagatcggccccttctccttcagggttaaactatccctgctcgtccattcaataaatatttattaagcggctgggcgcggtggctcacacctgtaatcccagcacttcgggaggctgaggcaggtggaacacaacgtaaggagttcaagaccagtgtggc

SEQ ID NO: 22388 - DNA, 1053 bp, Homo sapiens
acacgcatgtagacggcctgctttccctctggctccaggagcgtgaagcagctgtctctttctttcctttcagtttgagtgcatgagggggcacatttgggcagggccttgcgctattgctcatttgtgaaattggctcctttaaggaagctgcagatgagtcagctctggagtgcgtcccatggatggcgacaggacccctgtgttgccttgtgctgcccccagcttccagacggtctgcctggctctacctgggacaggcttccccagggtgtttgccagtgaggaaactaaggctctggcaagatgagtgccctgcctgtgaggacacagataggaccagagggcttcagcatagagcatgccacaggtgtgaattggggttctctgtggggcccaagtgggcaccaactgtcccatggaaaactgtgacacttcgggaattccactagagctcagctgctaaatttctcttttgtcctctggtaaacactgggatgcttttttaagaacctgactctctctgtctcaattcctgtgccctgtcctgttgggacgtcgaggccgggattagagcagcccctttaagagtgccagtgtcccagaccctgctgtggaatgccagccgcctccctgcagacagacatcgctgtgctgtcgtcctgtctccgtgagggttaacaacacttcagcctgttgtctggaaccggttcagactggttttctggaaagtgctttgtctctccgactgaatcctgggaagggtcatgtggagccagtgatgtcatgggatcaaaaactgactcagctgtttttttcttctttttctttcttctttaaatcaagatatgtgtgtgctgcaggtacagggcagtggcacgttgatgggccaggcctcactctactcaaagtgtacctcactggcaaccaaagggttaaatgtgatccccagtccccactccccagaggtgagcagggagtgaggagacctcccttccctgaaggggagaagctggggttaactcgagtcaccacagcatagggctagtccca

SEQ ID NO: 22389 - DNA, 1787 bp, Homo sapiens
aagtatttatgcctgtaactgctgaatttcaggtgagaacagtgagactgtatggcatttggcctggagctattcctatgccctctcccatctgtttggtaaagaggttctgtccagccactgtcagctttgaggaccaacagcttcgctgtgtgggtgaaaaggaggactgttcattttagagtggtagcaaccctgcctgtggtcttgtagatgagagtgacagtcttggagatgggcaagtggggagacacagcggctctgttttagcccaaggttggggcaagatagaaaaactatttgaagaaataatgggcaaaaacatacttgaggagaaactcatccaggaatcccaacaaaccctaaatagcataagtacaaagagatcttgacctagatacatcatagtcaaactgtagaaagccaaagaaaagaagaaaatcttgaaagtagcaaaagaaaaacaactcagcacatctggggagcattaataagatgaacagctgacttctgactcgagacaatggaaacaaaaaggagttgaatgatgttaaaagtatccaaagaagaaaactgccaacccagaattctataccagtaaaaacagtccttcaaaaatgaaagcaaaaaagacattgtcaggtaaacaagactgaaggaatccattgctggtagacctgccagttcttcagcctgaaaataaatgacacgttggcagcttgagtctatgagaagaaataaagaacactggaaatggtaaatgcatgggttaactggaaagacttaactagttctgcagtctggaagccaaccaaaggctttgaatgatttgttgggtttataatatccacagataaaatatatgtcatattagtacaaaagatggggaattaaatggagcaatattggagcaaaatttctgtatcttactggaatcaagttagcatcagtcttatatagattgtgattaagatgcttactgtaatgcctagagcagctctgaacaaaataactttaaaatatagttttttaaaaaaatcagggctgggcacagtggctgactcctgtaattccagcactttgggaggctgaggcaggtggatcacaaggtcaggagaccaagaccatcctggctaacgcagtgaaaccccgtctctactaaaaatacaaaaaaattagcctggcatggtggtgggcacctgtagtcccagctacttgggaggctgaggcaggaaaatggtgtgaacctgggaggcggagcttgcagtgagccaagatcgcgccactgcactccaacctggatgaaagaacgagactccatctcaaaaaaaaagaaaaaaagatcatcagaattaaagttatacactaaaaaatatttaacacgaaagaaggcagtttctttattcactgagaaataaaggaacaaacaagaggacatgtagaaaacaaaatggcaaatgtcaatccagccatgtcaataatgcagtaactgtgaaggatctaaatacctcaatcaaaaggcaaggactatcagatagtgtaaagaagcaagattcaggctgggcgcagtggctcacgcctgtaatgccagcactttgggaggccaaagtgggcggatcacaaggtcaggagtttgatagcagcccctggccaatatggtgaaaccccgtctctactaaaaatacaaaaattagccaggcgtggtggcacgcacctatagtcccagctacttgggaggctgaggcaggagaatcacttgaatccgtgaagcggaggttgcagtaagc

SEQ ID NO: 22390 - DNA, 1049 bp, Homo sapiens
tccaccatagtgtaaagtcacagtgctgagaggaaggcagggtaacgcctgaagccaagctggatctgctgcctttggaaacactgagttacctgtggctgaggctcgggcagatgccaccgttctctctggagggtgggagacaagggaggggacgtctgatgggtggaaagatgggagacataccagatgttgctatgtgcctcccttgcttgggacctgtgccataggactgcggatttttagagcttatatctttaaaatagttgtgacgtcatcaaattgaaaagctttgggggttcatgcgactgagacttgatgccatgcagaattcctcaaggcagggccctgatagctttcgtacaaagagcattctaaagagagccatcagtccaggcctccaggagacttggcgtgtctgcaggcggtgtgggaagagtggtctgagggcactctctgggggactgcagcccagaaatcatggtgcaccgggtgcaggggtcagagtctgaaggtacacggtggtaggagcagagaccggaaaggtggtctgggatagattgttggatgcaggaagggtggaacatagagttgggactgggccttgggtttgggacccccctctggagaagggagagttgatgctctgagcctaggtggagcccaggatctctcaggcatttggacgggagagaggtggccaacttgctggagaaggaaggagattcctagtcccggagaccagcagtctaggggcagtggggcacaagattcagaatagcgtcctcacactgaggtcctgggtgacctggccagccatgttcctgtgtttgatccacagccatagggcgtcgcccgctttctgtgacttaggtaaacatagaggctgtacagttgccacataaggctgtaagaaccttaaggtgaccaaattttgttggctgatgattaaataggttttataagcaattatagtgtatctttggggtgaatcctattaaatttttagtacctctcacttttcaaaatacaactttggcagcaaaaag

SEQ ID NO: 22391 - DNA, 1103 bp, Homo sapiens
agctaaggtaggagaatcacctgggcctgggaggcagaggctgcagtcagttgagatggcaccactgtactccaggctggacaacctgagttgagaccttgtctcaaaaaaaaaaaacaaaaaaaaacctattattaattcatttaaagatgactatagtagacctgtgacatattagcataaataacttattattaaaaatctattttgcaaatctctttaatactcagcttactaagaaggcagctgctaggttcccgtggctatttctgtgtccatcctcttgcgttctttgtgagggtttgaagcatggtgaagaaaatgtaactagcatggagaagaggttggagagtggaggagcgtttccataggctttttggatcattgtgcgtttcctcctctaatgagaaaccaaaatccagagtggctagtctctactggtgagttggcccttagactctgaaacctcatcattgagctttttgtacatgggttacattaaaatccgtgggactcttttacactttgaacagaaaaatctgtttttaaaactaacttttaattttagaatagtcttagactcacagaaaagttgcaaagatcagtcctgcaaacctcatcccagtctccacattgttaacagactacagaacatgtgtcacaagtagtgagccagggtccatgtattattttaaccgagttcatactttattctgatttcctcagttttttccagctgtcctttttcccttacgttatatttaatccttgcgtctccctagattccttggactatgacagtttctcgtactttctttgttttgggttaccttgtcagttttgaggagcagaggtcaagtgttctgtagaatgtcagtgcattgggatttgtcagatgcttttctcacaggcaggtgatggatttgggggaggaagaccacagagggtgaagtgctcttctcgtcacatcatatcaaaggtactgctggtcttgaatgaacgatcgttttggtgaggtgccatttgtcaggtttttctactgtaaagttacccttccctccttcccctgctccaccatttccatactgtcctctttggaagga

SEQ ID NO: 22392 - DNA, 1044 bp, Homo sapiens
atgctactggctgtccaggatccttcagccataaataaaggttcactattccaaaaatgacatagtggggctcagtggctcacgcctgttacagcactttgggaggctgaggtggaaggatcacctgatcccaagaagttcaagaccaagcctgggcaatacatagtagttcccatatctaccaataaataacaaattaattcgctgggtgtggtggctcgtgcctgtagtcccagctactcaggaggctgaggtgggaggatcgcttgagcccaggaagtcgaggctgtagtgagctgtgattgtaccattgcactccagcctggtttacagaatgagaccctgtctcaaaaaaaataaaatatgaccgagcgcggtggctcatgcctgtatctcagcactttgggaggccgaggtgggcagatcacttgagcccaggagtttgagaccagcctgaccaacgtggtgaaaccctgtctctactaaaaatacaaaaattagccaggtgtggtagtgggcgcctgtagtcccagttactggagagactgaggccggagaatcacttgaacctgggaggcagagtttgcagtgagccaagatcgcgccactgcactccatcctgggcaatagagggagacgcttgtctccaaataaagatatttgatgacctgaattagcagctgccagtcacatggggcctatcctctctaaccccacacctcctctttagggttcccccagggtcctggcacagtgaggggtccacacaggagctcaggtgctgtaggagcccaggttgtctgcaggtcctggtgtgtgaccttaggaagtcatgtggccctcccttaagattgttccctgtactgggaactgggggtaatgatggagctgtggagaggattatgtggaagggtgaattttggtggttggcctaggaatggccatcataaaggctcagcaggtgtttactgggtttttgaaacctgaaaagttagcctttcatttcttcgattgtagtcatttctaatgcatgtgtcttcctgt

SEQ ID NO: 22393 - DNA, 1029 bp, Homo sapiens
ggcagagcagccctctcaggcagcttcagctgctaggtggtctggacccctcgcctaccctcttccttcaggcaggtttgaattttattagacatctcacctctggaagaagcacacgccctcaataagatgataagaagggttaagtcccttagagcttggctgtcatttcatttcagctcatgctagcccaggaattgtgtctgtaactctatacaagatgctgccttggccccctgctcccctgttcactttggaggccacctgggtggaggccagctgctgcacctctgtgctgaagccttgggactgcctgcctctgaggtgctcagtgtgtgtacacgtccagggaacctggaattagagccctgaggtcaccttgaaagtcgatcttgggcggcatggggccggcagcaaggagagacatgctggcggtttgctaagacctgagtgaggtgtcctgggttactttagaaacaaactacccggttctgggcttcagaatgtgggctgataaccccttgcctgggggattgtatacttcgaaatcgtacctttctgtccacgcccaggtctctggtgagaagctgcttcatcagggctaggaccagcgttcaggtacagccaccacgtagctgtggtgggtggaattaggagggaccagaggagagcaagtaaagcggttcctgagtccagcatctggcgagtccagggtagcattggtgaagccttaacctctggtgctctgtgtctacccttccctgaggacgcagctcatgggtgtggaggggacctcagaggtcccgagggctgctagagcagagtcaggttcttcatcctagcgactctcctcaaccctgccggggtctaattatcaactagaccctggcacagcaagagccaggacaactttgagctgcggcaaccagttaactttgtccgagtttgttctctgggtcacagtgccacctagaggacgtgtctgtccttggctggttttcctgctgacaaaaaaaatggacttgattc

SEQ ID NO: 22394 - DNA, 1131 bp, Homo sapiens
acttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttc

SEQ ID NO: 22395 - DNA, 1579 bp, Homo sapiens
ctcctgatgtgatccaccggtctcagcctcccaaagtactgggatgacaggcgtgagccactgcacccagccacttttttttttttttttttttgagataggctctctgttgcccaagctagagtgcctagaggctctctgttgcccaggctcaggcgatcctcccacctcagcctaccgtgtagctggggccagaggcttgctacaggcatttcttgcttggcctgagaaacattcctatggggtgctgtctcctgggcttggctcttggttcctcgtgaggctctgcttccctggattgggcacaggcttgtcagtgcagttggggcagattcaaggggcgggtcctgggtcatggtctcaaatagcctctccagctgagaaaatgggacactcccctcgtccctgacatcttgtccccgacatctcatcctctctgaattgagccttgggtctgtggccacatggcaggcagagaccctgaccccatctgctcccacagattcgtcggtggacagatggcatgcactatgccctgggccccggagatgtggcaggagctatccagacagaaacatatagcaccttgagaggagggcatggggtgacattttaggcaaggcttgaagaggggaaaagtgccaggagtgtgcaaaggcttggagataggagccagcatggcaggtcaagaacaaaaagggcaatgtggtgggactgggtgggaagacggggcaagggcgtgggttttagctaagtgcagtgggagtctagggaaggtcctgggcccagtactcaagctacgcccactctgaagccatgcccactaccccaaggatggggttttgcccattttccaagtggggagtctgaggcatggccccagtcaggagcagcacccttcgaataaaccagaggggctaggggctaggttttattttatttatttattttttcttttgaggcagagtcttgctctgctgcccaggctggagtgcattggtgggatcttggctcactgcatcctccattttccgggttcaagtgattctcctgactcaggctccccagtagctaggactacaggtgcaagccacccatgcccgactaaattttgtatttttagtagagatggggttttaccatgttagccaggctggtctcaaacgcctgacctcaagtgatccgcctcccaaagtgctgggattacaggtgtgagccaccatgcccggccccaggagctgggttttctacctccactctgatgtggtccagccaagactggaggctaggcactgcccctcttttagcctcggtttcctcatctgcaaaactgaaggggacagggccatgtatctatttggagggatgaagatagagctggcactgcatcaccagggcaccagaaagccattgagactgagtgagcaggggctgggcatggggagacccaccagaggagcagctatgtagggctcatatgcaggtaggcacgattaggatttcctaatatacctaatacatttccccatataccccaaatgggaaccactcccaggctctgtggggtcctctctcaatt

SEQ ID NO: 22396 - DNA, 1046 bp, Homo sapiens
caaccccaacgcaggccaggcaggactgggagatgggggtcattgcagggaacttggaaactgccagaaagcagggagaagaaaggaaagattgtggccccgcctgccccagcctcacacactgattattttgagatgaaggggacgtggttttgtgaggcccagagccccgtgatgaagtcaccccctcttcgtcgcgatcatcaggcagagttatttttaggataaaaaaagtttttaattgaaaagaaagtagaaagccaacagtcttgtgggcagtcacccgtgcagctgcctgcacccgccctcctctcaggctcctggtgggctctgcccacagcccttgcccttcccgcgaccctcgccctgccccctgcctgcctccccgcccccctccgcctcttcccccagcagcaccctggcccctgaggtctgtgctgcctgtgctcccccgacctagcctggtctgacctgagtgtgggtttcgggctttcacaggcgcctacaaatcgaggacttcgaggctcgcatcgcgctgttgccactgttacaggcagaaaccgaccggaggtagcaccgcaggggccaaggttgggaggtcactggccggaaggccccaggctgcagggcctgacctgcatccccgaaggtggccagaatgcacgtgggggccatcgccctgtgccgtcagctgcatcctcaggcgtggagacttagtggagacccaagggggcgaaccggaaggcttcctggaggaggaggcagcactggggttggggcaagagaaaagctaggagttggctgggggaaaaggagacagggtcggagggaggcttgaaggggtgctactaggggccctaggcaggggcccctcagggcactgaggccccacccccaccatcggccccatccccacaggaccttgcagatgcttcgggagaacctggaggaggaggccatcatcatgaaggacgtgcccgactggaaggtgggtcccggctgggagggcagaggtgccagccacggcagagacagggcctggggtt

SEQ ID NO: 22397 - DNA, 1007 bp, Homo sapiens
tagttacaaacttgtttcttcttggttttttgtttgtttaccttgttgaaaagtccctagttatataaggttgttggctacttctgattggttgagcttcatttctgtttttctttaaaataggcagctataagaaataattcaagttaagtttagccaggcatggtggcttacgcctgtaatcccaacaccttgggaggcggaggcaggtagatcacctgaggtcaggagttcgagaccagcatggccaacatggggaaaccctcatctctactaaaaatacaaaaaaattagctgagcatggtggcaggcgcctgtaatcccagctacttaggaggcccacagtctggttaaaactccaactgccattttttctctttctgacacataaagtgtaaagggttttgtcaggtcaggtagccccagggctggcgccgacatgagtttttcttttaactcacgaaaagctcgttgctgttggttgtaatagatgtagtttatccaatttacatttttattaactgtcacccaccaaaatattgactcgaatcctgcagctatttgatttcaagctttaaattgatttggtattccccatgggactccagttgcatctaaatagacgtgagagttgaaagacccataaggggcttctctcgctttacgatgtcttatttttcttccctctggttgatgaaatgccagggtgaaagggatagccaattggactaaagtacaagtgccactccagttattggcagaatgcccagtaaaggtctaccacaatatcaccacacattagctcggggatgaacaagggctgattgataagctcttgaaaattcttaagctcactgcatcccttcaggtctccaaggaacgctaagtttttctccctatcatgagagacacaaagtgaacttagtgttgggagatggaggctggatggccctcggggactgacctgcagggtgccggactttgggatatagcagggagagcttggc

SEQ ID NO: 22398 - DNA, 1046 bp, Homo sapiens
ctccatctcaaaaaaaaagaaaaaaagttagtggcataataatgcttcattaaacgcagaatagtcttaacatggtataaaaaatgaaattaagttcacacatcatctaacaatttttaaatatactgcattcgattacataaaagtacagttagtaaaataatattctcatttaatacttttaactgtaatttttctcactataatgtagaaaactattactctgaacccccactttttaaaaatctttattaataaagtaattcattataatttttgaaaaaaaaagttttaaaatggtctgccaacatgttaatgtaggttaggccatccaaaagacaaagcaaaacatcaacattaagtcataggctaggattatacaaatgagaacccccaccttatacattacttaatataagttaactacaaagagcctctccacttacatttttatcatgcatcttacattttaatgtccttattcttttatagaaaaggtcataatacccaataaaaaagaatctgtaatatccctgatgcagcaacaattgatcacatgctttcacatgtgaccacaataggaataaaataacagcgtaaagaaatttgaaagttgtattacatcattattcactgttcaaaaatttttttcaagaaacaagtacactttcaatgaaattacaatgcttcagaaaatctcccttttaaagttatatacaaaaacagctttagttgtggattcatttttatactcaatactctgatttagtgtaatgtctgaagtgtcagtgccttattctagtgtaaattctcatatttacgtaaaatcaattttgaattaaatatttttttcatatttacatctgcaaaaatatactttagtataaactctctgatgttttctaagctatagattttgaaaaaaaaagtctttccaaattcattatatttgcaggactcttctccaatataaattccatgttgttgaataaagctggagcaactgcttcaggttttcctctagtacacaatgtgtgcaacaagat

SEQ ID NO: 22399 - DNA, 1018 bp, Homo sapiens
atgactcatttctcttacactgagacagaagcagaattaactcctgtcagcctgacacaattctgcatgggacatctcaaatgcctcaaagacacctaggtgattttgaaggaattcccagtcaccctgggccgctggcccaatgataagccaggctggagagactcaggctgattctaaatagaaaatggaacttccctggtggaactccacaacctggatcacccattctgatttactagctcttgggtaagagaaagaacaaaaatactctactccagtatcacattttacaggtgaatatagttgtggttgtgatcatggctctggatactttgcagccttgatctctcactacagattatgccatcacattctatttcctcctggagcctctgacctcactgtagcaggtcaatgaacaagatgtgaaacatctcaaagagccacactcccaatgcagaaaatgccttttgttagttttctgtacattctctatccaaagtctggcccttttttatctgcagattctaggtaggatcaacttggctctgtatcctttggtgttacagtaagtggagtacaattaaaggagaaatcttaagaaaaagctcagattagatatgagattgatcaagtcagccagaaaatattcccctaaaagcaatttctctctcaacacccaaagtacacagctactctcagcatgagaaacatgaacattatggagaaagggggcagattttcagaatacttttataaagtttcttttccatctctgctgctctctcatctcctagccattgaataggggttctatatttaaatacatctgacaacttccaacaacactttttgatgaagaaatagaatctgactgtgttcatatagtggaatacattagagcttgcaatataactaactaaagagctatgttggtggtgtttgggtggccacatcacctgtctttatttgtcctgtaatagcagcattccaatttagtgaaataaaagatact

SEQ ID NO: 22400 - DNA, 1045 bp, Homo sapiens
acactcttgactacaacaataaaagccctcttcaaacaaaaaatcatttttaacacttattttaatgaaaatttaaccacaattgaataattggtatatttttattgttctgtgtgtgaatgtataaaacagtacataaagaagccagaaaaaaagatgttaatatttgtaatgaattaaactggaaagttattaattattatttgcaggtgatatctttgattatgtagataagaaaagcagcagaaagacttttaaaagtttattcaggtgggtaagcaatattctaagataataccctggattcccagtctgttgcacacctgcggtggaatactctcgagtgtaaaaatgtgactgtggtgggacatcactcatgaaattaggttacccatgtgttgactttgtgtttatcaaaatggagattatcctgactgtgctaaacttaatcagaggtgtttttaagagaaaaagacacattataggaaaacacccctgctggcctgaaagtgacttctataggtggaacatgttgtaagctgcttatggtggccacatggcaggaaacatgcttgtatattgtcatcatttctgcctcttgcatgttgttcccagtagggagaataagaggttcctatggcagatggaaaaaaggggaatctcattcatgcaagaaataatcacctctcatctgggatagcttaagagaaacaggagaccacaaaaagactacattaatgggaggaaaagggtaacctggctaaaagtgctcactggcattaaggaacaacatttagtaagctgtagtgaacgatcagcctctgggatactgatagtctaccaataaggttgaacttattctaattcagtcaacatctctgcaccattctggtgacccaggtttacactattcattacagaaatgccatgaaaaccagtgggtaatgtcctagaattgaacttacttcaaaaggcatacctttttgttttcacatttgaaaaacctcaaaaacagtgaatttataattaacttctaattatagag

SEQ ID NO: 22401 - DNA, 1033 bp, Homo sapiens
tgcttaatgttttttaaatataagattgtatgatctataaacagcaactttttacttattttactccatctccaaaaaaaaaaaaaagaaaccttaaagttgaaagtattttctaaatatttagaaatttgttatgaattagtattttggtattaatttactagaatattttattacattctttctgctgagcacattactagcttgtaattgagaaatataagcaagattaatgctatttatttttaatgaaacaggtattattgtctctaagccagacctgatcacctgtctggagcaaggaataaaacctctgactatgaagagacatgagatgattgccaaacccccaggtaggtgcgaatgaaaatgaacacaacagacaatgcagataagaggtcccaaggtcaaaaagaaagccagtccttaaaatgtgatctgggaagctgtgttccaaaggaaatagttcctgggcagctgttttatttatttatttatttatttaatttttctctcacaaagggacatctgtctcatgcttttaaattctctaaggattctactattctttcggtgagcttccttcaagttcacagtgagagcgaaattcctctttatggcatataagtgattgcacaatctggctgcttttccgttgccttggggacacacaaatatctgcgtgattttgagaaactaaaacccttttttaagttgtctttttgcttcagatctgaaatgtgtgacagtattagtttttgttgcattttttgttcattttttctgcacagtccattctgtttttattactatatagtcttgaaatatagtttgaaattataagtatgatatccttctgctttgatctttttcctcaagattgctttggctatcaaagttattttagtatcacgtaacttttagaaatgtattttccattactatgaaaaaaataccactgcaattttgataggaggtttattgaatctatagatcactctggttaatacggcaattttaaaatttatttgga

SEQ ID NO: 22402 - DNA, 1533 bp, Homo sapiens
tcttaaagcccctgcacctggaactgtttactttcctgtaaccatttaccttttaactttttgactacttaacttctgtaaaattgttctaactagacacccctccccttcctaaaccaaggtataaaagttaatcaagccccttcctctgggccgagagaactttgcacgttagccgtctctcggtcgccggctaataaaggactcttaattcatctcaaagtgtggcgttttcctaactcgctagggtacaacaatcagatcaaccaccaaagtgggaaacattgaaatcaaggatcttatggttggtgatgaggcaagtgaattacgatcaatgttagaagttaactaccctatggaaaatggcatagtacgaaattgggatgacacgaaacacctgtgggactacacatttggaccagagaaacctaatatagataccagaaattgtaaaatattactcacagaacctcttatgaacccaaccaaaaacagagagaagatggtagaggtaatgtttgaaacttaccagttttccggtgtatatgtagccatccaggcagttctgactttgtacgctcgaggtttattgactgctgtagtggtagactctggagatggcgtgactcacatttacccagtattagaaggcttttctctccctcatcttaccaggagactggatattgctgggagggatataactagatatcttatcaagctacttctgttgcaaggatacaccttcaaccactctgctgattttgaaacggttcgcatgattaaagaaaaactgtgttacgtgggatataatattgtgcaagagcagaaactggccttagaaaccacagtattagttgaatcttatacactcccagatggaggaatcatcaaagttgggggagagagatttgaaacaccagaagctttatttcagcctcacttgatcaatgttgaaggagttggtgttgctgaattgctttttaacacaattcaggcggctgacattgataccagatctgaattctacaaacacattgtgctttctggagggtctactatgtatcctggcctgtcatcacggttgaaacgagaacttaaacagctttacttagaaagagttttgaaggatgatgcggaaaaacttcctaaatttaagatctgcattgaagacccatcccgcagaaagcacatggtattcttgggtggtgcagttctagcggatatcatgaaagacaaagacaatttttggatgacccgacaggagtaccaagaaaagggtgtccttgtgctagagaaacttggtgtgactgttcgataaactccaaagcttgttcccatcacacccgtaatgctttcttttttcttttattgccaatctttgaactcattcaactccaggatatggaagaagcctttctctaccctttgactggaaaggtcaagttttattctggtgtcttgggggagctttgttaaatttttgttaatgtgggtaaatctgaatttaattcaactgcttccctacataga

SEQ ID NO: 22403 - DNA, 1049 bp, Homo sapiens
tgcattaacaagttctccagtttattgtacacattaaaatttaaaaagtaccttctaactcaacctgtcttttccatctgaaaaatatacacaactcattctgtagaatgtgtatatggcatccaaaaatacacatttttatgcccttaattttatactatatcatccagaaaagtatcatgtatacactggtattgtggatcttatgccactctcttttcttagagttaaaaaatatattagagaatatttctgtgttaaaaaaattattttattttataattttagtcactcctgtaagtcagaaacagttacctgtactctctcatttcaccttgagtaaaattaaaaatgcttttcataaccagttggtaattatgtgtgtgtgtgtgtgtgtgtgtgtgtgtgtgtgtgtgtgtatgtgtatgtgtgtgtatctttcagggaccattgacatttagggatgtggccatagaattctctctgaaggagtggcaatgcctggacactgcacagcggaatttatatagaaatgtgatgttagagaactacagaaacctggtcttcctgggtgaggataacttcaatacacaatttctaatatgccctaaaggttttatttcttttatttgtggaatgtttttctggtaaagtgtgctttgcataaattagtttcagatccctgttttcaagaaaatcttggggattaatacatgtagaaaagaatttctgcaagatgtttcattttgaccttaactttccaaatttctgagctgatctgtatccttcactgtagattactaaattccacaaatttaatggcataaaatttttgcccacaccttaaaatgtaattgccaacaccaatttttgattcaatagtactggatagtaaaattaagaaactgggccaggcttggtggctcacgcctgtaatcccagcacttcgggaggctgaggcggacggatcacgaggtcaggagatcgagaccatcctggctaacacggtgaaaccccgtctctactaaaaatacaaaaaattagctggg

SEQ ID NO: 22404 - DNA, 1048 bp, Homo sapiens
gataatgctaaggaattctaattttggatatgtgcatatctttcccagaaagttatgcatttttatgtaataatatgttgttttcttacattatgttatttttagcatctttgatatgtagggcatatgcagtgccaatacactttttttttttttttttttttttttttttactaatttcaggactattacaatatcacatagttcccttctcgcttgcaaaattttcatgacaaatttactagtaatctcataagactatgcttataaatgacacatcacttttatcttgcatctttgaggattttctactttgtgacttgaaattgcactcatgcatgtgtttgttataaatatctttgtgtgtattctagtttgttgagcttcttcatttttacatcattttttcttatattaaaatttttttgtatttttcacctccacaatttctgttttttgatatttttaatatttttgttgttatcctcattcttctaattttcaattgttgtctgtgtttctattttcctcactgaatattattcaagtttttcaaactaatttgtatatctttatttttaatgatagctttctgaaatttttatgtttctgatggggctatgttgccccaatatttttatatgttgtaatctttcattgaaatttagacattaaaaacaaaccacctgtaacaatctttataatatagctttgtcttggcatatctgaaaccaattgtcttggatagagattctgagagtttctctaacatgttcttaggatgtgtcttgtctgaaatgttttaggtcttttttagttaaaggagtttgttcatgtttcttcttaatagtcagtaatcatttgctacaactatttcctgcctataatattgcagtctctttgctgctgtagcatttacctttgatctcagcagactcaaactgccattccaatgtataccatttatttcaagacagaaaccagtgtctggaaaagtccctagaaaccagaaataaaaatgttttttgccgctatttttcttgtcttt

SEQ ID NO: 22405 - DNA, 1056 bp, Homo sapiens
gaagtagaactttttttgcagagttttaattacattcaaagtatacttttttccttaaaaaagttaggtttttttgaaaagaaaataatcatgtcattcaactttcaaattacttcatgctctttcttcttcattgctattatattcacatgtgaaagcatgtgatcagtggttgctacatcaaagataggagatttttttttcttaggtcattatttatgaccttttctattaaagaataagaacattaggctgggcgcagggctcatacgtataatcccagcactttgggaagctgagacaggcagatcatgaggtcaggagtttgagaccagcctggccaatatggtgaaaccccatctattaaaaactacaaaaattagctgtccactgtggcacgcacctgtaaccccagctactcgggaagctgaggcaggagaatcacttgaacccaaaaggcagaggttgcagtgagccgaggtcgcaccactccacactagcctgggcaacagagcaggactctatctcaaaaaaaaaaaagtatactattctttttttttctttatttattttattttttatttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctacttctttctacatagacacagcaacaatctgatttctctatcttttccccacctttcccccttttctattcgacaaaaccgccatcgtcatca

SEQ ID NO: 22406 - DNA, 1050 bp, Homo sapiens
aaattaatcaaagagtgattaaaaaactgttgagcacccagctgtggtttgtaatttgttgttcatggcggggcttgaaggaaagacttttataaggtgcatgatgaagaaagccaaattcagtaattggttaggtaccgttatgtagtttcttagtttgtacaataaaggtgaaaattttctggttgtgtaatcagaccttaattggcagtatacagttgattaagcctgaattttgtgtctttcaatgtagtaattttcaaaacgatgcgcctgagttagattttttttttttttttttttttttttttttgagatggagtctcgctcttgtcgcccaggctggagtgcagtggcacaatctcggctcactacaacttctgccgctgcctgtgttcaagcttctcctgcctcagccttttgagtagctggaattacaagcgcctgccaccctgcccagctaatttttgtacttttagtagagacggggtttcaccatgttggcctggctggcctcgaactcttgacctcaggtgatccgcctgccttggcctcccaaaatgctgggattacaggcgtgagctatcacgcccagccacgttagatctttttaaaagtaggaacccagggtctagagacacctcagtctaattgcctgccactcaattattttcacactccacggggaactgattttctgctgcatttttcacctgtgtcccaagcagggtcttaagtctaacccccgtcccccatttctccagcctcactctggcttgcagtaagatactaaatttccagttctttctggcgttcccaaatgccaacttttcctacctaattcacattatcacctatttgtcctttagtgtacattttttacaccgtattttaattagttattttctgacaaagtattaaatggtgcttttaataagatttgttatctgtttgtaaatatttcccatgtgaagaaagcaaagaataatcccctgacactgtgttgtaaaaactctctgtgcttcttctccttgtatcttctctgggcac

SEQ ID NO: 22407 - DNA, 1481 bp, Homo sapiens
catgctcttattcttttttatggttgcatagtattccatagtgtatatgtaccacattttctttatccagtctattattgatgggcatgtgggttgattccatgtctttgctattgtaaatagtgctgcaatgaacatacacatccacatatctttataacagaattatttatattcctttgggtatatacccagtaatggggttgctgggtcaaatggtatttctgtttctaggtccttgaggaattcccatagtgtcttccacaatgattgaactaatttacattctcaccgacagtgtaaaagtatttctatttctccacagcctcatcagcatctgttgtttcttgactttttaataatcacgattcttggccgggcacggtggctcacacctgtaatcccagcactttgggggtgccgaggcaggaggatcacaaggtcaggaaattgacaccatcctggctaacacggtgaaaccccgtccctgctaaaaatataaaaaattagctgggcgtggtggcggacgcctgtggtccccgctacttgggaggctgaggtaggagaatggcgtgaacctgggaggcagagcttgcagtgagccgagatcgcgccactgcactctagcctgggcaaagagtgagactccatctaaaaaaaaaaaaaaatttagaaaaaaataaccactattcttactggcataagatggtatgtaattctggttttgatttgcatttctctaacgatccctgatgttgagctttgtttgtttcttggccacataaatttattcttttgagaagtgtccatgttctttgcccactttttaatggggttgttttattcttgtaaatttgcttaagttccttttagactctggatattaacgtttgtcagatgaataggttgcaaaaatgttctccgattcttaggttgtctgttcactctgatgatagtttttttgttgttgtgcggaaggtttttagtttaattagattctatttgtcaagttttgcttttgttgcagttgcttttgacgttttcatgatgaaatctttgtccatgcctatgtcctgaatggtattgcctagattttcttctaacgtttttatagtttttggtttcatatttaagtctttaatccatcttgagttaacttttgtacaggtgtaaggaagggttccagtttcagttttctgcatagggctagccaattctcccagcaccattcattaaatagggagtttgttcctcattgcttgtttttgtcagatttttcaaagatcagatggttgtagataagcagtcttatttctgagttctgcattctttttcattggtctatgtgtatgtttttataccagtaccaggatgttttggttactatagccttgtggtgtagtttgaagtcagatagcatgatgcttccagctttgttctttttgcttagaattttcttggctatatggggtcttttgggt

SEQ ID NO: 22408 - DNA, 1091 bp, Homo sapiens
ggtaggaaattttttttttttttttttttgagacagtttcactcttgttgcccaggctggagtgcagtggtatgatctcggctcactgcaacctccacctcctgggttcaagtgattttcctgcctcagctggccaggctggtctcaaactcctgacctcagatgatctgccctccttggcctcccaaagtgctgggataacaggtgtgagccaccacgcccggccagcaggaaaatatttacaaagggcataaaagagatgggttttagaaaaagaaattaatgcttaattatatattccatttgttaaaaattctcatttacctttttctttcccagagtgagtttaaaaggtttctcaggtgtgtttgttttttatggctaggtgaattcaaacagaatttcaaggctcagcttttagaatgctagctaccgaggaaaagaatagggaaaatctctattctattttggctgtagaaaatgaatacatgtccataagaaaatgtggtagataattggtgagtaaacatagattcatgaaaacatcagttgctctatctgcaggataggatttttgacagtgaatatctgtgttcacatcctgttatcttgatttctgagtttcatgctacattttatgagatgaaacttggtaccacctagaagtgttcccatatgactaattgtttactacatgatttttaatgaaaacaatacaataatagatatattttcataaaggagtagatacttttgctttttttattgaggtataaaatgtaagtaccttaaaatttccttcccttatatgaacactgtgtttgagtaattttgctggatttttcaaacacgtagtttcaaaaaccaagtgagtaactctaacatggaaactaaagcttgagcccagtgtctcagagctaaggctaatattgagcctacaaaaggaggttattaaaggaccagctagtttatttatgggggatgctcccctgcagatgtccagtctgctcaccccagccatggaagaagcctttctgctgacagagccctggaaagctgaggacccacaggcaaatgcagttaaggttaag

SEQ ID NO: 22409 - DNA, 1053 bp, Homo sapiens
tctccatgaatactgaaagttttttctgtattctaatgtcacaatttctaaagttacaacaaacttgcatttgagaacatctgtcaaagtcttaagttaactataaatcatcttttgaagaggatcaacacaacttgattgtctgcatgggaaagtcttagggcagtctcagcaaaaaaaaaaaaaaaaaaaaaaaacatgatcgacaaggaaatttggttagctctgtggcataaaataattttatgtaacaattgtgattattaatgatatacacttagtcattagaattacaggagtttcccataattttggaacacataccaataacatatttacaaaaacagtccaaaaatagtcaaacatgatttcacatttgacatgttttctatgtgattttttatactaaatgagccaaattttactattatatttgtgtattattaatgtcaaacccaattcttaatctttatagacaaacctatccaattttagtatttgaccgtaaggtaatattcttataaaccttttataactctttacaaagtccttgttgtttaagagtagatcagtgctttaagagaaacctgttgtttttatctcaatgttcaatttatagaaaaactgaataatacccatttaactttatatgttcacacacagaaactcttttgcaattaaattttagcaaatctttcacaatttgtttaaaccttcagttttattctaatttaaaacaatcctttaaccttttaatccaggcaaaaaagtccacatttccatgtcttcttataatcttttatcaaaaacacatttcactttctctgcataccttgcatgtaaaactgttttttagtagtcaaagttacatgttacaatgttaactcttagcaacttttacttttgatgaaacccttggtaagtaaaggattttaattacgtactaggcgtggagtccaggacacagacacaagtttatataaggtctgactccagtgtattaatagttagggggtgtggctaacttgatgtgtcccaggccttacctagccg

SEQ ID NO: 22410 - DNA, 1044 bp, Homo sapiens
ggttcatgcttttctcctgcttcaacctcccaagtagctgggactacaggcgcccaccaccacacccggctaattttttgtatttttaatagagacggggtttcactgtgttagccaggatggtcttgatctcctgacatcatgatccgcctgcctcagcctcccaaagtgctgggattacaggtgtgagccaccacgcccggcctgttcaggatagcatttattacccaggaagttctggagaaaattattcagagatacctgctttctaggatgctaaagaaaggactacttaaaatcattactaaaaattatagaacatgggagatatcttgaccttcgcatgaaactgattttttctttatggttaaattcagtctataattgactttttgaggggcaatatctcagcagtgatgttgtgttcttctttgtgcatcagcacatcataaaaatttattctagtgttgttgatgttaataatttgcttggttaaagagctctctgactttttttcactatagagttaattgtttttctctttattgttaagtatctttatgtagctaataaactatcacatttaatctggcacctgcccttttttcttaggtttttttgtttgttttttgcacatatgtgtctttggaaaatgaaggctcttatctttgtttacagaccaaaaaagttgggaaaaacacaatctctttcacttactgaatgtctgacaaaatagtcttctggggtcaaaaacattggcattgctagtaaccttgttagaattttaaaaactcagactttattccagatcttctggggaaaaaaaaaaaaagcttcacaacaggatctccagtttattgtacatatttaaatttgagaggtaccatctaactcaacatgtctttttttgtctgaaaaatatacacaactcattatgatgtaaatatagcactcaaaaatgtatacgtttgtgtccttaattatattctttatcatccagaaaagtattatatatgcactggtgttgtggatcttatgccattc

SEQ ID NO: 22411 - DNA, 1066 bp, Homo sapiens
aagactgtgcttgtaaatgacatgccatttttatcttgcagctccattctcttcttgtctgtggtttttgaaattgtgcttatatatgtgtttgttataaatatctttgtgtgtatcctaattgtttgttgagcttcttcattttgacaatattttttctttcagaatttttgagttatattttcttttgatattttttacctttacaatttctgttttttggatattttaaatatttttttcttatcagttttttctggttttctatagttctctgtattcctattttactcattgagtattcaatttatttttaatttttaaaattaatatatacatcttttttatggtttctttctgaaaattttataatatttttgatagaaccattttgccctattttgtattcattgtaatctttgattaaaatttagacattaaataaagctacctgacacagtttttatcttgtagctttctcctggcatagtctgaaaacaattatcttggttagagatcctggtagactctcaaacatgttcttagaatgtatcttgtctaaaattttgtgtttactttttagttaaaggagtttatttctgcttcatcttaatcagtaaccatttgctctgttttctgtctgttgtactgcagtctctctgctgctgtaacaattacctttggtctcaagacccaaactataactccaaaatataccaccatttttttcagcactttatgttacgggagaccagtttctggaaaggcccctagaagcaagtaatatagatgtatgtgccagtattttacttgtttattaaaaaagaaaccaaaagttagcaatttactttgaaaggcagtatgttatattgttgagtaggaagaactgtgttgggcaaaggtaatggacttttctttttcttctgtgtctttgcattcctgtgtactcatctgtgtactcacctggggaactttacatgcttatttataagttttccttatgtattttggtcagtatgcttttattacatttatatgtctatgaaggatttagggcctgtggtat

SEQ ID NO: 22412 - DNA, 1504 bp, Homo sapiens
aaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcacaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaaaccccatctctactaaaaatacaacaattagccggttgcggtggtggtgcctgtaatcccagctactcaagaggctgaggcaggagaatcacttgaacttggggagggagaggttgcagtgagctgagattgcactctagcctgggccacagagcaagactccatctaaaaagtaaaaaaaaaagaaaatatgaactttacagtgaagaatatttattttgaagatgaatgttacaaatataaagtgggtagtagtgcctttacttgtatcacagatcttattgtagacattttttgtagaggaaaaactctgaagcactttcacactttgttcaatatcagggaatttatattgaagaaaaatcatgcaaatgtagtaaatttggaaaaacactttttcaaaaactacagcttagaaaacagagttcatactagaatatatttttgcagatgcagtaaaagttaaaaaaaatttaatccataagtaagtctgtgtaaatatcagaatttatggtagaaatacataaggcactgacaacatcagatatactaaatcagagggctgagtatagaaaattaaagttggtagaaaaattatttgtatataactttaagaggatcagaaggttttttgcagttataattacattcaaagtatactttatttcttgaaaaatattacagattttttgaaaagtgaataatgatgtcattcaactctgaaattcctgccgtttcttcattcctattggattcacatgtgaaagcatgggatcaattattgctgtatcaaagatatgaaagattctttctttgttttgttctgtttttttgagatggagttttgctctttcgtccaggctggagcacagtggcatgatctcggctcactgcaaccttcaatttccagtttcaagcgattctcctccctcagcctcctgagtagctgggattacaggcgcatatcaccacgcccagctaatttttatgtttctagtacagacaggatttcatcatgttggccaggctggtctcaaactcctcaccttgtgatccacccaccttggcctccaaaggtgctgggat

SEQ ID NO: 22413 - DNA, 1031 bp, Homo sapiens
ccggcctcttaatgaatctttatagacaaatctatccaattttaatgtttgaccataaggtagtattctcataaaccttttataactcttcacaaagtccttgttgttagagtagatcagtgctttaagagaagtctgtcatttttatctcaatgttcaatttctagaaaaaataatacctatttaactttagtcagtatgttgacacacagaatctcttttgcaattaaattttagcaaatcttccacaatttgtttaaaccttcagttttattctatctaatctaaaacattcctttaaccttttaatctaggcaaaaaaatccacatttccatgtcttcttatataaccttttatcaaaaacatatttcactttctctgaattccttgcatgtaaaactgttttttagtagtcaaaattagatgttacaatgttaactcttagcaacttttacttttgatgaaaaccttggtaagtaaggaattttaattacatactaggagtgaagtctaggacacagacacaagtgtatataaggtctgactccagtgtattaatagttagggggtgtggctaacttgatgtgtcccaggccttacttagctgtaaaacaggcaagttgtacagtgaacagtcatagtggcattttgagaagtcttaatttaagaggcctaatgacctttaaattgtacaacatttcttgcataaatttccttcagtgaattatttcatgacttatacagaccatctacaatatgtttgggctttctgatttgtcctaaacatccctctttttaaataaccagtcattttactttaggataagaatttactatacaacatcttttcttatataaagtctcttttctttataacctttgtatatgtaggggacatggctaattccatatgtctcaaggccttatttagaatctactggcttcaagataggtaaattgaacaatttttaaaagtcaaagagccaatttatgaccttgaaatatttggtaaatctaatatgtgacctat

SEQ ID NO: 22414 - DNA, 1025 bp, Homo sapiens
attccaatggcttttaaaaaatgttcttgactaattcttgtgccacatactttcagtgctaccttaaaatagaagcattgacaatgggcgcaatatagttttatattggtatctgtgaatttgaaggagcaaacaactccttagcttttataaacaggtttcaggaggtaaagatctttttctgttgtgtccctagggtgatggaatgccctctgggtttgtagtgaagaggggttgtagctttgtcacaaggctgctgggtctgcactagagtccacctttagatggcttgtcacaagggcttgggtaattgtaattcccattttatttttggacagattgtatatattctttaagactttgatctgtagggcagataccagggcagatttctgcagttggctccttatataatggccctatcaggatgtgaatgggtttgcctttcactgaataccagagaggatttcttcaggtcactgtgtgggtttctgtttaggaaaaactgatcatgatctgcggctcagagagctggaactgagtcaataaactgcttcagggaccacagtaaaaaccaaggtctgtaaacctgtctgcatggctgcaaataggtgtcttcctccaggtctctggaagggcaggacctctcttagactgtaactgggaggagtttgggatggttacagagttaatttcagaattctctgttggaccaagttgggtggaccatttcttgatctgtagccaaaaccaagggtcctgtaatttcccacacgaataagtgcctgtcctctgaaaaaacactcctcaatcttgggctttagcagagtttcacaactccctccctgcatctcaaagctctcttaaaggcacttactttggagatgggatcttgtttatcatctggtctggaaatccaggcctgcagcaattctccaacctcaatgtaccatgtagctgccattaaagatgtgagccatgatggctggctgtctcatgaaggcattttttgtcagggatgactg

SEQ ID NO: 22415 - DNA, 1073 bp, Homo sapiens
ctttaagaagccctcaattcttaacagacataagataatttatactggagagaaactctacaaatcagaaagatgtgactacttttgacaacgcctcaaacttttctaaccataaaagtaattatactggtgagaaatcctagaaatctgaagagtgagataaagcctttaaatggttgtcacacttcattgtaggtaagataattcatactggagaaaacgcctacatgtgtgaacaatatggcaaaacttaatgctcacactttattgctaggaaagcatttatacttgagataaattatacaaatataaagactgtgaaaaagccatcattatctgctcacattttactcaacacagagagttcctgcttaataaaagcattataagtgcaattactgtcaaaagatctttcagaaaatataagcttttttagtgaagagtatttattttgaagttgaacatcacaaatataaaaagggttgtagtgcctttacttgtatcacagatctttttgtagacattttcttctagaggaaaactctgaagcagttgatcaaactttgttcaacatcagggaatttatattgaaaaattgtgcaaatataataaatttggaaaaacaatttttcaaaaactacagcttagaaatcaacagttatactagaatatattttttccagatgcagtaaaagtaaaatatttaatccataattaagtctatgcaaatatcagagaatttatggtagaaatatataaggtactgacacttcagatatactaaatcagagtgctaagtatagaaaatctgaaactaaagttggtagaaaagttatttgtatagaactttaagaggatcagaaggttttttgcagagttataattacattcaaagtatactttatttcttgaaaaatattacagattttttgaaaattgaataatgtcatcattcaactctgaaattatttcctgttgtttcttcattcctattggattcacatgtgaaagcatggggttaattgttgctacatcaaagagagagattcttttgtttgtttgttcgtttgttt

SEQ ID NO: 22416 - DNA, 1098 bp, Homo sapiens
ggaaatccatagctaagatgccaggaccccctgaaagcctagacatggtgagagtgctgggtccgacatcacgagagaggggaaggagttgctcggaaccggtgggaagtggctgtggcgggactcaggcctccccgcagtcagctccacaatctgctccctgagttctccttgcccagctcggcctcagtctccttcagccgtaagttggcggctgcgccaacagccggggccccgggcgtcctgtctcttccctgcactgtgactgtgccctgcctggagtcctctctggcagttctgcacccgcagcgccgcgtctttctcagattgtgcggggaccacgggagggtcatcaggggagaatcctgacttggggtgcgggttcatgaatgggaagagctttggtccgtggggttcccagttgctattttctcctattaaaaatttatgggcgtcactgcaaaaatattaaagaatgtaatcaaagagtggttctagaattgtagagcacccagctatggtttgtagtttgtggtctgtgggagaggcttgaaggaaagtcttttataaaatgcatgatgaagaaaccaaatttactaattggttaggtacagttacatggtttcttaatatgtgcgttaaaggtgaaaatttcctggttatgtaatcagagcttaattggcagtttacagttgctgaagcctgaattttgtttctctgaatgtagtaattaaaaataatgcacctgagttagattttttttttaaagtaagaattcagggactagaaatacctcagtctaattgcctgccacttaattattttcacactccacagggaactgattttctgctgtatttttcacctgtgtcccaagcagagtcttggaaccaatcccccatttctccggcctcactctggcttgcagtaagataatttccagtttcctctgacgttcctaaatgccaccttttcctccctaattcacattatcgcctatttgtcttttactgtacttttttataccatattttaattatttttttggcaaagcattaaatggttaaatggtgcatttaaagagatttgttatctgtt

SEQ ID NO: 22417 - DNA, 1605 bp, Homo sapiens
tggtggcacgcacctgtagtcccagctacttgggaggctgaggcaggagaatggcttaaacctaagaggttgaggttgtagtgagccaagattgtaccactgtactctggcctggtgacagagagagactccatctcaaaaaaaaaaatgtaagcaccttaaaattttttttcccgtatgtgaacactgtgtttcagtaattttgctgaattttttaaatacttaatttcaaaaaccaagtgagtaactctaacgtgaaaattaaaggttgagcccagtgactcagagctaaggctaatactgagcctgcaaaaggagtttattaaaggcctagttagttttttttctggagagcctcccctgcagatgttccagcctgctcactccagccatggaagaagcctttctgctgacagaagctacagagtcctggaaagctacaggcagatgcagttaaggttaagataaaaggggacagggagggtcatactgaccatgtagttgttattgtacatcagggatgctatgatttagtatcctgaaactttgctgaagttgtttattagtttaaagagcttttctactgagactgtagggttttgaagatacagaatcctgtcatctgcacacaggaatagtttgacttcctctcttcctgtctgaatgccttttatttctctctcttccctgattgttctggccgagactttgaattctatgttgaacaagagttttgagaaaaagcattcttttcttgtgccagttttcatgaaggaatgcttccagcttgtgttcattttgtatgttggctgtaagtttgtcatacttagataactcagtattttgatgtatgtacctccaatgcctagttttttgaaagttttaaacatgaaggatggtaaatttcattgcaagcttttttaacatctactgaaataaccctgtggtttttgtctttagttctgtttacttgaggagtaacatttattaattgcatgttgaaccaaccttttatttcagagatacagccaagttgatcgtagtggattagctttttgatgttctcctggatttggttttccagtattttcttgaggatattttcatcaatgttcattaaaaatattggcctcaaggtttctatttttttgttttatatttgccaaattttcatattagaataatgctgtttttacataatgggttggaaagaagtccctttttctcagtattttgaaataatcttagtaggagtggtaccagctcttactttacatctggtagaattcagctgtaaatttgtgtggttctttgttttatttttggtgggcaggctatttatttatttatttattttattttattttattttttgagacagtctcactctgtcgcccaggctggagtgcagtggcacagtctcagctcactgcaacctccacctcctgagtttaagcaatgctctgcttcagccacctgagtagctggaattacaagtgtgcaccaccacacccagctaatttttgtatttttagtagagatggggtttcaccatgttggccaggctgttcgctgttcttgaacttctgacctcgtgatccactc

SEQ ID NO: 22418 - DNA, 1035 bp, Homo sapiens
ggagtctcgctctgtcacccaggctggagtgcagtggcacgatctcggctcactgcaacctccacctcatgggttcatgccattctcctgcctcagcctcccgagtagctgggactacaggcacccgccatcacgaccggctaattttttgtatttttagtagagatggggtttcgctgtgttagccaggctggtctcgatctcctgaccttgtgatccacctgccttggcctcccaaagtgctggggttacaggcatgagccaccatgcctggccctggccagctatttattactaattcaattttggagcttgttactggtctattcagggattcaatttcttatttgttcagtctttgcaggatgtatcattgttccaaggttataatcctcaagcttggccctgacgaactctctaattatattcatgtttcctcagttttttccttttaggtagacatattaatagaatgggctagaggagcctctatgaagggatctctcctttgattgtactctgcttgctgtaacacccaagaatgcagagtcaggctaaccccacttagaatctgcacatagggtcaggcctctgcctgggatttacaagacagggccagactttcaattgtgaatgtaatgaaaaccaacaaaatgcattttctgcattgtgagatgtcaacatagacatcttaaagcccccctttgagagtgtggctttttaagcttttcagatcttgtttagtgacctgctacagttatatgagaggctccaggtataaatagaatctgatgacagaatctataagtgtaaacaagcatcttaagagtgagggataaggccacaaagtatccagagctatgaccacaactatacctacctgtaaattgtaataatggagtagagtattcttgtccttcttacccaaaagctagcacatcaggataggtgatccaggttctggagttccaccaaagcagttccattttctatttagaatcagcatgaatctctctcagcctggcttatcactgg

SEQ ID NO: 22419 - DNA, 1094 bp, Homo sapiens
atgaagagctgtgtccactctgcctcctggattgccatgcgtttagtccttgcaaacctttacttccctacttgtgtttctttcccctaatgagtttgttttaactactttagaaaattcttgtgatagtcaagggtctctgcaaaatatctctctcctatatcccagaaccttctctacactctctaaatcatggcttcttatacgccatgcagaattcttaaaatgaatttataatctgcactacttaaaatgttccctttgttgccattgaacgtgggaaaatgtagatattcaagattcccattggcggaaagctggggtccttagtaaagataaataacatgtaatgttgtggtttcatctgttttctccattaattctatgcagaacaggattaataaaatgcttatttaaacaggatggtgtttattaccctgaaagttctgaaaaaaagttattgagagatacctgctctctcaggtgctaaagaaagactactttaaaatgttattaaaaattgcagaacatagaagatatctgcattttgaactctgcataaaactgatttttctgtatggttaacctcagactataatttactttttgaggggcaatatctcagcagtgatgatgtcttcttctgtgtgcatcagcacatcataaacatttgtcctaatgcagttgattttaaaatttacttaaaagagctctctgaaatatttatttcactatagagttaattatttttctcttcattattaagtatctttatgtagctaaggaagagctgtgcataaaccatcacatttaatctggcagctgcctttctttgttaggttttccttgcatttatctgtctttggaaaatgaagactcttatctttgtttacagggcagaaaaattgagtaaaacacaggatcttccacttactggatattgacaaaatattctttctgggccaaacacattggcattactagtgaacttgttagaaattcagaaactcagagtttatttcagatcttctgggaaaaaagaatctgcacaagatctccagtttactgttcacattaaaacttgagaggtgcct

SEQ ID NO: 22420 - DNA, 1050 bp, Homo sapiens
catttcaaatgctctttttctatatgtgtatcttttctgatgaaaattttgttcaattatttgctcatctataaattaatttagctttattgttcagttttaagagttcatatgttatgaatattaactactatcacatatgatttttgaattttcttaatgtgcggaaattttcaagtatagtgtagttacatttttctgtttttttctttgttgttcatgcatttaatatcatatctaagaaaatggtgccaagactcatattatttcttttttctaagagatttattactttttcatgtctaagtttttttgtttttgtttttgtttttgttttttgagatggagtttcactcttgttgcctaggctggagtgcaatgggatgatgttgggtcacggcaacttctgtcttccaagttcaagcagttctcctccctcagcctcccaagtagctgggattacaggcatgcatcaccatacccagctaattttgtattttttgtagagacggtttctccatgttggtcaggctggtctggaactcctgacctcaggtgatccacctgccttggcctcccaaagtgctaggattacagacatgagccaccacccctggcctcatgtctacggaatttttttgtaaattttgtgaatatagtttttaaaaatgatgtaactgtatttcatcagtgttgatgtttttaacattattttttgagaaaattatcttttctgtatcgtgtgctcatggcaactttgcaaaagatcatgtaatcatatacagaaggcttcatttctgggctctctgttctgttctttcatctttttatctttgtgtaagtatcacactttttgttattgtagcttttaatgtgttttgaaatcagaaagtataatgtctctctgttcttttttatgagtgttttgctagttatagtttataatcaaattataaaatgttaagcaggttgggtgcgctgtctcacacctgtaatcccaacagtttgggaggctgaggcgagcagattgcctgagctcaggagtttgca

SEQ ID NO: 22421 - DNA, 1050 bp, Homo sapiens
acacaagataattcatactgataagaaaccctacaaatgtgaagaatgtggcaaagcttttaaccgatcttcaatccttagtatacataagaaaattcatactggagaaaaaccctacaaatgtgaagaatgtggcaaagcttttaagcggtcctcacacctcgctgggcacaagcaaattcatagtgtacaaaaaccctacaaatgtgaagaatgtggcaaagcctttagtatattctcaacccttactaaacataagataattcatactgaagagaaaccctacaaatgtgaaaaatgtggcaaaactttctaccgattctcaaaccttaatacgcataagataattcatactggagagaaaccttgcaaatgtgaagaatgtggcaaagcttttaaccattcctcaaaccttattaaacataagctaattcatactggagacaaaccctacaaatgtgaagcatgtggcaaagcttttaggcggtcttcacatcttagtagacataagataattcatattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataaaataattcataaaggagataaattatacaaatgtgaagaatgtggcaaagcttttaacaaatcctcat

SEQ ID NO: 22422 - DNA, 1055 bp, Homo sapiens
gcaggatggacatctttacagtattacctttttcagcctttcacaagagcatgctcaagagtgtgttgtttaatttctatatatttgttaatttttcagattttttttctcgttgtatactcatttcattttggtgatagaaagtaatttataaaatttcagttttaaaaaaactggtaagacttaattttcttctttttgtaataagaggaggtctatcaaggaaaatgttgtattagctattgagaaccatgtgtgtcctggtgttgaggggtgttttctatacctctgttagaaataattgtcttacactgcctggaagtcctctattcccttactaatattctcatttaatttttattacggaaaatgcagtgtcaaaatatcctactataattatgttgctctctatgtgtctctgttattctgtcaatgtttgctttatatgtttggagccctaatgtgagatacacacacacacacacacacacacacacacagagagagagagagacgtgtatacagatttgtcataggttcccagtgagtaaatctgaagtggtttttttttgttgttttttttttttttttgagacagagtctcactctgtgtcccaggctggagtgcagtggtgtgatctcggctcactgcaacctctgcctcctaggttcaagcgattctcctgcctcagcctcccgagtagctaggattacaggtgcccaccaccatgcccggctaatttttgtatttttagtagagtcagggtttcaccatgttggccaggccagtctcgaactcttgacctcaagtgatccacctgcctcaacctcccaaagtgctgggattacaggcgtgagccaccatgcccagcctaaatctgtaagttttaatgtccttttttgtctccttggagttttaacttcaagtacattttgtaaaatatgatagtttttgacttaagatgtagcttgcataatactatcttgatttcttctgctctcatttgattaatatttgcatgaaatgtattcttccatcttgccccttttagtgt

SEQ ID NO: 22423 - DNA, 1046 bp, Homo sapiens
ctaaaaaaaaccaaaaaacaaaaattagcccggtgtggctgtgtgcacctgtagtcccagctactatggaggctgaggcaggagaatcgcttgatcccggaaggcgaaggttgcagtgagccgagatcgcgccattgcactccagcctggacaacaagagcgaaactttgtctaaaaaaaaaattattcacatatttaatacgttgaaaaaaagacagcaaagaagagagaaaatttttccgtgttctgagatgggcctcgttcagctccgggaggaagccccgcctgaaaaggctgaggcttaggctgtcaatctttcttcattcagcccaacgtctgatgacatcttctgtcactcagggccttagaaagcggggttcttaaacgttatccaatcagagacgctgtcctgggaactgtccaatcaggcacgcagctggagcgaacagggcggcttccgggatttggcggggcctttgtctctatctgcggccggagctccaggtctcgtcctcactactctgtgtcttctgcttttaggggcgcagcctctgtggccctgtgacctgccccctggaagcctagaaatggtgagagtgccgggtgcgacatcccaagagagggaacggggctggctggaaccggtgggaagcggcagtggcgggactcaggcctcctcgctgtcagttttacaatctgcgcccgagttgttgcccagctcggcctcagtcccttcagccttaagatggcggctgcgctgacagccgggctcccgggcgttctgtctcttcactgcgcagtgactgtgccctggcctggagccctctttgggcagctctgcaccagtagccccgcgtctctcccagattgtgcagggaccatgggaggaacgtcagggcagaatcctgactccgggtgcgggctcatgaatgggaagagctttggtccgtggggttttcaggccattttttcctattaaaaatttatgggcctcactgcaaaaacattaaataatttaaagtgtgattcaaaaattttagagcacc

SEQ ID NO: 22424 - DNA, 1029 bp, Homo sapiens
cattatttaacttgagaagattatgagagcccccagtttataggaactggctcagaagtatagatgagaccctaggaattgtgactgggatctgcagtggtggcagtgttgtgggactgagccctgaacttgtagggtctatgctgactcaaggaggtatcagaattgagttattggacaaccagttggtgttggagaattggttgctgttcagcaaactccacacatttgttgtcagaaaaagaatatcacagatatttgagctggagggagactcttggtttctctgggaaggggaactctgttctgcacacaggctgtcacaatgcacattgtcctgtgattccagatctcttcccagggtgaaaggggactgagggcttggaagaaagaagttctgaaaacagactccctgccctcaacctgctaccaccaatgatttccgcctactaatgaacatacccactaggaatgggtgtggccagaatcttcacaaaacaagaagacttgatctgaggaattactctatagtggctttacctctaaaatttctcaccaaagaattacacaagtgcctagaggactcctggattatccctaccacaaaccctgaacctgaagcagcaacctggtctctctatcaccctgggcttgtggactaccaatcataatctcatccacctgcatggacacaggaatatgtcagaacataaccctgcctgaatcagtatctgtagcataaaccagtctttccagctaccatgcactgtcccccactcacgggtccttgatagcacctttccctcttctgtcttttgcttttctacaaaccctttctgatgtgcacagtgtgcctcaggtgcctgaatccagcacctactgggagtcagatgtccatgagttcaagattatagccctagacctggctgtcataagaacagacaaaaattagaaatacagtcttcatccttgaaaataaaagatttttctctttccttttcttaaagcatttactttagaaaacttttg

SEQ ID NO: 22425 - DNA, 1037 bp, Homo sapiens
cccagtgctgatttcttctctgcctctccttttttaggttctatttttttcatctttcatctttcctttttttttttttttcccttgagatagagtcttgctctgttgcccaggctggagtgcaatggtgcaatcttggctcactgcaacctctgaatcctgagttcaagtgattctcatccttcagcctctgaatagctgggattacagttgtgcgccacgatgcctggctaattctttgtatttttttttagtagagacagggttttgccatgttggccagtctggtctcgaactcctgacctcaagtgatcctcatgcctcggcttcccaaagtgctggaattacaggtgtgagccactgtgcctggcctcctttcctattttcctatttttttctccctttttgtctctctctttctatgtgtctttccctctgtttctctcttccttttttttgttttgtatttctctcttcctccttctctctttccctttgtttctttttaattttttttccttgtagaacttggtttattttttccttccttcctacctttctttcttcttttcttccctcctttcctcccgcctgttttctttcctactacatgagcatgccatcatgcctggctaaattttttatttcttgtagtagagacgaggcctcgctatgttcccagggctggcgtcaagctcctgtgctcaactagttcttccatttcagtttccccaagtgttgggattataggtttgaggcaccatgttctgccctctttttattttctttttcattcttcctttttttttttttttttttgctctctctcttgcttgcttgcttctttccttcatttctttctttattctacatttttctttttttcttttttcttttctttttttttggagatggagtttcactcttgttgcccagcctggagtgcaatggcgtgatcttggctcaccacaacctctacctccctggtttaagtaattctcctgcctcagcctcccaagtagctgggattatagaca

SEQ ID NO: 22426 - DNA, 1046 bp, Homo sapiens
ccgcctgagcccagcccccagaaaggattgtgacatatcgttggacccagaattgaggtaatgtaactattccactgccttggcactgcccacagaagacattgtgacatattgctgggtcttgtacccaggtggtgtgaatcttctctcctgccttggctcttccacagggggcattgtgtcatatcgctgggccccacacataggttatgtgactcttctgcctgtgccctgcccatgtggcccattgtgacatactgttgggtcccaaacctaggtgatgtaactctactgcttaggccctgcctacagaggacattgtgacatatccctgcatccatcacacaggtaatgcagctctcttctgcttggcccctactcacagaaaggattgtgatgtatcacagggctcagcacctagctaacatgacttttctcctcttctaggtttttgcccacaggggatattgtgacatgtcactgggcctaatactagggtgacagtactcttgtgtcatggcactgccctcagcaggtgtggtgatatattactgggcccagaacaaatgtgatatgagtctcctgcctggaccctgcctacaaggtgcattgtaacatatctggggccctttgactattttattttatttattgtattatattttatttattttaattttatttttgagacagaatctcactctgtcacctaggatggagtgcagtggcgtgatctctgctcacttcaacctttgcctcctgggttcaagtgattctcctgcctcagcctcctgagtagctgagactacaggtgtgtgccgccacgtctggctgatttttgtgttttcagtagagacaagatatcaccctgttggccaggccgatatcaaactcctgacctcagccagtccacccgccttgacctcccaatgtgctgagattacaggtgtgaaccattgctcttggcaccctttgactattttatgtgactcttctctcttacctggacattgaccaaatgggcccagcaccaaggtgatatgact

SEQ ID NO: 22427 - DNA, 1031 bp, Homo sapiens
gggaccttgtgacatatatctgcgtccatgacctaaaaggtgacacttcttgcctgcactgtgccctgaacaggaaatattgtgacatatccctggaaccagacaccaggtgatatggctcttctgcccctgtcttgcccccagggagcattgtgacatagtgcttagctcagcacccaggtgatgtgactctgttgcctgtgctgtgctttcaggagagaattgtaacatatccctggctgagcacccaggtgatatgacactcctgcttgtttccttccctcggggaagattgtgagataccttggctgaaatcccaggtgatgtaactctcttgctaactccctacctacaggttaaatggtgacatatactatagtcagcttataagtggaatgatgactctcatacctctagtcagctattggaagaaatactgtctctcatagctcgacttagataaatgagtcacttccttggtcttctctttttatgaaggtcataaagaattgccacactctaacatattgtataatgccctcgagtgttacaaacgtgttatcccagggcacacagcacaaaggtgagattgtttcttatatgcacacctcaccaattattaggattatcaccctcacacagggaaagagcctatggctgaagtcttgaatctcaaatgcaaacagaatctcaaatgcaaacactgtccacagttggaattgtgactcatgtatgagcctccaaccacagttgagatggtgacacatttctaaactcagaacatagcagatgaggactctactctcttaaacccaacaaattaagagagatgttgactaatacctgggcttagggccacaagtatggtcatgggtgcttacaaacatgattttagagtaaattgtgcctctcatttatactggataaagcctttgagtagtatagtgtactaaccaggcgcagtggctcacgcctgtaatcccagcactttgggaggccgaggtgggtgaaacgaggtcaggagttcaaga

SEQ ID NO: 22428 - DNA, 1024 bp, Homo sapiens
tgggcccagcacgtagctgatgtgacaatttttttttgggttctgctcacaaaagagattatgacatgtgattgtgcctaacactaaggtgatgttactttttttttttttttgctttggctctgcccttagaaggcattgagacatggctgggctcagcactaagaagatgtgagtcctctgcctgaagcctgaccacagggagcattgtgacacatttcttgacccattacaatctcttctacgggcaaagctgaggtaaatgcccgttttacctatgtgatgtgacattcctcttctgcctgggccatgcccacagaatagagtgacgtattggtggggcaagcaaaacagtggtgtaattattctgcctggtccctgtacacaggagtcactgtgatacatgtttgggcctcccacctagatgatgtgacttttttcttctggagtttgtccacagtgggaattgtgatatgccacgtgacatagctcctatgtgatgtgactctttctcattcttggcctctttccactggggttactggaacataaagctgagcccagctcctaggctgtgtctctcctttctaagccctacccacaaaggacattgtgacgtatctctaggcttctcacctaggtaatattacttttttacctaggcccacccctcaggggtattgtgaaatactgctggaccaacatgctagatgataggagtctctgctactgcttggggtgtgattaagaggaaattgtgatgtgcatttgggtgcatccagcacctaagtgatgttaactctcctcttgtgcctgagacctgcatgcaatatgtgtttttgtgttttttgtttgtttttgagatggagttttgctccttttgcccaggctggattgcaatggtgcaatctcagctcaccacaaccttcatctcccaggttcaagcaattcttcagcctcagccccctgagtatctgggattacaggcatgtgccaccaagcccggttaatttttctaattgta

SEQ ID NO: 22429 - DNA, 1024 bp, Homo sapiens
aaatgtctttgcaccaatcctacaggtgatgtgactctcttgtgttacctggtctctgcccccaggaagaattgtgacctttcacagcgtatagctaatttttttcttttatttcttagtttttctcctgcaggaaagattgtgaaatattactgaactaagcaccaaagggatatattttttttcttggacctgcccatgtaagaccttgtgacatattgctgggccctacacctagatgatgtgagttttctgcccgtcaactattttatgtgactctcctctcttatcttcactttgtccataggttagcttttaatatacctttgggcctgggtcatgctaatagaagcaagagtgacttattgttgggcccagcacacaggggatgtgattcttctgcttggttcctgccgaaatggtcattgtgacatatctatgggtcagttggctaaatgacaggactctttttatctttctggagcagtccacagtaggaaatttgacatatcgctgggcccagcacatatctgatgtgactctcctctcatgccaaggccttgcctactgtagtgattgtgccatatagctgggcccagctcctacgttatctgactcctgttttcttcctgagccctatgaaaagattgcattattaaatatttctgggtcttttacctaggtgatgtgacttttctttctggcttgtcctctcagagggtattgtgacatgttgctgaatgcagcatttaggtgatacgacccttcctctactgcttggactctgaccaaaaagggattgtgatgcatcactgggcccagcacctacgtaatgggactcttttctcttgcctggaccctacaaatattttgcattgtgacgtgtagctgggtctgccacccaggtaatgtgagtcttccacataagccctggccacaagagtattatgaaataactttttattcatcacctaggtagtgatgtgactcttcatcagcctgtaccctgccacaagggaattgt

SEQ ID NO: 22430 - DNA, 1018 bp, Homo sapiens
ttctattgagaaccatttgtccctcctccctacccttctagtcccactctgtacccaccactccctgaagaacttagcccagtgagtactactcatagtggagctgcctatcaacctccaaggggaaatctttgtccacctacagaggttgcaaatggggaagaaggcctgtgagaggaggtgtccccttttctctgtctggtttggctctataataagacaagtttggtcatttctctgaagatgcaggaaaattcataggtgagtttgagaagttaactctgacctacagtttaacatggcaggatctgtacattttgttgtctctgtgttatacagtggaagaaaaacaatgcattttggggacagctaggactcatgcagatgaggtattggcttgcaacccgaaccataatatatatcagacaggaggtatagcagttccagatcaagatctagagtggaactatcaaagggggtgtgaggacttggaagaagagatcatatggtcacttgtttgttgaaagagatgaagaaatgtatgaaaaaacctgttaacaatgaaaaggttaagcaactttctcagggcaaagatgacaatccagctttgttttaatagtgtttagttgaggcaatcagaaaatatactaacactgatcttgcctcaatgaaaagatagacccttctgggagtacattttataacccagtctgcccctgatatccatagaaaactactaaaagcagctatgggtccccaaacttctctggaacagctttggatatggcatttttagtttttaataacagggacaaagcggaggtagcggaaagaggaagaaggacctcccacaagttgcaggtcttggttgcaaccttaagctaacctcccacatggggttgccctcctgggtcttgggttgaacaagggaagctgaaaggtgggaagcctaaacctgggtgtccgagtcactgtgccttgggcataaatcaggttgcacactgtaagaaaactgacc

SEQ ID NO: 22431 - DNA, 1096 bp, Homo sapiens
agtaaaaatacaaaattagctgggcgtggtggcacatgcttgtaatcccagctactcaggaggcttaggcaagagattcacataaacccgggaggccgaagttgcagtgagctgagatcatgccactgcactccagcctgggcgacagagtgagactccttctcaaaaaaaaaaaaaaaagaatattaactttcttctggactgcttactctgttttgacccattataatgggtctgtttcacccccaaactgtatggtcacggggatagattgacaagcccatagatgccattttacataatctctaagctgtttttcagtgacttcggttttcttacataacttccttatcatgcccggatgcctcagggaagtcgtagcaatttctctttcagtagataaagccaataaactggctttagaacaacattctgaggtttaagcccacaccaagtatgaggagttctataagccaaaagacaccagtggatgacaggggacacttattgaaatagcagacattttgctagacactccaattaacctgatatgaggtgctaatcaataaaaaatagttaaacatttgcatgactctactcatttgggaataaattccctgtttaatatctcggctttttatagaaaaataattacttaaaagagtaaaccaggtaacccaggcctgtgaactatatgcctggaacaacccaaatgaccaatgtttacctcctcctttagtaaggcctgttcagcatagaggagcataccctggtgaagactggcaaatagactatactcagatgcccccgtgtaaagggtttaaatattgattagtattcattgacacctttaccgtttggattgaggcttttcctaccaagtctgaaaaggcaatcaaggtttctaaactactaaaagaaataattccgatgggtacagtatctcacgcctgtaatccctgcacattgggaggccaaggcaggtggatcacctgaggtcaggagttcgagaccagcctggctaacatggcgaaaccccgtctctactaaaaatacaaaaattagctgggtgtggtggtgtgcacctgtagtccta

SEQ ID NO: 22432 - DNA, 1047 bp, Homo sapiens
cttggccatcgaaagtgctgggattacaggcgtgagccaccgcgcccagctgatggatttacttataacggtttatcaaattagctttagtgctgataatacattattactaaagtaaaagttgattttctcttgaacaaaaattatatgtattattaatatacataaaatatgtttgttcacattttgaatacattgaaaaagagagagagcaaaaaagatatagaattttcccatgctctggggtgggcctggctcagctcagggaggaagccctgcccgataaggctgcagcttaggctgtcactctttcttcagcctagggtgtgatcacatcttctatcactcagggtctgagtaggcggggccttaaacgttatccaactagggacgttgggctgggaactgtccaatcaggcacacagctggactggacaaagcggcttccgggatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatggtgagaatgccagtccgacatcccgagagaggggagggggctggttggaactggtgggaagcggctgtggcgggactcaggcctccccccagtcagctccacaatctgcgcccagctcgacctcagtccccttcagaaataagatggcggctgcgctgacagccagacccccaggagtcctgtttcttccctgcgcagtgactgtgccctgtcctggagccctctctgggcagctgtggacccgcagccccgcgtctctcccagattgttcagggacccggggagggtcgtcaggggagaatcctgactcgggttgcgggttcatgaacgggaagagctttggtctgtggggttcccaggccctcttttttcccattaaaaatttatgggcgtcactgcaaaaatattaaatactttaataaaagaatgattcaa

SEQ ID NO: 22433 - DNA, 1056 bp, Homo sapiens
ctttcagtgctatgttaaaatagaagctagttttgcattagtgtctgtaaatttgaaggagcaaacacctcttcaagtttctataaactggtttcagaaagtaaaaatgtgtttttgttgggcccccagagtgatagaatgtcctctgggtttgtagtgaagaggggttgtagcttggccttaaggctgctgggtttgcacaagggtccaccttcagttgtcttcttaaaaggagcttggatagttgtaattctcatttaatttttggacagattgaatatccttcaggactttgctgtgcagggcagacccaagggcaggtttctgcactcaggcctgcatatggtgagttttatatcaggatgtggatgagcatggctttcactgagtacaggagaggattttccgaggtaactttgggtttctacataggcaaaaccggccatgaactatggctcagggagctggaactgagtcatggaactgcttcagggaccacagtaaaggtcaaggtctgcaggcctgccagcatggctctaaatgggtgtatttctccaggcctctggaaaggcaggacccccccagactgtgactgggaagagtttgggatgtttacagagtaagtttaaaattctcaggggaaccaagttaggtggaacaatttcttgtctttagccaaaaacagtagttctgtagtttgccacctgaatgaggacctgccttctgaaaagggttaccttcagtcttgggctttagcagagtttcacaactcctttcctggatctcagagttcttttaaaggcatttatttttgatctggggtattgtaacataacccaggcaggtcttaatattttgatcaaaagcaattctccaactttcatgtaccatgtagctgtcattacaggtgtgaaccatgatgcctggttctctcataaaggcatttttgtcagcaatggctgacaaattttcttgctgacagaggataagcaaataaggcacctttaattttttatcttattaatgccactctccatataaattttaactgttttc

SEQ ID NO: 22434 - DNA, 1045 bp, Homo sapiens
gtgggatggggggatgggggagggatagcattgggagatatacctagtgctagatgacgagttaatgggtgcagcacaccagcatggcacatgtatacatatgtaactaacctgcacattgtgcacatgtaccgtaaaacttaaagtataataataataaaaaaagaaaaataaataaagttaatattgttatgtgtgaatttgatcctgtcgttaggatgctggctggttattttgctcgttagttgatgcagtgtctttctagcctcgacggtttctacaatttggcatgattttgcagtggctggtaccggttgttcctttctgtgtttagtacttccttcaggagctcttttagggcaggcctggtggtgacaaagtctctcagcatttgcttgtctgtaaagtattttatttctccttcacttatgaagcttagtttggctggatatgaaattctgtgttgaaaattcttttctttaagaatgttgaatattggcccccactctcttctggcttgtagagtttctgccgagaggtccactcttagtccgatgggcttccctttgtgggtagtccgacctttctctctggctgcccttaacattttttccttcgtttcaactttggtcaatatgacaattatgtgtcttggagttgctcttctcgagaagtatctttgtggcgttctctgtatttcctgaatctgaatgttggcctgccttgctagattagggaagttctcctggataatatcctgcagagtgttttccaacttggttccattctctccgtcactttcaggtacaccaatcagatgtggatttggtcttttcacatagtcccatatttcttggaggcttttttcaattctttttattcttttttctctaaacttcccttctcgcttcatttcattcatttcatcttctgtcactgataccctttcttccaggtgattgcatcagctcctgaggcttctgcattcttcatgtagttctcaagccttggctttcagctccatcagctcctttaagcacttctc

SEQ ID NO: 22435 - DNA, 1036 bp, Homo sapiens
gctgggattacaggcatgcaccaccatgcctggctaatttttatagttttagtagagacggggttttgccatgttggtcaggttggtcttgaactcctgacctcaggtgatcggcccaccttggcctcccaaagtgcctggattacaggtgtgagccactgtgcctgacctggcacatcagttttatctggcagcttcaaaggtaatctttttgtctgtgacttttgaaattgtgcttatgtatgtgtttgttataaatatctttttgttattctagtttgtttgttgagcttttttatttttacatctttttttttttttttacttttaggatctgtcagtttttttgtgtatattttatctccacaatttgttttttgatatcttaactattttttattcttgtcctcatttttctgattttccatagttgtttctgttcccattttaatcagtattattcagtttattaccaattattaaaattaatgtatacatcttttttatgatttctttcagaaaattttgtgatatttttggtgggattgtattgccctattttgtatatattataatccttgattaagatttagacattaaaaaaagctacttgtcaaaatcttataatgtagctttgtcatggcatattctgaaaacaattgtctttgctggtgattatgagagtttcttaaacatattcttaggatatgtgttgtctgaaattttatttttattatttaattaggagagattactcgttaatttgtagcgtcatcacttgctacaccttttccatttctgtggtactgcagtctctctgctgctgtaacatttttctttggtctcagcagactcaaactctcattccaaaatataccaccatttctttcagtactttatgtcatgagagacagaaaccagtgtcaggaaaaaaccctaaaagccagaaatggcaatgattgtgccggtattttacctttcttttaaaacagaaaccaagagttggcaatttacttgtaaagacactatggtatag

SEQ ID NO: 22436 - DNA, 1024 bp, Homo sapiens
tgatctagcagatagactctttattcagtatgtgagagtcatttacagactggggacataaattagaaatgatgagctggatgtcttttagggtgaaaaattactaaatttctaatctatgttactttttctatttattctctctgttacataacctatgatacagacagaataataatataattctgatacatggttaatgaataattccacatatatatgtgatttatatccaaatattgctttacttgtagtggtttgttaaccttctaatgtggagatcattgagcctttccgtgagtattctcctggtgtttctcctgagtgccacatggcaacagattttaactgagctgagggcccaaatgtgcattgttgagaactatcaattgcttggttctggaagttgaaataaatatgtccctttattagattaagtgcttgaagaaaaagtaaataagatactgcaatttctccctataaactcatacatatcaggtatgcagtttcttctgtataaactcatacatatcagatatgcactttctcctttataaactcatacgtatcaggtgggtttagagcaatattctacctcagccattattctctgagtacaagccaagaatgcaaactgtcacatgatctgtattgccttgcatatttatgcttacgggccagagtagttttaactgacgttgaaaacagttgaacactcttacatctcacgggaggaatagagtgaatataaaagatttttctcagcattttacagctgaattgttctacatccagtattaaattgatttaataaaataatactgccagcatccaaagaagataccatgagaacaatttctgaattattcagtacaatttcataataatattttcatacggagatctctcaattaacatatgagagaaattgtctttattatttgagagcaaagtatttttgaagacatgagtgggtatctttatattaagtgaagtcttaagaaaaagatccccgtgtgagcat

SEQ ID NO: 22437 - DNA, 1052 bp, Homo sapiens
gggtctgggaatatatcagtgagggaggtggaacacaggttctagctgggtcttgggaaagtgaggaggaagcacgtggacaaggcagggctccagaggcaccagagggctcatggcttctctttgttctcgccaccactttcactggggcccaggagctgagttccaagacttggggaatagtggacttctggggcaaagtggctgatgcaccaaaacatcttttaaagaacagataaagaacagaagcgtacctgggagagctggctgaaaccaggacacggtgggaccattggaaaggactctaaaccacagcagcagaaggagagctagacttgcagggacccaggctccacactagggacctcgaccttgtcctgcagggagtggagacccatgaatggatgttaggtgggtttggtttgcacatagccttggtgtatgttgatagtgttgtaactgatgactaaccaggcctcacatttgcagcccacagtgccttgcatacaggagatcatcattcttctggtcctatgccatgtgattgttactgaggaggatggagatgacatcatctaccacgcctcctccccaggtgagggctgtggtgagatgcatcctgccagaccctcctcaggagacaagggtattggcagttattcgtgaatgatgcaatggtgccacctctgccacagactcagctgtctgcccctgccctcataccatgaccaggctgtgactacaggtgttagagctgtagagaactgggactgtgctctcccgactctcctaacgctgacaacagagggaggacccaggctgtcttgcatttcccagcagtggctattgggctaagtaagtctctgaagagagagcagggcaagcttctgtcatcccctagcccccaggagttttccaactgctgtggaagctgtgtatgaagcactctccccactttgtgtggctctggcagtcccacagcacacgactaaacatggccttgctcagaggtgacatttggtcagaaagttgtgggaatactacttaggtta

SEQ ID NO: 22438 - DNA, 1211 bp, Homo sapiens
aggcggaaaagaccccaggaagcgagcccactcctccccactgctcagcaacaccgcctacgacgttctcagtagccgaatccctttccaggcgcatgcgcccccgaggtgggcgagcgccggtgatgtcacgcatagcgccatctccgagctccgagagtctgcgacagcagctgccagtgcgtcatcagagagcgccggaagcggtccgagaatgaagagtaagcggggccgcgaagttggagagggttggggacgttaagggtcggggtcttggtactggtgggtgaaatgggtccgggctacctgttgctgcggagtcctaacagaaccgctacaggaatgggcccaccctacctaagaaaaactgagggctggagcacgggttagcctggctcgacctctgagctagggagggatgtcagggctggaggcaggttctcccggaggctgctcagtggtgtgcgatgctagaggagggttccaggccttggctcaacttggccactatctcccggggtgaccgcggtcaagatcctgctcctttctgcgagctggtttcacactcttaacctgatgcaaagcgccgagagctgctggggaatgatatcactaacccaaagctttggtccttaggggtagaagacatgtgccaaggaggggcgtgtagacaccgttaagactgggccttcaatcagaatttttatttttcatctctgccactttctacctatatgatcaagtagattgtctcggcatgtctgagcttcagtttgctcatgcacataagtgtaatgagaaaaaatatgtgtaccttgtaatgaggtttctggcaagtaatggatgttcagtaattgttagatgtgtattgttgcagaaagacttccaagtctgttactaagcacctgtaacagatgaagcaaagttatcaggccccgcaagttgctctctacagtttataatccccatcttccatttgagggagaactagatgctatatataaaacttgcaaccacattggtttgcttgatcaaacaaacatacctggctgggtgtggtgggacacgcctgtggtcccagcactttgggaggctgaggcagggggatcacttgaggccaagagttgaagaccaacttgggcaacaacatagcgagaccctgtctctacaaaaactggaaaaaaaaaaaaagaattagccaggtgtggtgg

SEQ ID NO: 22439 - DNA, 1063 bp, Homo sapiens
attactcagttatttacactggttgttcagaccaaaaacctaaacagtgtctatgtttcttctttcctaatctcctcgaatccttcggaacatcctactacttaaattcagccactgtcattccccagattacctcagacacagctcctcaccgcaccaggcagccagagtgccggttacgtagaaatcagagcacgttccttccctgcttcaagtcttctggcagcgtcccatcgtatgggagtaaacctgcctccttgctgtggtctaaggcctccccgctccctggggcagcaggcctcccacactgccttcctcctgccctgcctcagggcttcgcctctgctccttacctctacccgggagttctcctgtgtgtgcacagtccagcttctcattgttcagccctgctccaatgccactcccctcagggtctaccattgcaaaccatgaccctccacacattgccctgtccctactcttcatagcactcgttgctgtcagaaagtagaatggtgtggttcaccgtgcatcaccctgccttgctagaacccgggctccgtgagagtaggatccaggaccgcctctttccgtgctgtgtccctggcatctcctgaggatggtgcaggcattccacagctgcttggtgactctgtccgctacactgaggctcgggtcaggacgagggaggggctgctgcttgtgatggtggctcatctcgcagtgctggctgctgggcagctctgcagccacactcacgttccagccagcatcctgggcagtgcatggtggtgtttgtgcagatcctgcaagggagacctggctgcatcagagcagccagcccgtgggccctgatggtgctgggcacatatgtgacctttaattccagaatcctgcccaagacccctgtggccacagaccctccgaaggacacctcataggaacagtccagaggctgcaaagccccaggggaagcctggattcttgttggttacatcagggcccagctgttgagcccccaccccctgggtgctctgttctttcatctgctagctcagagggt

SEQ ID NO: 22440 - DNA, 1066 bp, Homo sapiens
aaggtcgtgagtctggtgggctggtgtgtgtgtggaccaagcagggggcgcccggcatgagctctgagttagtgcttagtgcttagggcaccaacagaggggcctgtgtggcctcacactccactcgggacggcagcatagtgcgagctccagggcccctgcctcctagcatcgcctcagttcccctcctgtaaagtggggattctgccttctggggttgggtgggaactaaatgagatagtcacgcttggctgacaggaagcactcggcgcctgtgcttgtgatggtggtggtgactgctgcacttcctgggtggttgcgtgggttgcagggcctgtgacagcttggtttggtggatggcagagtcagggttgggttgggggtagagacacccaggtctcctggcacagaccgttctgatgtcccgttgaggcctgttccgccctgtttttcaaggctccccagcggggctgaacctctgccctctgctgcccacagtagtagccggctcagtagcactttttttttttaagagatagaatccactcagtcacctagctagagtgtagtggcatgatcatagctcactgtagcctcaaactcctgggctcgagcctcctcttgcctcagccttccaaaacgctggaaccacaggcatgaaccgctgcacctggcctaagtagcacactttatcactgccttcccatccctgtctggcctccacatcccctttactgggaaatcccccttccctccccgtagttccctgtactcccgtctaagggtcagcttccgaggtgatgcttctcagtgctgggcaggcctgcgggttactgtgcgtagtcagtgggctgcctggcatggtgggttagtcagttgggggtgggcagcgtggttctgacacccccatgcctgagcctggacatactccttgtctgtctcctcctgcagccgccagctggagacgatggtggaccacttggccaacacggagatcaacagccagcgcatcgcggcagtggagagctgcttcggggcctcggggcagccgctggcgctgccaggc

SEQ ID NO: 22441 - DNA, 1065 bp, Homo sapiens
gtgattcaccaaccctggagaccctgaactgtggttgagcagaccatatcctcatatcccgcctcagctcacagaattcacttgcggccaggcacagtggcttatgcctctagtcccagcactttgggaggccaaggtgggcagattgcctgagctcaggagttcaagaccggcctgggcaatatggcaaaactccatctctacaaaaaatttaaaaatttaaatttttttgtggtggcgcatgcctgtagtaccagctacccaggaggctgagatgggagaatcacctgagcctgggaggccgaggctgcagtgagccatgactgtgccactgcactccagcctaagcgtcagagtgagaccctgtctcccaaaaaagaattcacttgctagagtccgccagagttgttgtcatttctctgcccactgtgcctgacgacaacaacaacaaaaaaaccctggtcctcaggtggtgggagtcaagggttttccaatgccgtcttccctgtgtggaacacggacagcttactctttcatgatggttatttggtaccatgtgataaatacatgatgcagaggttcacactgacttttagtttctaaggcaggtagagccatggagccctttaagattcagagcatggcacccaatacgtgtccatcctctaactcagacacaaacgagattggagtttatttgggcaaaattaggctctagctctgagcagggctagagagagaaatcaaatctgataatgtctagtcatatttacccaaccgtgcattttcctaccacatgttccacattttgaaattcaaatcacatttataccttggacattgttagaagactatttttatccctgctgtaatcatctaatttgctgattacaggtctcaaattgccacagagaactcaatttttgaaagaattgtcctgtttgatcaaatatgttattcaagcaatgcagtcatttgttccacaagtttacctgccaggtagagttaaccaggagtaatagcattagaagcctatacttaaaatcaagcattagctaatccgcc

SEQ ID NO: 22442 - DNA, 1051 bp, Homo sapiens
gtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggtaactagcagccccgcgccgcttccgcctccgcccgccgggctgcccctgcctgtgctctgggccgccgccccgcgtggcctaggcccagctgcccgggcccccggagggaacggggataaacttttgtcacgtgcttctgttgtctttgtctgcagccctttgacttcgcagcggagtgaggggtgtgcagcccgttcgcctgcccaggaaagggggcttctgagctgaaggcgtgcggcagcgcgtgggaatttgggggcgggggcagcacgctgtcaacggaagcgttcgccttaatatttgtagcttgtaatgacctaaacattgcttaaaatgtgtactgtttgttgctctttgattgcacggaaaagttttaccgcgtttgtcatgataatgcttcctgtgcaatatttggttatttaatatttgtcacaatataatgccatttaaacattaaaaaaaaaagagagtctcactatgttgcccaggctaatctcgaacttctggcctcaagcgatcctccccctcctacccttccccacctcgcctcccaaagtgttgggattataggcctgagtcaccgcacccggctcatttttacaaattttaatttcatcgtataataaatgagttttaaactactggtgaaaagggtacaaagttttgtgtttcctagtgggactttatataaagaagtattcccaatttaagaaatagttttattgttaaatctgatttttctgtggattctgtggtctttcagattgattctgtcccctcaagtgtcttgaaattgttactttgaaaagcagtatttaatttgctta

SEQ ID NO: 22443 - DNA, 1050 bp, Homo sapiens
cttgggaggctgaggtgagaggatcacttgagctcaggcgtttgaggctgcagtgggccatggtcatgcaactgcacttcaccctgggcgacagagtgagaccctgtcattcatatatatatatatatatatatatatatatatatatatatatatatatatataaaacttaactagtttggcgtctttaaattagaagacattaatgtatttttttaaaagagaaagatagaaaaagaagaaagaaaaaacagcccctcatgaaatcttactccttttgccaaaacttggcattttttattctttcagagaatgtgacacagaccctcagaggatggtgtttctattgcctttcctctgctgcagtgggttaatttcacctccttcagtgtataatacgtgcataatgctgacttgatatgttttctgccatttggcatattaaaaagatatccttagttttattctgatgttagtgtgactgaaatgcaaaggatactttttggggtgctctgaacagctttctggtatcgtgttgagttacattggaagagagagtaactgctttttcagttacagtcttgtggcaaactgaatgactgttttctgtagacattgactgtgctaccaaattatttttctgtgttgtgttaatgttaattcggcacacaaaataaccacgtatatctgtcatgggtgtgtaaaattatccccagttcaggaaaaagcgcgtcagtatttaatctatctttatttaatagaagcatttgcttcagtggacaggagacccacaaggccacaaaataaactgattagatagctgcactgtaattatagtgtagtacaggaaaactacccagtaaatcggcagtgaaaattttttgtgaagcaatttatttaggctttaaagctggcccagttgtgggagtacagtgagttctagtaaagtagaagcgtagtgacatcctgagtgtagaaggggaaaatgtcatagtagcttcatatgtggcacttagtattcctttatgaaagatgaatcaaacatgcttt

SEQ ID NO: 22444 - DNA, 1052 bp, Homo sapiens
atctacattctacctggaattggctttgtatatgggggagattgaggtcaggtttcatttttactgtatggatacctagttgtcccatcagcatttattggaaagagtgtcatgtctccaccgcattgtcatctttgtcataaatcaggtgactgtgtaagtagatcagtttcttgactgttctgttggcttgtctgttcttgcagcaaacctacactgtctaaatcattatgactttgtgttatcttggtacctggtacatggtggtgtagttttagttgtggttcctcaagattgcctttattttctcctttccagtccgtatgctgtttctttctttttcttgcttttgatactggccagttcaagtgctggtagtgggcatcaggggtcaacttttaaacatttaccattaagtgtggtatttactgtgagtaatttttgtatttgcttttatcagattaaggaaatttccttatattccaagtttgctatgagtttttatgagtgggtgttgaattttagaaatgctttttctaaattgatttaattatggtaatttattgaaaagagtatatttgttctgtaagttctgtaacttcaataagtaatgttgaagttacttttttttgccttcaagcatctgtttaacaaagcacatcttgcaccacccttaatccatttaaccctgagtggacacagcacatgtttcagagagcacggggctgggggtaaggttatagattaacagcatcccaaggcagaagaatttttcttagtacagaacaaaatgtagtctcctatgtctacttctttccacacagacagcaacaatccgattcctttatcttttccccacatttcccccttttctattcgacaaaaccgccatcgtcatcatggcctgttctcagtgagctgttgggtacacctgccacacggggtggcggccaggcagagggagtcctcacttcccagaaggggcggccgggcagaggcaccccccacctcccagacgggaccgcggccgggcggaggcgccccccacctcc

SEQ ID NO: 22445 - DNA, 1712 bp, Homo sapiens
ctctctacccattaagcaataacgctgtcattctcccctcccccaaaccccaagtcatttatgactatacattttgttgcttgtgttttttggtgtcatatctaagaatccattgccagatccaaggtcttgaagatttatacctatgtttccttctagggatttcatgattttagcgcttatatttaggtcattgatccgttttgagttaatttctgtatattcattgattgttgattttgagaaaattcatctaggatattttcatctgaaggctcataatctgagatttaatttatgctctcatttcaccatcacgagtgtctttctgcgctaaccaatgtggtagccattaaccacatgtggctattatacttaaattcaaaattcaaattaattaaaattaagtaaaataaaaattcagttttttggttacaatggccacatctcaagtgctcattagtcacatttggctattgactgttgtattggtctgtgctgatgaagattcccttcatcaaaaaaaaaatttattggacttcattggtcaagagtgctactagctctttatattcataatctgattcatttaataattgtgaagtatctttccatcacttttttcctctttccattataggcagaaagtaaaaacaatctgaattctcaactgtgtttattgaaagcgaaaagcagagtacaaagatggtgtctgttatcatttatactgtcttgaaagatgatgcaatatcctaggcaatgcagtagacaatggaaggatgatattttgctgttgattgcattatccttctgagtgattccataattcttccattttctcattttcttattagttttttttttttagagcgtagttaggaatagttgatcataaaataattactaaggtgatgatgaaatggcaagatgcaggaaaaacataatcactaggatcctgtagtgtatcttagacttacaaagccactgtattcatatggtaattgcagaataaaatgagttttttttttcttaataggaaaattttcttttgattccttggaaggcctctaagagaagataaaaggcatgaaatattaatccttgcaaatagttagaactactcaagaaagaaactaaaaaaataaaactgggttcaatggaccctgactgtataccctgatactttgaattcaaatccattaccacaaggttcttcttaaattttccccagtctatatttgaaactccccttctttcatagtgaaaaccttggttctcaacatctgcatttattcatttgctctatcctacaatatatacaaaatagcttcagaattactgcattaataccactgccaatggcaaacctgaagtaaagttcaaaatgtctttgcagtttcattggcttttgtgtaattaatgcttttggggtgtacagttagggtactgatcccaaaagtcacttgaattactttttttctgtgcagttataccttggatttttatttatattgaatcttagtatttgttttttatctttttcacttaattgcattttatgaatacatgaaaacatttgcatggttcaaaatcacaactaaatcaaaagttatccctactgaggtaattctgattcattcccattcctgctcttacttacccctacagataaacttttttttttttttttttttgagacagagtttcactct

SEQ ID NO: 22446 - DNA, 1024 bp, Homo sapiens
tattcatttttttttttttttttgctggtaacatacttgatttttacatattgactttgttctaaaattttttgttgttgttaaaaaatagagatgagtttgctgtgttggccagactagtctccaactccaggcctcaagtgatccacccgcctctgcttcccaaagtgctgggaccacaacaagtgtgagccaccatgcctggcctaaatttatttgaattctaattacttgcctgtacattctgatagtatctgtgtagttacatacaggcatgttgtttgtaaatactgacagttttattcattccagttcttaagtttttttttatggttgtttgttttgttttgttttttgccctattgtatgggctagaacctttaatataatgtaaaataaaagttaggacattgggctttacataccaggagggcagttttaagtatttcaccatacagatgttcgtagttggctttttgtagctactcgttatgaaaataaggacattttctcctgttgctaattttatcattaatggatgctgaattttatcaaatgtattttctatgtttcttgagataacaatatggtaaattactttgattctttaaaaatattcaaatgccattgcattcctgcagcaaacccatttgtagaggatgtgtttaccttgttgtatattgctagattaaatttgataatattttattaaggtattttgttctgttacatgaggcaaaattctgtaattctttcttttcttttcttttttctttttttttgattaactctaccagggtgctgcggctcacacctgtaatcccagcactttgggaagctgaggtgggcggatcacgtgaggtcaggggtttgagatcagcctggccaacatggtgaaaccccatctctacaaaaaatacaaaaataagctgggtgtggtggcgggggcctgtaatcccagctactcggaaggttgaggcatgagaattgcttgaacccgggaggtggaggttgcagtgagttg

SEQ ID NO: 22447 - DNA, 1044 bp, Homo sapiens
agctctgcctcccaggttcatgccattctcctacctcagcctcccgagtagccaggactacaggcacctgccaccatgcccggccatttttttgtatttttagtagagatggggtttcactgtgttagccaggatggtctcgatctcctgacctcgtgatccacccacctcagcctcccaaagtgctgggattacaggcgtgagccaccgcgtctgaccaaaatttactaattttttcttttgaataacttgctgtgaaatagaagacaactaaaaaaaaaaccctctaaatataatagaactgcttgggcttaaatcttttctgcaagtaggtggaccataaatcatataaacaaagataacctagacatgccatcagaaggctagtctatatatttttatatctacctctttcatctttccccttatttctgatttcccaaatgtcacttctttagtttacatttggatagtgcttatttgaagtctctgatattctacacactatatgtaactaataaagactttaaaatgtaaggcagcattttggtagtgaaaatttctcttgtacattgtgaaatggattttgttgttcgtctatcttcctagggagactgtttaagggaagtaaaaggaacagggcaagaatggccggaacgaagtggagggtagactatggggagtgatggcaagaacacatgccattctaccagtgacttgtttcttaaacataaaaagcatatgtgccaaatttgcatatttactaattaaaaaggcttcctggaaacattaggtagactatcttctataacctttaacaccgtcactaatggatatagcttagaagatttcctcgaaggtcctttaaataatgtaaatgattatgaatgtgtaactagttaatatgcagctacgaaaggattatcatgtagaggttaatgaacattctgctcttatggtttgcagggctttgctttctgtgcttttggctctcttcatgcttggaaacacatgcattgggattggaaaacatcctgactgttc

SEQ ID NO: 22448 - DNA, 1080 bp, Homo sapiens
acttgcacatgattcagtgggtgtgcatattaagctgggctcacctgtgtggttcttctgctagtcttgtgtgggctcactgctttggttgcagccagttggtggctgggtcagctttgttgtccagaatgacctcaccctcaagtctggtggttagtgctgttggttgagcctctgcctccatgtgctcttttgtccagcttactttctatgggcatctcagcagcaagaatggaagctgcaaggccacgttatgttggtcaaaggaagggccagcgcagattcacaaggtgggaagataacacccacctgttgagaggaggcgtgaaaaagaattaatggtcatttttaatgcactgcaatgactttattgaataggtcctacacacacaaaaaggaagtctccgtcctttatgttgactggtgagaatgaaatgaaatagtacatgtgatgcctggcagttcatctttatgttaggcattacttacaatcgtaaatcgtatgcatgtgagttgtaaaaaatttattgccttgcttcctttattttaaaaggatttttggtaaaggtatctttgaaattacatgaaacagacttaaatatagaagaagatactttgttcaggtgtttaattttggaaagaatactttaaatttagacataaaagttctaaaacactttggcatgtgagttttgagagagtctaaagcaaatactcaacatttttttatttttcaaaggaaactggacaaaaataattgttcagaggaaaagagtaactagcttccattagaatttatagttaaagtatatagtaggaaataaccaagaaagcatacctgtatagctaaaaatctcaggtgaagatttgattttctctctctcttttttttttttcctgttggagctactctttcctatcagtcgggatggagatacctgctttatgcacacattgtatatctgtctatatgtctcatgtttttgaggcattccttgtgcacagaagcactgaactatatcattgtaacaatgccatggtttacagtatatttcatatgaatacctgaaactgttttct

SEQ ID NO: 22449 - DNA, 2051 bp, Homo sapiens
tactgaatattttgccatgaccatttagaaaaaaagtgtaatgctattgatttaattcaagtacatttaaattttccatgaggagtgttccttttcccaccaaattgcataaagcataacagtatagatccctttttcaagaatttttaaataaaatgtaacttttatcaatttgtttagattgtttaaaaggatactttgaaaaaaatcattatttcttgctttagtaactggaggacatctctttatctatatagaatccatgcccaaacttaatattcctctattttcttgattttagaggtgaaaagccaggcatccttcaagctagtggatctttgacaaagatgcattgcaaaacaatcaacaaacaatcagaaaggcatgctatgtgtgagtgatgatccctgcagcatatgccataggcttgttgtagaggagctgctcagtaaatggtggattcaattgaaacaagtcttttttggatgcttaatgggaagttgtagggtgggtatgatggactaaaaattatttctaaagaaggttatatattgtatatattccagaatcttccgtttttatcgtttcttaaattaaaaaataaaaatttaactctgtcccaggttaactcagatgttaacacttatatagaaatttttttcctctttccccgttaggcatctcacagtattttctgcttgtctgtttaggatgttaggtagaggaaaagagagtgatagaagattttttttcttaaaaaaaaaaaaaaaaaaaaaaaaaaactgggccaggcatggtggctcacacctgtaatcccagcactctgggaggccgaagcgggtagatcacaaggtcagggttcgagaccagcctgaccaacatggtgaaaccccgtctctactaaaaatacaaaaattagccgggtgcggtggcgcgtgcctataatctcagctactcaggaggctgaggcaggagaatcgcttgaacctgggaggtggaggttgcagtgagccgagatcacgccacggcactccaggctgggtgaaagagtgagactccatctccaaaaaaaaaaaaaaaaaaaaaagttcaatgttagtatttgctgtctattttaacttcttactttaaagtaaaattagcaaagtcttattgtttcaacctgatttaaattttatctcccttttttattatttaaaggttggagtctttatcactggcctcaaaggatgtagactttttttttttaatagagatttttatttttgtcagtcacttttaagaggattaaaaatgttgatccctttcatatttcctcgtccctttaaaaatattctattatgacaaatttcaaacatatggaagagtgaatcttgatcacctatctgtctgtaccctaatccgttaatccatttttttctgatgaatttcaaattaagttgtggacatctgtgtatttcacccctaaatacttgagcatatccctcatttaacttgatttctctcttactttctacaattttatgcaaatgagctgtttcccataggttctgtcttgatcttaatcctttaagggtaagggctaacttgtggttgtgttaatggtcttcatcgctgctgcctattttttttttttaatttccttaaaacaaaaggtactctcaaaaggcatattgcacatgattagcaagattcagaaggaagtggttaaagtttcttacatgccttatacctatgcttttagttcttgttttgtataaggaatgttgcatgaggatattggaaaaaaatttaaaattaagagttgaaggcggaacctgatctataaggatccattatgttgaagccaaagaagcaggtctagctattctaagtaagtaggctggagaggtgtttcttaactctatctgggttttgttttccatttgaagaaaaattattttaagcaattaccatttttgattactgtaatgactcctgtgtccaaaaattaattacgtttctaattattaaaatagaaaaaaaaatctgttcaaattttgttataaata

SEQ ID NO: 22450 - DNA, 1002 bp, Homo sapiens
tttcacttctttttaaaatataggtattttctttgtggttaccatggcgattacatagaacatcctaaggttataaaatgtattttgaatttataccaacttaacttcaatcacatacagaggctttattcctgttcagctccttcacctctttatattatttgtgtcacaaattatatctttatatattgtgtctccattaatatagatgtccagtgatgtgtattcatttttctttatcacatagaaaagaaaaaagtggagttacaaaccaaaatgacagtaatacttatttttgcctatgtgtttacctttatcagagatctgtgttttcatatagctttgagttactgtcttttcatttctacccgaagaacttcctttagcatttcttggattgcaggtctagtggtgaggaatgccctcaactcttgtttatctgggaatatcttaaatttcccctcatttttaaaagactgttgttttgctaaacatagaattcttggatgaagtattttgtttctctctcagcactttttaaatatatgtcatcccataaccttctgtgcttcagggtttctgctgagaaatctgataatcttgttgaagatttcttgtttgtgatgagtggtttttctcttgatgctttcaagattctctctttgttgttgttcaacagtttgattatagtgtgtcttggtgtgggtctgggtttatcctacttggatttcgttgagcttcttggatttgtagattcgtaccttatcaagcaatgtgtatgctcttgagtatctccaataaggcatttcaaaatacaaatttatgattttagtttatgatagatgtatatagctttaaataaccacaaaccatcttaagacgttatttaaaaaaaagagcagcattcacttatcccttttggctcacagttcccattcctcagatgtaattactttctgtttttggctatttttactctgctctttttattcatattttcca

SEQ ID NO: 22451 - DNA, 1044 bp, Homo sapiens
taatttaagaggaccatgtagcatttttacatgtcctccctgtctctgcttctctaatctttttgctattgttgtatcacaatttttgttgaatcagtattcatgcttagatattatgtaattccattttgttcttgtacaggcttttagttgaatttaactgctttttttgttgcatagttttctatgtgtctgtcattaattcagtcagatactttttttgttgttaaaaattttactgctggagtctttcattgtcttgcttcaatttggactggcttctctcctgatcaaaggagagccgtcttcctggtgtcttcttaccctgtttttgccttttatttatttcctgttttctgtttcccaaagcacccttttttcaggttctatttagtttgttggaatattgctttaagtaacttttgggaacctgctcggaggtacttctttgaatttttatgtatctgaataactcttatattccttatactcctgcttcttattgttaagtagactgtttagaattctaggtcttaagtaactgttgccctcagaattttggatacattattctgttacctcctgtctttaagtgttgctattgaaaatcttgatgctattttcgttttctttgtatataacttgtttttttgtttttaaagctttgagattcctttttggtccttattccccatgatctggaatacaacagtggtacaccttgaagccgtgctatggatcctttaaaatttgtttgctagtgcttagtaggccttttttgagtggaggcttaagtcctccagccgtgggaaatttatattagtaatttgaaaatttccttttcttgttgcctatttgtttgtccttgttgtaatttttgaagtgatttcttctgcatactcttttaaatcatgtattgactttaaaattttcctgtacatagtttcatttctggaagcactttttttttgttctttggctgtttctttgttacagcatcctgttcttgtttcatggatggagggtctttttttaaggagtatt

SEQ ID NO: 22452 - DNA, 1694 bp, Homo sapiens
ttataaactttggagcaggtaatttgtaatctggtcagatagctatatgtatgagaaactttacgaaattgctgtttgaaatacacattagcacacacttagaattgttaaaatgctaaatgaaatctgctactcgagaagttctatattattttgcttaaatgatgtaccatatgcaataattagtttctgtgaaaaatagggcaggaagcataaaagtttctttttcctagtgtttcacctataaattcttaggtctttttgattaactaatactattcattttttaaaaccagttttggatcttgtgatttttcttggtcatgattctctttctattttttgtatgatgttatttcagttctgttgcattttcaattttgttatttttgtaaggtcctcacatcttttatagaatcaagtatgataaatgttcactcatgcatatagatatattcgtgtgcatatgtataaatcctttatttttaaaaattacaataatacatgctcattgtaaaatattctgagtataggagtagaaaataagtgtgtattatgtggtttcaatttctggtctttagagataaatgttctctgaatttcttacaactttattattattgatactatatttatattgcatatggccaatatctttcttgcaaagataaaaaaattatcttctatattctacttatgtctgaataacctcaatatatagaagcagcataggaactgttttttgttaatttatttcaaaacatttttttgtttttgaacttagaattctagttttaaaaatactttattcaagatcttagtatttacccatggaaactaactggaaatttaaataatgtaaaattctagtatgtttgtttgatcttgttaattttcttccttgctagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtttgtatacttttaactttactaattttgcatataatttgaacattaagcattatgatattttttagaagagcaatattaacaatcattatcattgtggatagtgccagacaggaaaatcatcttttgcctcttgttctgaccaatttaagaagaaaaagggaaaaaaaatttagttagctggtattggtccattgttctctgaaacaatgcattgtttggggtctggaaggggatcagatttgagtggcaactactgtaacttcacctgtccttcattcagagagttttcttaagaatcctggagttaattatattgtggacattttggtgtgcttaggatgttgaaagtgactgcattagttaaatttttaattatgccaggttgttttctatggacataaaatgaatacttcataggcacaaagggaaaatgt

SEQ ID NO: 22453 - DNA, 1493 bp, Homo sapiens
gagcattttggaagaggaaccacaagaaaatcaaaagaaacttttgcccttatcagtaacacctgaggtgtgtgtgtgtatcttttaattctttatttcatatagtatctttgaccagttttagctatttaatctgaaaagtcataagattaaattaattctaggttttatactttcttggtactaattaataaaaaattaatagtcacaaacagtacaaatattgtgataatcaaatagtttattttttgataaacacattacttgtcttaacgttctatttcagcaaaatgggaaatttaaaatgtcttacttggcattatgtattacatttgtagctaggaaattatttcgcagtttattttaaataaattaccagtaggtcattttctgatagtgtaaggagcagattacattattctcttttaaataccttggctaagttaaagaaaaataatgcatgcatagcagataattacctaaagtctaatattttaccttgtaccagtgaaacttaactcttgggggattatggaattgttttataatctgatgaaagctgtagaccctgtccatagaaaaaatagtgcacactcaatacactttcacccaccacacttcttacagtttttggtggtggtgcaggggaggttaggaaatccccaaataaggatgtctgtgaaatataaggctattgatttcttcattcttgtgttttggtgcgtatttgaagttttcaatttaaaaagtatttaggaagattggggaacccatgcctggatcaaaccagtgtacacatttgtatatacaataagatacatgcatatatataaccttatctaaaaattccattgcttttactaaatggtattatactcagtgtattaaatggtaattggggatggagattggtagcatttagggacagtacatatgactagaatgttttcttcccctcttcttagtataatgatcttaggtgacctggaaagtatcttaccttatttgatagtcttccatactgttagaaaacaggtaatggatgttatcaggtaattgctgataaatgtttgaaaattagttttttgtaaggacttagtgtatcatggtacagctagagtgtggaacctattttttatttcacccttagtagctttgcattttgtatggaaatgtttaatagtagttgctatacattttttaacatcaaagaaatagttcatgattatggtaagtactttggaagatatccttttcagtatctttttaaatgctaaaatacctctttttcaaaggcattttaaatagaagaaggagaagaaggctctatgctcatcgtgataaagtggagtttttaggaaagtaagctttaagctgcttttaccagttgaactccaaaaataatgtaggagagagatggctttctttgtttttgtttcagtggtggggcaaggtagaagaaggtggctttttaaattatttaggtgttacgt

SEQ ID NO: 22454 - DNA, 1468 bp, Homo sapiens
aaatttacattttacattttgttttcttgcatgtatactgtaaaaattacttctgtttggtggtgaaattaaaacttaatggtgttggtttctctgaacaattagtattttggtgtagtagtgttgtctagccaaaaatctcgtgaatttacttttaatgaaaagaattgccaaatgagtgaatgggaagattttgtgggtgtcttatttgcattttattaccataacctgacttttgttttctaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcagatacttctcccttagtttttgcagtttcactgggattatgttttgggaaacaaggaaaggtctagatgcttaaacattttaaataaaaattccttacagtttcatcttcccaacattttcattctttaaggctactttcctactaactgaaataacacatttacttttaccacaattcctcaaaataaatttattctaacattgaaaataacattacaagttaatcattagcttgatgcatgctaaaatgtagcttttaaaaagcattctgcattagtactaaaataagccatcaa

SEQ ID NO: 22455 - DNA, 1036 bp, Homo sapiens
atagcactcgccttggcctcccaaagtgcagggattacaggcatgagccactgtgcccagccctaattaggttctatttattcatttttgtttttgttgcatttacttttggggtcttagtcataaattgtttgcctaggccaatgtctgggaaagtttttctaggttttcttctagaatttttatggtttcaggatttatatttgtttttaatccatcttcaattgatttgtgtatatcgtgagagatgaggatccagtttcattcttctacatgtggctatccagttttcccagcaccatttattgcatttattgactagggtgtccttttccccagttgatgtttttgtatgctttgttgaagatcagctggttctaagtatttgactttattcctgggttctctattctgttccattgttctatgtatctatttttataccagtgccatgctgttttggttactatagccttgtattataatttgaaggcaggtaatgtgatgcctccagatttattatttttgcttaggattactttggttatttgggctcttttttggttccatatgaacttcagaatttttttctaattttgtgaaaaatattgttagtattttgataggaattgtattacgtctgtgaattgctttgagcagtatgatatcgattcttccaatctgtgagtatgggatatatttccatttgtgtcatctgtgacgatttctttcagcagtgtttagtagcccaccttgttgtgatctttcacctccttggttaagtatattcctaagtattttattttattcttgtttttagcagttgtaaaagggattggattttttatttgattcacagcttggatgttggtgtacagcattgctactgatttgtgtagatttattatgtaacctgagactttactgaatttatttatcaaatttagaagtgttttggaggagtctttagggtcttccaggtgtaagattgtatcaatggtgaacagagataatttgacttcctcttttccaattt

SEQ ID NO: 22456 - DNA, 1030 bp, Homo sapiens
cctactctgacagtgtcttaaaactgtcaagtatagtctgtattttattgtaattactcttactgggaggactttactaatttgctttgggcattttatttaccctgcttgttgattgcctttccttttcttttttttttttttttaactgttgctcagacttaagtacttccctcttcctctactgatggggaagttacatatttgctatattttaatgttttggcacttgaaaagtatgtactattatcactttattgtagcgtttatagtacttggtttcatttgtgtctaacagctttattgaggtataatttacattctgtaacatccactttacagtatgcactttggggttttttagtagattttgagttgtgccatgttgaccacaactcagttgtagaacatttccattgttttaaaaacatcccttttgcctatttacagtaaattcctgttcctatccccaaccccgggacaccttaactaatatgctttctctatagagttctcttttctggacaattaatagaatcatacagtatgtagtgttttgcatttacctttcgatataaggtttttgaggttcatccattttttaaaaatcatgcatcagtaacttgttttttcttattgctgcatggtattacattgtatggatataccacattttgcttattcattcacaagttgatagaccctgaattgttcaggctataatcaataatgttgctatgaacattcatatatcagcccttgtgtgaatatgtgtttttatttatttagggtaaatacctaggagtggaattgttgggttggatggtgaattcaggtttaactttttaagaaattgcacagtttttcaaagaggctgtataattttatattcccatcagcaatgtttgagatttccagtttctccacatctttggcagcactgttactattttgtcttttttattatagcctttatagtggctgtggaatataataattgtattaatttacatttctgtagcgactaatg

SEQ ID NO: 22457 - DNA, 1005 bp, Homo sapiens
taccttgttgatgtgatagattacattgattttcaaatgttgaaccacccttgcatacctagaataaatctcacttggtcatggtgtataatataatcctttgcatacatttttggattcagtttaataatattttcttgagttttgcatctgtgtttattagcaatatttgtctgtagtttcttgtaatgtctttgcctgattttcatatggtaatgctgaactcatagaagtagggagtactccctgtgcttctatcatctgaaagagataggagagaattggtgtattttttttttttccttaaatgtttcatagaattcataagtgtatctgtctgggcctgcgctttgtgttttggaaagttattaattatttaatagagatagtcttattccgattgtctgtttcttctcgtgtgagttttggtagattgtgctcttcaaggaattggtccattttttctaggagtaccatatttgtgtgcatagacgtgttcatagtatttcttggttatccttttaatctccctgggatctgtaatgacattctctttttttatttctgaaatcagcaatttgtgtcctctctcttttttcttagttagcttgtcttactgattttatttatctaagaaccagcttttggtttggttgattttctctactgattttatgttttcaatttcattgatttctgctttaaatttttattcttctccttactttggaattaatttcctctcctttttctattcttataaggtgaaggcttagatgattaattttagatctctcttttctgatatatgcattcagtgttaaaaattttcctttaagcactgttttcactgcatcccacaaattttgataagttgtattttttatttttgttcaaaatattttaaaatttcttttgagactttctttgatccatgtgttacttagaagtgtgttgtttaatctccaagtatttgggagattttccagctatatttgttattga

SEQ ID NO: 22458 - DNA, 1046 bp, Homo sapiens
agaaaataatttttaaaaatgttcctattgcatactactctgtggcataaattatttaaatgcagtgcttagccaaactaatgttacagattagatgatgaactgataacgtcatatacagtaagttaaagacatgcaatgaagtcgttatttacttatggacaactacccttgcaaaacaaagtcaggaaaagtgggtgatgttcaaatgaggccatttgaactgtagcttcaaaataatcccctttaatttcattctctgcatctctaaattctggagaaagaaggaatgtcttcatcatcagaaggaccagtctcctgtttataaaatgataaagaaagttgggcagctcctccatcataagcttgctcttctggtttttttttttttcctttaaataattgaactgttacaggaaacattgttaaaatcttaaggttagggcatgctttcatttttttttgtctaaagattactctgcaccctagacaaaggaaatatttaaactgttaaatttgaacaaagatacagtctgcatatgacttctctgaagccctataaaaattctttaaaattgcctattcactcaaatttactgagtgtagcaaaaatgtcaaaggcataaagtcagagaagattgaataaaataatgcagaaagacagattagtcatgcacagacccacacagcctttcagagcacacaataccgctctttattaccgttctatctttacaaagactacgttcaatacatagaagatgatacatggccagccatgtcatctgcctgtgattccagaactcatctatctgggcccttttcacaatgacattgatgagagatcgcagtgttttcagagcattgttttatttatcatatataatggctggtgaaagaaataggaattatgtcaccgatagcacataaaagagttgcatagaagattctgtgacaaagtttggtaaaacccagaacaaggaagctcatggaaatgttcttttctctgtcttcccccactgctgtgtcttctccccctccgttca

SEQ ID NO: 22459 - DNA, 1098 bp, Homo sapiens
cctggggcccttccagggccggtctgggtctctgtggaatgtgcgggctcaggaatcattgttcctggggctgttgtcacagtgtgtcaatgatattcattgaagaacatctctttgaatgagctaagaatgcttaaagagaacagtagccggccgggcgtggtggctcacgtctgtaatcccaacactttgggaggctgaggtgggcagatcacatgaggttgagagtttgagaccagcctgaccaacgtgaagaaaccccgcctctactaaaaatacaacattagctgggtgtggtgtggtgcttgcctgtaatcccagctactcgggaggctgaggcaggagaatcacttgaacccaggacacggaggttgtagtgagccaaggttgcgccactacactccagtctgggcaacaagagcgaaactctgtctcaaaaaaaaaaaaaaaaaaaaaaaagaggacagtagccatcggttaaagacatgcacctcttggttgaaacagactgatcagtcccagaaaatccctgctaagcagtcagctgccgaaagcacctgcctggggcctggaccctcgccaaatgtcaacatgatgttggggaccaacaggaacactggaagcacagtgttgaggagactggacatggagattgcctcaagctgggtttctcttggaatgcagagcctgaggtcaggcctgagggcgtatagcttactggggacatcatcccagttgatgggggccgagggaggtgggcagaattgtctaaggagtcatataaaatgcagctctcaagtgtccatctggagaaacaaagtggggactcatttacccattggtgccgtccccctaggtcgaggtgacccccgagggcatggattcctctccatactcaggttgcccacatgtgctctgcaagagatctgggcatgggctgggtgagtgggtgagagggtctctcactgcccctggcccacgaggggtatccactgcagggggatgcggggtgatagtccatggagggtgagaagcagtgctgcttctgcctgctcaggggctcaggtgattttggaggagacgagacattccaggcag

SEQ ID NO: 22460 - DNA, 1027 bp, Homo sapiens
ttttgatctttgagcctcagttttctcatcagtagaactggactaattctttctccctcataaggtcatcaggattaaaagagaaaatgattaaggagcccagagaccagctattcaatgaatggccagctactcttattacttgtgtaatacatgttgttgaatattttagaaatagaagccccaccaaaggctgtgggcttcagtcatctgcagagccgggtgaagaagtgccattcctccttccttcctggctggtctttggggtgatgtacctgggaatccaataactattggctgattgatttcctatgtatctgaagatgcattttaaagggtcagctgagttatggaggggtctggggtctaagtcttcactaaacaaatattctcactccaatccatcaaatgttagtaccatgtatctaggccacacacacacacacacacacacacacaatcacacatgaaaacacatacatgcacacaagtgtactggttggttgctggattcctggtagggacattataaactgtgctttccatcttttccctacagccaaagctaaagatcacaaggaggtcccttcattcctttctttcttccgtcttttcctccctccctccctttctcccttcttcctccttccttcctatctgtctctctatctatctgtctgtctgtctgtctgtctagatatataaagtgtatcctaggtaggatcggcactgtgaatgagaacagaaatgctttgaaaccattgcatcaacacaatagcaaaatgaaagcagtgatgttctcctagtttccatgttccaaattaaaaaaaaaatatatatatacacacacatacacatatacataccagagactcccctaatttgcatactggtgtatattcaagtgttgatttcaaagcagcctaacacttaagcatgaagtataaaattaatgagttgaacctgtgaccactgcattcaagaagagtcacccaagagagaggtggggagtcgaacagagctcctt

SEQ ID NO: 22461 - DNA, 1046 bp, Homo sapiens
agaattgcttgtgaattgtgtttctgccttgttttgatttgtttttcccagccaaaatgtggggctggaggcaggagactgtgtcattcagaatctgtgcctgcttccccacccatgggctgtatctgtgtgtgccccggctgggcgggtggacgggaggagtcgcgggggaggcttggttcctggggacatgtggggtggcgccgacagctccagccgggctcaggtgagtcacggctgcgctttgagatgggtaattggtggcatgtggtccgtgagccatgtgtgagagcccttccttagtcataggaaagggaacaagcgtcgcaaataaaagcctcatcagattagtgagtcagaaaagacgctaatcccaacccgatgcttcatttctactttttttttccccttccaaaagcagaagctgttcctgttctttaagaaaaaaaaattaaaatcagttttctaaaagactgatttaaccacaatcaaaagtggaggggggtgtgggccgtgtcactattgctgtatgacgattagcatgaagatgagttgcactttagccgggctgaaacttgttcctaacagaatgttaaatacttagtgaaaagaaagattatgtctatctagttacaccattccttgatatatgctccatgtcagaatgccattgtctcctgggtaaagacggagagttcaaatacccactatctctcccctggtgctccgaatgctcttctttgaagtttttataatccatctgtcatcttctagcaaggagggcacatgttctgtaccactcaattacagaattctcctttgccagctccaatgagacaggaaagaatgttatgggtggttgagagaaactgtcagatatactaaattcctaggattcatacgcacggtgtttttccagggtaggaacacagcccgccttattgttcaagtgcattagagatacagttggcattggggtagagaacctttgattttttttttttttttaaagtctcttccagagagttgtcttaaatttgattgtt

SEQ ID NO: 22462 - DNA, 1044 bp, Homo sapiens
gccagtgtttcctgaacctccttggccatcccctggggagggctcctgcacccagcagaagtgtggctggtccatcctggtgagtgttttattgagaggagtcccaccccctcttcacatctcaggctgctggtgggtgcacttctgcgtctcattggcaatgcaattactggcaccatgggaggtctgcaggttcaaagctagtgatgagaaatctagttcaccgctttcagaaatacgggtttggtttaggtggcgatggtggtgcttcatcaaagaaaaactccaccaacccataaaagacaaataagaacacagagtctggtgctcctctgttagcaggagactccaggtgagaggctgagcctgcctggctggtctcctcattgtcctctcttcctccttttccatggcggctgcccaggacataggtcctccaggtgcaggtgggaagggacagtcatggagctgtaccactgagtttccctgaggcatccacatgacaagtgcttgtaccttgtaactctgggctgatgcacgggtcaaagcatggggcttgtgctgactcagaggccatcttccttggtgcctgatggcagtctttgctcctgtatttcaaggctgcgggttttggggactgacagatgggcagcaaggcagtcctgtgcttcctgaagtcagttatgccactgcctctgcgtgtgctgccccaggaagggagggctcatccgtggttggaggcttggagatgcaatgtggacttgtcttgctggtgttcgtggaatgctatggcatccttgggtggccaggtggtcagagggacctgggtggctggtggaaagtgaggggcaacagtgtcgcctccctgcaatggtggggacatagggggacctcaccctcagggaggtactgcctgactctgcgatgcccacactgcctccttgtttgtgtcccagtggcagatgggggctggtttcctcaatatttgggactttctgaggacgcctccaaggaggatgagatataatttctgccctcgtggaa

SEQ ID NO: 22463 - DNA, 1041 bp, Homo sapiens
gggttgtcacatgcagaatcctataggatttgcacgaagacccgggtggtcctcagacaggggaagtcaggtgtctgggtccatgcggccactgaacagcagacacaggacaagaactcagttctagaatgcagtctgtggggcactctcaagagaaagtgtcctctttgggagtctacaatgctacagggccaagggtgagcccacgagcctctggcgtctgtgccctgttagctggtctcacggactccagacacctccaccttccacgcattttctcttgttgggccctctatatagaatgtcagccccatcccaatcctccagataaacccctcaactgcccccagggcctgcaagcagagagcaatcagtatgtcctgaatgggtgcagcagacgcagtgcaccagatttgactggcaagggaggggaagacgaccctttcagactggtggtggccttacgtccttcatccctttttaccccctgctgaactataaactctctggtggcagggacatttttcttgtttttacataatttttcctgacattgggagctagaatatcaatgtaagaaaaccttcatagacaggggtgctcaaagcattggtggttctggctcaatggattttaggcacacacgttttcatctccatttggcattttgaagctcccaggagctcctagatgggtgatgggtttctgaggctcggctggtgtccagggtctcctgggatggggacagagcacaccaccttgtgtctccactgctatacacctgctccatctcccagagatgaccccagcttctggagggcaggcgccttccttgtcaccccaccagttagctcggtggctggtgcatctgtggccatggcaggctctatgtgatggcgagagaggcagggcaagagaggcagtgcgggaggtgcagggcaggggccttggcgctgcctccaggtttctgtgatcagctaggttcctagcttctctggagagcagacagcctggggggttgtttcctgaaagggaatcagg

SEQ ID NO: 22464 - DNA, 1416 bp, Homo sapiens
taaacacagtaattggcatggaggtctgaagctttattttatgatattaaatcattcttttctggaacagaaatctgcaaagtataccattcattatgctaaggcctgtattaacaagggctctggctgatggctggtgacatcttggagaacttatgtagcacatctcaagggaggtgtcagccctcacctgtggaggtgagcattagaaccaagagcagaatccaggattccatctgctgtgtttcagggacagaagtgtatggtttgtcattgtgagcttggtgcataaagggtaacattaccctaaaaatactcacaatgtggactgagatgaacttgattgctgtggcattattttagggggacttggcgctttctccatgtaatcttgtgaacattttttttttcatgtgaaccatgattttcttgaaacaaagaggattatcagtcataagttctgaagactgaaatggggtgggagaaaggtttagaaggagaagattttttaaaggacttgcaaagctggcactcaactctagctggagagaaattcttgagttgggcgccatcttggttttgttgctccagggcagtgagggaggggatgggagattttcaggtcctcagagtcctcatgtgttccataaaaatgggttcctgtagcccatagacagctactagagggagttaaggcctgctaggaaagccagtgagagttctctaaggctccaagttctaagggttgctcctctccagacagcttgggaactgcaagccactggaagtcactctgtggtcgcacagagctctgcttcgagtccagcagtctgtgttttgtgcggtctcactctaggctatgttcccaagtggagcaccatgatttcctgtgaagggtccatgagatagatctttggtgatgaggccagcttggagaaaatggcgcttgagaatttcttatgatgctattcaatgacagtgtgattcgtggcgtccccccagccctgtcccctgcccaacttaaccacacttggcaagatctctgaggagtcctgagaagaagagtcctcaggcaacagcaagactttcccaccctggtctaggaaaaaagttctggaaaagacaagaagtccatcagacacaaaagaagacatgtaaggggaatcaaaacaaacaaaaaagctatgaaaatgcagagactcaagaggtcgccaagcgaatgaaatgacttaaggagtgatatgtttgcttcatctttctggttgctctctgaatggtctctgataacacattttagctgtagaaatggggaaagggggcaaagacaaagttccgggaaggttgcaagagataactggttatctaactggtatcccgggggccagtgtggactcgcttctatgtctaaaaatgatt

SEQ ID NO: 22465 - DNA, 1023 bp, Homo sapiens
ctgtgcccagaactgtgtatgacagccttcaaggagcttacaatgcatgaagatggggtgatatcaaacctcatatcagttacatttatatttaactggtgtaatatccaagaacaaggaaggaaccgggcaaaccacacgtaggtctgaaaagagccaatgaaatgatgcagaccaaggctagggcgggcagatgcctttgcaatggaattagagtagttttaaatatgggctaatttcaagcaattttaaatatcacaagattccactagagcgaaagactgcagagaggccttggagtttgagaaaacagggtttgctgagcttcagtctttgtatccacctctgactctgtgtgcaggctacagcatggggcattgggctaacaagaggcacattaggtgtgtgtgtgtgcgcatgagtctgtgcatacacgtgtgtttgcatgtgtgtgcatggcgcacatgtgtgcgcttgcatgtatatgtctctcttctcttagggtgaggatctgtagaaaattcactgcaatgtacccgcagccctgggtcgtcgtgtcctgttctctgtgggccagtaagcttctcttctaaggtcagctttcttcacccagggccactccattttcagatagactggatttggagagtgcctttggggcagtttgctcccttcttttatatttgatattattacagtttttgtaacccaaatggcattggttttaacaaataaacaaatgctaactgccaacttctttggctggatggacatgaatcggctttagcaagtgaatagatgacatatcaaagaatatgttgactaatcccttccctgtctgagagcgttttccagatcgtagacaaatacactgcaggcatttaaaatagaagtccgggcatggccacaagtgtattctgggagttacagggtccgcacgctctacgcaggtgagtatttctaggagatgccgggaagttggggacacccggaggcaccctccgatgttcagatgatcgtggc

SEQ ID NO: 22466 - DNA, 1051 bp, Homo sapiens
gagggcagtttaaagaatgaagtcctaagggttttatctatatttatatctcttgttaaaccaaactcttatgtaaatgttacaatctgtaaataactagcagggctgccttcttaaaggcaagattgcatctccatttttgagatttagcaaaattattaaatggcagaattgactaagatgcaagtatatttggaacgagctaataaacattaatcaatatcatcagctgtatttgtgtagctatttcagggtttaaaagtaaaggtttttgttgaatttctcataaattaaaacaattaaaatataaaagtcattacccttagtgatgttttggggaaaaaaatggagatagctttgtgtgctcttactttttatagccattaatgtttcagtaaaccttgcatgactgtatgcaatttagattattttttcatccttttgccattggacaggaaggaaattactggctcccatcagtgttactggcaatccccatgttctgacatctgttcctctctaaacattttaccaaccttgatgaaatgtagtttggtgtcagaagctgacttgaagaaaaaaatcacatgattaaaaaaaacattgattaaacaccagaagtcacttcccaataactgtcaatattttgatggtcactgtcatttatttttttcttaaatcctgataaatcgtatagaaatgttaatcatgtttaatatttgaattaaactgaattaatggcatgtcatttttaaatagaagtgtagtggattcattctagtccattttaatcagggtctttgggctacgattcatcaggaatgttttcagtctttctcagagaaaccatgtaacgcactttctttgagcaaattagacttcctcaattctttgtcctctttatctcctggttttcagggaaaaacacacagcatcttgggggtcaggacctgccagaatgaggaactggggtggagcagaggggcaaggggttctctgggctggatgtccacgcagcccacggagcccccgtcagagagccctctgggag

SEQ ID NO: 22467 - DNA, 1032 bp, Homo sapiens
aatggtgatcgtgatggtgatgattgtgattatgatgatgatgatgatggtgattgtgatgatgatgatggtggtggattatgatgacagtggtgatgatggtggtgatgatggtgatgataatgatgatatgatgataatggtgatcgtgatggtgattgtgattatgatgatgatgatggtgatgatggtgatgattgtgatgattgtgatgatgatgatagtggtgatgatggtgatggtggtgatgatgttgatggtggtggtgattataacaatgttaatggtgattatgacaatgatgatgataaagatgattgatgatgatggtgatgacaatgataatatgatgatgacaatgataatatgatgatgatgatgacaatgttgatagtaatgatggtggtgatggcgatgatggtgataataatggtggtgatgatggtggtgatgatgacagtaatgatgatgaagatgatttgatgatgatggcgatgacaatgatgatatggtgatgatgatgacaatgatgatagtgatgatgatgatgatgatgatgatgatgatggtgctgctactgctgatgatggtgatagaccttgtggtatagtggctaaaagaatggagccaggtagtctgggactggatcctagtgctatcacttcctggttacttaacctgggagaaactacttgacctccttttgccccagttccctcatatctgcaggggggcaatgctaatagcatttcacagggttgttgtaaggatttgaacttggaccccaccaaggaggggctggcatatggtaagcatgattaacatgctaactagtgagtattagttcttattggttattatatgattgttgtcttattattttagtagctgtgcaatcttgggcatgctagttaacctctttgagcatcagtttccctatggatgaagtggggacacagtgcctgctgcagaaggccattctgttgctggtggcatgtgtgagagtgcagcacctgccagcccaggttgcct

SEQ ID NO: 22468 - DNA, 1035 bp, Homo sapiens
aaaataaacctcacttttaagatttgaccaataaaaatcattagcatatttggatcagatgactttatgtatacattgaacttctccatgcaaattgtccttggaaaagcctggaaacagatttcagtttaaagtcaaaactcctcttctgtcttctctttgtgtttccagtacagtgatatgatgatttattctggtttcatctgttatacctgcaattgatctactggtgatgggattaaatttatcattttagatgtataagtcatagttagatagccagaaaaatgtttagttgcataaaaattcccattgtttgctttcgacacacagtgtttgatttttgccgtagtcaaattgctgtagtgcattatttttactccaagatgtttatttatttatatatttatttattttgctatcttaaatggaatcattttggcccattcacaactgctatctttaaaaagatattttcttgagatcatgtattcaaacaaatgtggacttggggttgtggactctgctatgtgctgaggttctgctgaattagacatcacataattttctaagtctaattacagtatggaagattccagttttatgttacgctttttgtacaggaaaagacaaactgctacaaagacctcttcagtatgaagctaacagtaaaaccaaactcattttaaaagaactgaaattgaaattcataaactcagtggaagttaagttgtaactacccagcctgggaaattctgaacctaagataatgctgcattttgaatccttatgaaaataaaaacaacccaacaacaattattgaggaaaaaaactctagcatgagtttaattttatccaactttattggcagcttattttgaactaatgtgcaataaagttgccaagcacagcaattgaaagaagtaagaaaaaaacatttttggttgttttcttacactggtttgttctaataaaggcggtagagaggtcaacacctgaacagataatttgggtgtctgtctcaatcatgcctgg

SEQ ID NO: 22469 - DNA, 1117 bp, Homo sapiens
tgggggagaagaacaaagggacttcccgctcctgccaatataatcatatcaatccctgtttctttaacaaaacaggacctcttaatggaattgtgtcttcaggtgtaaatagcattaaaagctgcttctcctctcctctttgccctgatagagcacaaggagtgagaaaataaagtggaggttgtcagaagtggcagctgcttggaatcctgataaatataagcttttattgatctgatgaaaatgaaagatcccagtgctaggcagtatttagcttcttgtctacagcacgtcaccggtggccttgcatggggatagatttccattctcatacaccggatttgatttcatctttaaccttttccgttgaatttccttgacctctgcatattgctgtgatttggtgaatttgttacatttcactttacatcatttctttctatatttccttttgtgatagggaacggggacgccccctcttgcaatctgtcagtgcctgcaccaactttatcctttctggggcattttctcaccagactgacagtccttaagacaagtatgcagttaagctgctaaggtaagtcttacgatattagaactccttcttcttcccagacatacctcatttccttctgccttgttgcgttgaccaaacacaaatctaaaccaaatagctcctctgtctcctgcccccggccaggggcttccttgtaccctctccccaacccagataggagtcccgtacctgcccagtaagctctcggtgagtggtggctggcagggcctttccccatgggggaggtattcctttgtggtttgggtgtgtttggggatgggtggggaagaggcacaaagagatcgtgaaaaaatgttattttctcctctgtggcttaaggcctttctgaagttttcttctgagataaagatggggcttcattgcaaaatcctgaggtgctgctaacatattctggttccaagaaagtgctgctgttattttgagtagttttgatacaaccaaatcaaagtgaagatttgaaatagcttttctgaaagcccaagctgaagtcataaattattctgcaccatgattcattctgatagtaaaaccatacttctt

SEQ ID NO: 22470 - DNA, 1086 bp, Homo sapiens
acggtggaaggtgaaggagaagcaggagcatcacagggtgagagaggcggcgagggaaggggtgggggaggtcccagactcttttaaacaaccagatcttgtgtgaaccaactgagtgagaactcactcatcaccaatgggatggtgttaaaccactcacgaggcagggtctcgttgttttattttattttactttttcatttggagacagggtctcactgtgtcactcagttggagtgcagtggcgtgattttggctcactgcaacctcgacctcctgggctcatgcgatccccgtgccttagcctcccaagtaactaggactacaagtgcctcccaccgtgcctcgctaatttttgtattttttttgtatagatgtggttttgccatttttcccaggctggtcttgaactcctgggcttaaaccaggggtccccagcctctgggccatgggctggtactgtctgtggcctgttggtaattgggctgtcaagcaggagctgagctgcaggtgattgagtgttactgcctgagctccacctcctgtcagtggctgcattagattttcataggatcccaggccctattgtgaactgcgaatgtgagggatctaggttgcgtgctccttatgagaatctaatgcctgatgatctaaagtggcacagtttcacccgaaactctcaccgcctcccaatccatggaaaagttgtcttccacaaaactggtccctgatgccaaaaagcctgcggacagctggcttaagcatctacctgcctctgcctcccaaagtgcagagattacacatgtaagccactgtgcctggcccagagtgccactcttaagcactgattacataaacattgaggcaaccgttggtaactaaataaatcacacacatcagacaatgatttcatgtcccaccacaatgtagatttccagagagctctttgcaaagattggaggcagaatttcagggcatggttgtccagccttctatagctttatcctttagaaagacctcatgttcaggttgggaggcccagtgacttccagaaggaaaggcactcagagcctatagaaccctcct

SEQ ID NO: 22471 - DNA, 1032 bp, Homo sapiens
ctgttgcctttctctcgattgaggcttatagtgactgcaggaagaaagatggaaattgggacaagctaagtttggggtgtccagaaagtgtccagcctgcacagggtgcattgcaggcagtcccagcacgctctcaggccagggcatgaactgtatacaagcaacttggccttaaggtaacagcaaaaagtgatgactctttagaaaagaaaaacaccctttatattcatcagggtcatatgcgtttttcttttcatatgtatacaaaagaggtactttgggtgatacaaggggtatatgccaatgtcaagagcaggcaagaacaatggaaaaattagcagattcatcagttctcctgcttatacttcagttccaagagtaaaatgttagtttgttcaactctgcgctttacgccttgatcacagtgtgaaaagtgttgactaagcttagcttcctggtcagagggtcaagacccgtggcttttaaacatgcttatatgaaatccaaacattcatggtcactagtgatctgaaatcaaggcacaacttatgaaatgaacacgtaattatcttgtttactcagggtataaatagagttcatgcattttaaaatttttcttcctgaaaaggacttgcgccagcatttggtctttagataggcatgtgctctctctctctctctgtctctctgatgctcttgttctttctcttcttcatctttttcctcctgtccctgttcctccccaaactttccttctcccctcccctctctgttgtctttctctcttccctctctcttcctccccctctctctcctttagaagggaagggacttgctagtgcttgttgcccctgcaagaggcaggaacagccattgcagttctttctaggagtatttcctgcttcccacacagctttggtggggggaagatgctgcccagggaatccctggtgtgcttgaacatagcattgccacttctatgaatgcaggcaagggccacgaagcccacgtctgcttcagacaacccagctg

SEQ ID NO: 22472 - DNA, 1050 bp, Homo sapiens
aaactaaagtgagctgctatccgctttattgaagttggtgaaatgcatacctcctgcaaacttgcagctctagaaagaagacccacttgctgtcttccacagcctccctgtctgctgctgcactcggctgcagttttattgccagagtctccaagtgcaaggtccagctgctctttgtccctgggcatgctgtccccctcgttcttcctgtgctcttgacaacggtgtctgcaccaggcttttgatgggaggctgctgttgccttcagggatgggatggtcacatagtaggctctcagtgaacatctggtgatgaccgtaaatgtaatctccacttggccgaagaactcatgggaattgaagggtggattcaggcaatttaagcccttcagcattcccctctacatttttttctttcctttcctttcctcttttttttttttttttttttctgctgttcatttagaatctcctcatcacggtgcactatttgttccatcccacgtttcttattgctagtcttgcaagggaagatggtaggtagaagaactgtagcgtaaggccagcgttgcccacgcagggcctgcctaccttgtgctcagacctgggttgggcacaaagggggccatcctgccttcaagaggcttctagtctgggcgcagagcccagactccccaaggaaatgtggagacagccttggtgtagattctgtatttggggcaggccagagggggacactgttttctggcaccccagcatccctggaactccagcatcctcaactgcaggccacttgaggtagtgatggcttagcagtgaggcgcatggcatgtggagacaggcagtctggggttcagtcccagcaatctagtgatcagatgtgaaactttaggcaagttatttaacctctctgtgcctcagtttcctcaaccataaaacgaatatgatagtagtaaaactcactgatagagtttgagaattatgtgaaggcacttagaacaggactgagtgcccaggaagtaccacgttagttaccattgctgtttgtttc

SEQ ID NO: 22473 - DNA, 1045 bp, Homo sapiens
ctgggatttaggactcttaaccaaatctggttagtcctccctcttatttccaacaagtttgacttgtatagaagtgcgattaaaataagcatttaaataaaaatctggatacaatgggtattttattattacctgttaaagagaaacctgcaaggtgaaggagagagagagaaaaaatctttaagcccttaagtaaagaaagaagtacttattaaggcttctattaagaaataactgcaaaacacggttttacaaatttctcagactgcataacaatgtcgcaaaacttaatttgcatcacttgattcttttttttgttgaaaactgggtcagtagggcctgagaaactattttttcagatcttaaccaatgaattcttctttataaatcgctgctcttaacatgatagtagttctgaattcatcataaaaaacctttttacagagcctcttagaacagatctctagaagaaggcttacaatgagtggcagagacgtcctttgttatctgatgtaattctttgcaaagaaggattgggaacggagtggctgtttaaaaatgtcttgctcagaccgagatgaagaaggggtcaagtttgcaatcaaacagttattgccgagatgggcgactgtcactggctaggctaatgtgggatgcagctgtttgttatgtgagcaaaagaatgtttgaatcagtgaacatgtgaaaatgattccagtgaaccagaaaatgtgtttgttctttggctctccaaactgctgagaaccaagcttaagatcaactgcgaaaactaggacctctgacaaattgagaggtcatattttctaacagaaaatggacaaaactagtcacacagatcacttccccatcttccccctttgttttatttttgttttgttgttgtttatttgacttaccagtaatttcacaccgtggtcaatgtcattcaatgtagcctccgtgtacaatgcaaagagaaactgtttggaaagcagcagcttattaattttacttttatggcatttagaaagcggggtggctgttt

SEQ ID NO: 22474 - DNA, 1013 bp, Homo sapiens
gtcagaggcccccgtgtcttcccctggcggccacctttccgctggggcccaagggtggtctgtccacttgggacgccctgctcgtgccgggatcgccgttgctctcagatgctggttcatgtgcggctgtcacatcatcctcctccttccccggagccggatgcctaccagcagtttctttttataaacttcccattcacttggtagacttgtatcatctcgtgcttaggagcgatgatttgggaacaatcagtaacacttcggggcttttaccatctttctgacccctttacatggagccataaatcccgcttctccggggctgcttgatgccagtccaccgtcacttggcatttcagaaagagggtacttgcacaggctctgaaagtcttcagactaggagtgtaacatcagagatgtgtggcataaaattgcagaggcagagcaccctctctgctccagcacttaacaggcaggacatggttttgcttgtgagggattagattcgaggccgcggagtcactcaaatgtgtttctctggcggcctcacttggcccatctgtgggatggacaccgctgttgcctgggctgcccttctgtttccaacactcctgcccacggagcttctgaggagctccatgaagctctcctccctatgcatgttagcgcaagggacggaacagttcatttaaacctaaatttaatggaaataaggaaaacatagattagctaaggacaggttacaatgaggcaaggaattaagcggtcaattttcaaaacagagcttgaagcattagctgcgtgatttccattgactcgaatgggaggttccaggctcaggtcttgaccaccaccttgggtgtgttggggtgggagttagtaatttgctttgcagacagccacaaggtgtcccttgattgatggtttggccagaagcaggtatcacgagcttccaggatctgactcttacccactcccatgcttaccatgcactcaggtagctgggaaatgat

SEQ ID NO: 22475 - DNA, 1012 bp, Homo sapiens
gggaggaggaggttgcggtgagccgagatcaagccattgcactccagcctgggcaacaagagcaaaactccatctcaaaaacaaacaaacaaacaaacaaacaaacaaacaaagtttctacttggtctcgtccacgagtcccgttcactgactttatgatgctgttgttgttcaatgacttcactattctttttttcttactataaagtaattcttgttcatcttggacatttaagagatacagataaataaaaaataaaaaaaattaaatgtgtatgcctaccaccactcaggaataatcactgtgaacactttttttttcactaaactagtaaatattttgttatcgatgcatagtttatgtatagattttagggtacctgtgctaatttgatacattcatataatgtgtaaagatcgaatcagggtaattgggaccttcatcaccttaaatatttatcttggctggatccagtggctcatgcctgtattccaacactttgggaggccgaggtgggcagatcacttgaacccagcagtttgagaccagcctgggcaatatagcgaaaccctgtctctacaaaaaatacaaaaattagccagagcggtggcatatgcctgtagtcccagctacttgggagggtgaggtgagaagatcgcttacgcccaagaggcagaggttgcagtgagatgagattgtgtcactgcactccagcctgggcaacagagcaagaccctgtctcaaaaagtattatcttttctctattctagaaacatttgaattattctcttttggctattttgaaatgtacaatagattattgttaactctcgtcaccctactgatctatcaaactcgaggtgaacatttttaattcatacttttccagtcctttttatgcaactaaaaatgtagttagccaaaaagtacatacttctgtgtaagttcttactgaaatgtatgtcatattttttcttgtcattgaacatttcccaccaggatcagcaaagt

SEQ ID NO: 22476 - DNA, 1045 bp, Homo sapiens
aaatcttaggcttctgtccaccttgctgcctatctgtaagtaacaaatctgcttcacataacctgttgcatgtattctgtgtcattgaacttggacaggctggcacccatcctcacacatgcctccaggcctttacacatgcaatttgttcactcatatccttggagccgctacaatgtatcctgaagttattactcacctactaaatgtcctttgagtcacagctcaagtgccacctgctcagaggagacgtcccgcccatcctgtctggaaaattaaccccctgcccttctggcccatccttccttgatgatgcttacctttctgttttagctgtctctcctccagggatgaatgttcgtgaaatcaaactgaccagggtccagatctcagttccaccaggcaccagcttgtgtggccttcagcaagatactttctgaacctcaaatgtgctgtctgtacaatgggaaaacactagtttctagtttgtaaagctgttaggatgagatgatgtgcctggcccatagtagctgctcagtgaatatttgttccgacatggatgaaggaagtgagacttttgtgatgtctgactatttttagactggagaggaagagggaggcatatgggaaagaaggcatggcagagacaaaggtgaagcacattggtgagctaggtgtgtttagtggatgttgacgccatgtggttgggaatgtgctgggaaccctggaaaaggagactagggccagactgtggaaggccttggacgccaggcaaggatgacatcctgcaagctgggaccagctagaggctcataaaccctctttctctctctctctctctctgtgtgtgtgtgtgtgaaatgattagggggtttatagcatggctaccctgtgagcactgtgtagggctccatattgttatctgggtcttgttcctcacgttttccactccctcagacacccgcccttttccccacctcctccagcagacatttgtggacctcctgggtcccagacagcagtgtggccgggtcctgtgtgaact

SEQ ID NO: 22477 - DNA, 1039 bp, Homo sapiens
gttgcaaaagacatttgttccttttgatgactgagtagtattccatggtgtatatgtaccacattacctttatactttcgttgatcagtgggtacttaggttgattccatatctttgcaattgcaaattgtgctgctataaatgtgtgtgaatgtgtgtgtgtgtgtgtattgtgtgtctttttcatgtaatgacgtcttttcctttgggtagatatccagtattgggactgctaggtcgaatggtagatccactttcagttctttaaggaatcttctgttttccacagtggttgtactagttctcgtaacaggtaacagctttctgaggtagatactgattttatcctgcagtagaaaatggggatctgaggttctgaaatgttaagtaacttccccaatgtcacacaggaagtgctggagtctggatttgagccggtctgttttattccttctctgtgctcctaaccattgtcccatcactgtgaccccaacctacctagcctcacacacctaggattttgagaactctaagacaaacataattgtagttgtccaagattcttgcttttttttttctgccttaactaattcctccctattagttagaactaaatctagagttttaaaaatattccttcattatattctctacggtctggaaaatgaagttatcatcaagataggtcaaggtcttgtcagatgaatgaaaacaacagtaatgatgtattttcctccccattaggtctgatgcctcgctttccagccagctcaaagttctaatggacggtcagagtgaaatgttctatcagtcccttgtccagccccccagctggttgaattgggagttttgtgtttgcaggggaccctctatttccccatctgtctgggtgggcttcagcaagcttctagtatcagcatctccatagcgccctcctctgggtccaccccttgcttggtgctgtatgcttcttgctttgggcagacaggagcctggggacaccactccttcaccatttctgttaggtctggcctttggg

SEQ ID NO: 22478 - DNA, 1067 bp, Homo sapiens
gtgccctagaaaatgcgttcactgacagcagtgagggtaccttcaaaattcaagtcctatctgccctacctcaccacaccaaccaggaaattaaacaaccatggtgcccttccttagtgactacatttgtgggtgtgggcaccgtggttcttttctcttttctttctttctttctttttttttttttttttttttttttgcgtcagggtcttgctctgtcacccaggctggagtacagtggcatgatcatggctcactgcagccttgacctcctgggctcaagcaatcctcccaccttaacctcccaagtatctgggagcacagttgtgtgccaggcaacacaggtgactaatttttaaaaaatttcttgttgagatggggtctcattgtgttgcccatgctggtctggggctcccgggcttgagtgatcatcctgccttgacttcccaaaatgctgggattacaggcatgagccaccatgcctggcctcaactgtgattttaaatggtgggattgagattttttccaaaagtaactgaaccaagaaggccagagggacaaaacttgcaaatcgagttatataatgtatacaatatgtataatatatataatatgtaatgtatatattatgtataatatacaatatgtaacatatattatacatacatatataactacgtatgtataagatatgattataattacatatgtattacacatacatatatgatatatattatatcttatacatacataattatatgtataacatattataatatataatgtatgcatagtatataatttatatataatatctgtataatttatgtataatatatagctatataatatatattatttgtgcataatttatatatagtaacatatatttatatataattttactgtgtatatttaaggcacacaacatgacattatgggacatatatagatagtaaaaaggttactgtagtgaagcaaattattatatccatcatctcaaatagttatcctttttttgtggcaagagcagctaaaatctaaaatctaaaattcatttagca

SEQ ID NO: 22479 - DNA, 1046 bp, Homo sapiens
attgcctctgtactttgtcttttgctctgctgttggatgtttgggacatcacagcacaacccaaacatccttgtggcttactcatggaccacccagaagtagtcgatgcaagccctgaaaactctttcctgaatgttccagtctgcatcaaacaacctggtatcagctccagatctgttgtgttgacactgcttctggtctctgggaaacactaaggtcaaacttgatgaaagggcagaaagccaggccagggtggctggtctttctcaacccagacctctgatccattttagcatgtctcttccatcagtcgtaaggacttttaaggtcttaacatctcacactgctgtgttagtctgttctagatttgctataagtacctaagactgggtaatttataatgaaaagagtttgaattggctcacagtcctgtaggctgtacaggaagcatgatgttgcatctgctcagcttctggggaggcctcaggaaacttacagtcatggtggaaggtgaagtgggagccagcacttcacatggcctgagcaggaggaagcgtgagaggggggaagtgctatacacttttaaacaaccagatctcaggataacttactcactgtcacaagaacattaccaaggcaggtagtgctaaaaaccattcaagagaaatcttcccccatgatccagtgacttcccaccaggccccacctccaacattttacaattctctacatcagatttgggtggggacagagacccaaaccatatcaactgtttagtcttctgactcactggggagaatttgtctgggcttctgaggggattgtaaggtagtcatgggccagattaggacaagagcaaaactttatatatctttgcagtcaagaacaggacacattgctgtattatgcaaatggaatcttcttccagctaactctttcttgaagtatttcaaaactgtctagctctgaatttcagatattgtactcttagtctcacaatttccagttgatttcttttggcgattcccattttctacctaaactcc

SEQ ID NO: 22480 - DNA, 1054 bp, Homo sapiens
cacaggtaccggaagcggggctgctttggacaaaggcgagggaggtgcctgtatttcctagaaccaggtagcaaatgttgcctgtgtgtttcatcagaaagcgccccagttgggcactgtgcctcttggatgctgacaagaagatttgacgttacttctctggtccttaactttgtttacccagctgctattcttcccatacttaactctttcaccgtgcagaaagcaagggggagggaggaagggaagctccaggtgtgatttttcagaacaaaatataatgctgtgatttatttttaaaaaagagaataagcacgaggaaattgaatagcatccatttcatgcttaaccgtggttcacaaatgatagtttgtaattaaaattctgtctgcaaacctattctgcagaccccaaaagaaaacttcctcagaatgttatcaactctccaatttctgtaaagatgccatattttcagatttcaaagagaggatctccttttgaaaataaagaattgttgggtatcgtatgagcctgctaagtacagcattttaaacccacactgtgttgaaaaattcaagaatttggcagtgaccttaaggccacagataggataatgaaaaatgaggcgatgagggcagtgtctaaaggaactactcttttgttctaacagaagctttgtgtgtgtgtggcttaagcaagtggttcaatagaatttctttgaaacagaaacaaaaatgctaagagctggttacaagtactctggtcttcttttctccttaaaatgcaggaagaatttttacctcttctcatgaatcttgtctgctgaaatgtctcagtcttcatgttatgtttaccaaggccaggccagaggatctgataatttataaccattcctattgggttttatgtaataactttggaactcatataaagtaatgatccacaaactcttttaatgttcattataaaatatgaaatatttctcagaaccattgcaattatgtgaccagacataactgtttcacacatgagtaaatacagggaggtttaacat

SEQ ID NO: 22481 - DNA, 1571 bp, Homo sapiens
agcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataaggtaagcattggttcaggaagtctttcagaggaccttcgcatcttagagtgagaagggaactttgtagatctaatccaatcacctcattttatagataaggaaactgggtcccagaaaagtttgataagttgcccaaggggatcccaacttaccagtattaaagttgggactgttcagaatttctgctgtagaatccttttccctgcctgctgcctccttgacagcctctgtgttttagtgtgtatagtttaaagtgttgattttctgttgcaagagaattgtagggagtgtatagtggattgacatacgtttgacttaacgtatt

SEQ ID NO: 22482 - DNA, 1023 bp, Homo sapiens
gagaacagagcttttgcagatggtaggcccccaccccaaactttaactggggctccccgctgtgatcttattcttacccaagtatgactgccagatttcatctgcattattaaaaaaaaaaaagcacacacacagacacacaagatctttttatgtactagttaagtagcagtcaaccgagtttctggtaataagaatattagaatcaaaagatttaattagagctccatgaaaaggcggatgccacatccggagaattaaggataaagtgtactaagctgtgccgctttggttcagctcacttaaattgatatactttaaatgtctccagtgtggcacataatgtttatgggagataagacatattggggtgactttcccttttagatttgctaagaattaaagttagaaacgactacagagtgaaatgttttaccataatgtttcattaaattataccccagaaagcataactgattctagaatgcttctgaaagaactgattttgacaccactgtagcaccaaaattctcatgtcaaacagatgtcatccctgtaaaactctctgaaacaaaaggagtttatgatatagcatctgtttttgcagtagatggctgagctaaaacagttttgtttcctttttacaaaatagccctaaatgcctccttttattttaattcattatgtttccatatcccctttaaaggagacattaaaacgtctgatatgattggaccataaatccctaatgaaaggatgaagtaaatactactcagtagcaccacctgcagttaatatcagtgttggaagatgtcttttttagcaccgtcctaaaaagcaaacatttcaaactgtccaaatgagttaacattaaaattcacaattttaataaaaagattaaagtgtcagctcaaaattaaaataaccacttcagactttacagtattaatgaatgtttactagattttatgttgcagcatcttttctttgtggctcatgctttttttttagggttacatgcat

SEQ ID NO: 22483 - DNA, 1029 bp, Homo sapiens
gaactcctggcctcaagggatcctcccacatcagcctcccaaagtgctgggattgcaggcgtgagccactgcacctggctggtattatgtcttgtttgatttgttaagatgtgaactttaagcttgaatcttaggacagtaggcattttgtctagttgatacataggaaattgtctttatctgtcaattttatgttttcatttcatatgggtataaatttcatagcaattttcaatgccttagagttcatttcagtaatttggcagtaaggtactcagtattcagcaaaagatccttaaaacttaaaggcaataaaattttctatgaaagagtccatttttcaaaattaagctagtatgtgtagaataagtcatttaatttcattacttgatttttcccaaaagcaaattcagatatatatttcagaaaatataggcattctcagtgatagtgctaggcaatgcgcatgaactttcacccccttgtcaaaacttagcaggtttaactctctccccagattctgtagatatgatacaagtgagtgtgggaaagttattgtattaatctcaatgaaaacctgacagattgtgccataaaaggtcattgtttaatcccaaagtgtggtgatctgtgtatggtttcgaatatttaatatgtgcttaatttgcaaaccagcagacttacttataatcactcttcagaaagtacatctgtttgcagagtcttaaaactctgtggaaggtgtttgaccttgcctcagtcctcctcagtgtcttccttccttccttctttccttccttccttcttttcttccttccttcctttccttccttcctttccttcctttccttccttcctttcctttcttcctttccttcctttcctttccttcctttccttttcttccctccctccctctctccctccctccttccttcctttccttccttcgtttccttccttcctttcctttcttcctttcctttcttcctttccttccttcctttccttcctttcctttccctcccc

SEQ ID NO: 22484 - DNA, 1050 bp, Homo sapiens
gtatagcagtgtattactgtgcttttgtttgcatttccctgataatttctgagtttgagcatcttttcatttgtttatgggctattattgcccacttcttttttgcattgtctattgtattagtttggcattgttataagggaatacctgaggctgggtaatttataaagaagaggtttatttggcttatggttctgcaggctgtcctctgcttctggtgagggtctcaggaggcttccagtcatgacagaggtgaagcgggagcagatatgtcacattgtgagacatggagcaagagagaggggaggaggtacaggctcttcttaacagtcagatcttgcagtaacagacagagaactcattattcatgaatggctacaccaagccattcgtaagggatccatccccatgacccagtcgcctctgcccaggctttacctccaacattggggatcaaatttcgacatgagatttgaaaggacaaatatccaaactgtatcatcggctgttttcttactgatttgcaggagctcttcatgtattctgagtacaaggcctttgtggggcgtattgcagatgtcatctaactgtggcttgcctttctactttcttaatgatgtcttttgatgaacagacatttccagtttaatatagtcaaatgtattaatctttttctttgtgtttaggacttttgtgttcttatattctgaaactagttttgattttttgaaatagtctgttgagtaaggtagacgatgatacagaaataaaaatgtgtgctgattttcagggatggcacatcaactatgcgtgcttaggtattactgagcctcatttactaatatggcactaaagctaaaaaaatctaaacagaaaacattccagaaaggctttcagcagggggaatgacagtttggaatggaaatgataaggttgtctctcagtgtagtcagttattgtatgggatttgtataaatagaagtatattagaaatgatgataatagctgatatttttgagaagattgtttgtgggccagacccggtgtgct

SEQ ID NO: 22485 - DNA, 1023 bp, Homo sapiens
cactcatattgtaagtcagttttttcattgctggtacaatgactcagtatttctttataaaaatctgttgttctgaaaatcaacaaccttagaaggattttgtcttagaaaatttccttggctttagttttatatcatatttagaaaataataatgaaaagcatccccaaaatttcaatgatgtgaatttttaaattacctttatttctttaaactaattccattgattgttacttaaattttccacctggaatcatggatttaaaatttccccacctcatggggaaaaaactaacccagaagttcaaagcctttaaagtttcatctgattctggccttagaattgtccttaaaagctttctcctggccgataggaggaagcatatatcaaggaggttctttcccttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccgtgatggcaccattgcactccaaccggggtgacagatgaggtcctctgtttacctccccccccaaaaaaaaaattcagtaggaattccttcatagaataacatgttatttattggtattgacttcttattagacagagctcatagtatttgttttctgctccgaacacttaaaaaatactaagacgtgatagtgaaaatagctttgaaaagaaactacatatggcaaaggtggggaggggggaagatgatgcatt

SEQ ID NO: 22486 - DNA, 1054 bp, Homo sapiens
ccacattctgacataactgataaggaaggaactgggacaagattgtccggtgatactgcaacaaaaaagggaagagaacaacaagcagacatcattggtgaagaacagtcaccagaataattttacagtggagatgtggaggttgtaaccacacgtgtcacattaaaagataatcctttgccactgtggaagatgaatacaaagcagaaacataagaaggtatgtgccttcttcaaggggaaacaggaagagaacaaaaggaagtgaaatatgaactggcagactttagacaagaaatagaattacaaagtagaatcattatagaaattatgaccgtctcagatgcaacatacaggagactggaatccgtagaatgtacagaaagagcaatgttggacaggactgagagaggtcaacaaaatgaaaggagattgaataaagtgacagtatgagaaagcaagtgacaattgaggacaaagagcagcaagcatgcatcatttgtgtcccaaaaaaagagaacgagaacaataaatcaggaaaaacacacacacacacacacacacacacacacacgtttaaagatgtaattcaaggaaactttccaaaagtaaaaggaaatttgaatctactaattgaaggggcagagcagtttccaggataaattggcctagaaaaatcattagcaggatagagttctctgaagttgctgaacttaaatatgtaaagaaacctttggacattctagacgaaaagatcaagttaccaataaggagaaacaaaagtcaacctagcattcagtttctccacagtaatgtctaatggtcaaagaccatgaatgatgcctagaaaatgctcaagtaaaagaaagtgatttacacattttaacccagtcattccattgcatataaagatggcatacaaacttttttgttcctagaaatatgtacttttaagaatacctgaagaaattggaagaggaaaaacttcatccatccatgagatacatggaaaaacaatgacagaaagatgctcagtggggctcaaatttatttaa

SEQ ID NO: 22487 - DNA, 1051 bp, Homo sapiens
tcataggcctaaatgtctaaaactataaaacatttagaagaaaatatgcaaatgaatcttttataactgtggagtaggccaaaacttcatagagaccacactaaaaacacatgattaaaaataaataaataaattggtgttcatcaaaattagacatttttgtactccaaagtacaccatcagaccaggtgctgtggctcatgcctgtaatctcagcagtttggaggccaaggcaggcagatcacttgaggtcaggagttcaagaccagccgggccaaaatagtaaaaccctgtatctattaaaaatacaaaaattagccaggcgtgatggcacacatctgtagtcccagctactagggaggctgagacagaaggatcacttgaacccgggaggcagaggttgcagtgagctgagatggcgccactgtgctccatcgtgggtaacagagcgagactctgtctcaaaaaaaaaaaagaaaaaaattaagactcaaaagtcaaaattattccttgatccatgggctgtagaatagattttgtgttagcaggcatgaaaataacacagataaccagatgcattatcaatgagcagtagtattttgaaaagaattttttttttctgtgtagtagatctcaacagtgggcctaaaatagtaaatcgtgctgtcaacacatgggctgtcatccaggttttgttgtccatctttagtgcacaagcagagtagatttcacatcattcttaataaggaccctaggattttcagaatggtaagtgaacattggcttcaacttaaagccaccagctgtattagcccctaacgagagtcagcctatgctctgaagctttgaagtcaggcattgacttctcctgagctgtaaaagtccgagatggcatcttcttccaatagaaggctgtttcatctacattgagtatctgttgtttaatgtaggcaccttcatcagggatcttagctggatcttctggatgacttgctgcagcttttccatcagcactttcagcttcaccttgcacttgtatgttagggagatg

SEQ ID NO: 22488 - DNA, 1047 bp, Homo sapiens
aatacaaaaattaactggctgtggtggcatgtgcctgtaatcacagctattcaggaggctgaggcaggagaatagcttgagcgagccaagatggggccactgcattccagcctgggcaacggagcaagactctgtctcaaaaaaaaaaaaaagaaaaaaaaattcttatattaagaattaggaaaatctctcttgagtgaaaagagacaatcaatagatgctaacactgagatacacagaaattggaattatcttacaaggaatttaaggcagccatcataaaaaaaaagcttcattgagcaattacgaacacacttgaaacaaatgaaaatacaaactctaagcaaagaagtagaagatacaaagaagaagcaagtggaaattttagaacagaaaaattccagtaatcgaagtttaaaactcagtggatggactcaacagcaaaatgaagtagtcagaggaaagaatcagtgaacttgaagatagaacaatttagaaattacctaatctgaacaacaagaaaaaatagaatgaaacaaaaatgaacagagcctcaaggacctgtgagactataatgaaaagtctaacattcaggtaatcagaatcccagaagaagacaagaaaagagtttactgaagctgaaaaaagtatgcaaagaaatactttcggaaaaaatagttgaaatttcctcaaatttggcaaaagctataaaccttcagaatcagcaagctgaactaatatcaaacaggataaatccaaatagagccacactaagacacattataatcaaacttttggagactaaagataaattttaaaaaattgaaagtagtcagaaaaatactgtacctataggggaaaaccaatttaaatgacagtgaattcctcatcaaaatcaaggaggggctgggcacagtgactcacgcctgtaatcccagcacttttggaggctgaggctggtggattgcttgagcccaggagtttgagaccagcctgggcaacatgatgcaaccccatctctataaataataataataataaaatgat

SEQ ID NO: 22489 - DNA, 1039 bp, Homo sapiens
ttcatacctaacccaagataaaatttagccctgtgaaaatagatggaaattattctggacagtgtgatttaatatcattccagacatagcaagtgtcaacaggactctggactgcatacaaagcaggaagttcagtgggcctgcagtatcttcctgaaaatgtctgccatgctctgtgtgaatctatgagccatctctggaggctgattgggtatatgatcatagataaaagattttagagcatcttcatctgccagatagggatattaggactttattagaggaaaagcactacatgaaagtaattaaagaatcatagtccagtcatgtcacttaacaagggggatatgttctgagaaatgcatattaggcgattttatcattgtgcgaatatcatacagtatacttacacaaacatagatagtatggcctactacacacctaggttatgtggtataacctactgcatctaggctgcaaacctggacagcaagttactatgtttaatactgtaggcagttgtaacacaatggtaagtatttgtgtaactaaatatatctaaacatagaataggtacagtaaaaatataaaggccaggtatggtgggcctgtaatcccagtgctttgggaggttgagaaggattgcttaaggctaggagttctagaccagcctgggcaacatagcaagaccgcatctctacggaaaaaaaaaagaaaaagaaaaattagccaggcacgatggtgcaaacctgtagtgctaacaagtcgggaggctaaggcgggaggatcacttgagcccaggcgtttgaggtttcagtgaactataattgcaccattgcactctaccctgggtaacagagtgagaccctatctctatttttaaaaaatactgtaataaaagattaaacattgtatacctatatagggcagttttcataaatggagcttgcaggactggaagtttttctgtgtgagcctgtgagtgaatgtgaaggcctaggatgttaccatacactattgtagactttataaacactgt

SEQ ID NO: 22490 - DNA, 1046 bp, Homo sapiens
cgccaataacataaggggaattaaaacctgtccatcagactgaatcaggttcaacatttgagcacatctaatattctaagatgtagattctgaaagcaggtaagctctttctcttcctgcagatactacttccacttaatgtaagaaaattcctagctttgccaggcacagtggctaacacctgtgatcccagcactttgggaggctgaggctggcaggtcatttgaggtcgggagtttgagaccagcctggccaacatggtgaaaccctgtctctactaaaaatataaaaattagctgggcgtggtggcacacacctgtaatcccagctacttgggaggctcgaacctggtaggcagaggttgcagtgagctgagatcaggccattgcactccaacctgggtgattccatctcaaagaaaaaaaaaagctagctttgatctcatttataattgtttttcagaggtactgatattaacaaataccactccctccaaaataactagagtgataatgactgaaaaagaaaatgaccaaaatagacatgttggtaatgctactacagtaataaacatgtttgtaagagaaatgacttctaatgatttcaaatccagttgagacacttcagcatttaaacattttggtaacatatcactgataatgttgcaggtgacttaaatgttctctcttttgttgtgctttctttccactaggttatgaaaacctgcactcataagttacggttttcagagacggagacttgctgtgttgctgaggctggcctcaaactcctgagtttaactgatcttcccacctcagcctccctcgtagctgagactgtaggtgcaagccactgctcatatatttaaatcataaacttaaccatcaaccagctgtttggtgtaaccttttaaatgtcgtagtcctgtgagacctagcacaggattaaattcataaatttaacaaggtgaataggattagtaaaaaaatgaagggaaatgtggtttgcaaaccccagtctctgcgttagccagcatactactgata

SEQ ID NO: 22491 - DNA, 2055 bp, Homo sapiens
gcctggccaagatggtgaaatgccatctctactaaagatacaaaaattaggccgggcgcggtggctcacgcctgtaatcccagcactttgagaggccgaggcgggtggatcacaaagtcaggagatcgagaccatcctggtgaacacggtgaaaccccgtctctactaaaaatacaaaaaattagccgggcgtggtggcaggcacctgtagtcccagctactcgggaggctgaggcaggagaatggcatgaacccaggaggcagagcttgcagtgagctgagatcacaccactgcagtccagcctgggagacagagcaagactccgtttcaaaaaaaaaaaaaagatacaaaaattagccacgatggtggcgggtgcctgtagttccagctacttgggaggctgaggcagagaattgcttgaacccgggaagtagaggttgcagtgagccaagattgcgctactgcactccagcctgggcgacagagagtactcggtcaaaaaaaaaaaaaaaatcacgactgtaatcccagcactttgggaggccgaggcgggtggatcatggggtcaggagatcgagaccatcctggctaacacagtgagaccccgtctctactgaaaatacaaaaaattagccgggtgtggtggtgggcgcctgtagtcccagttacttgggaggctgaggcaggagaatggcgtgaacccaggaggtggagcttgcagtgagccgagatcgggccactgcactccagcctgggtgacagagcgagactccgtctcaaaaaaaaaaaaaaagaacaacctttgaggttattccatatccattgaatcagctctttttatctaaatgtctatggaaagaaggctcaggaaggagaggaggttgtagaatgaagccactgaagttttccgggcaaatactgcctggctgaaaccctaccaagttattactctcttgactgtaggctgagtcatgccaggtgacttcctgaaagctgctgttgctcctgatgcttcaccgccgttgtaccatgtggcacacatcaccacatcacaaagcattttggttgctgaagtccccatagggcctaggagagctttgtggtgtccatcattatatcctcaggatctagccaagtacccatttcccagaggaatgaacaggcaccaaattctccatctactgtgatgagtttacccttcagagtctttcttctttcagcagggaccggaaccaccttaccctctctgcatctcccacctcttatgctgaacagctctcccaggtcaagcctcaggggtctgccctggtttatttactagttctgaggatcagtgtcctaataagcaacctcttaagaggatcaacccagctttcttcactgaatcttttcatgttgtctttgagggatctcacagggcgcattaatgaattcattttacacattcagttctaccttaggtactggtctgactgtctcaagtctcacattgtctatggcataaaccttaagaaaccctgcctttgtctttcacagtggtcatctccatcagaggcaactgaaagtttcttatcaaaagaaatttggttgccacccccacagttctacgaagtgagaagacttgcaaactttgcctctctctctgacttgcacaaattttgtttgggtcgtgcattagaaggactggaaaggtggctgccgatcatcttgttaactgctgatgggatggtccatcttttaccaggtaaaccagtgaagcatcggtgcttttgttagtattcacattcagtgccctgggctgcatggctgtattgcccaacgtagagacaggaattacagtctgtgttttgtaatctacagggtattagctaagtaagatcaaagcctataaaatatccatattattataaccagaaattctgcataatgtcatatacatacacatacatttatattaatatatttcctagacattgacaaaggtctttctcatataatttctcactttttttttttttttctgagacagtttccctctgtcacccaggctggag

SEQ ID NO: 22492 - DNA, 1018 bp, Homo sapiens
aacaaaaaccatcattgtttgtattccacactgttaatgaatgtaaagaggttagaaatgtagtgtttgattaatgatgtttatttttactgtatttaatatgagtaatttttcatcatctttcaagaggaataatgtttattgattaaaggtgagaaatgatagttaagacaccaattccatgtccagatctttgactgtatcatgcattgtacaattgatttcatattttatgaaatgccttaattttcctactataacataaagacaatgatgaataaagtttatgtgtatgattaaatccagattagagaactatatctagcacagcagtcctcagcctgggcacttttgccctagggaacatttggctatgtctggaaacatttttggttgttgaaactgtgggcagagtgggtgggtgggggagtatgctactaccatctagtagtagggagaggccagggatgcaactgaacagcctgcaatgcgcagtctcacccatagcaaagaattacctgaccaaggatgagacacccaatctaaagtaaaatctttttttttttaaataaatggttccaatatgtaaattttgagaaccacagatactattattctgtctgccttttgaatctacaaaaatgggaaattacgtccaattggaaaaaaaaaaaaagttggctgggctgggcgcagtggcttatgcctataatcccagcattttgggaggctgaggtgggcggatcacctgaggtcaggagttcaagaccaggctggttaatgtggtgaaaccccatctactaacaatacacaaaaattagccaggcatggtggcctgtaattccagctactcaggaggctgaggcaggagaatcgcttgaacctggaggtggaggttgcagtgagcccagattgcactccagcctgggtgacaagaggaaaactgtctcaaaaaaacaaaaacaaaaacaaagtgtacaaaaatttttgttgtcttttgatttttttgagatagagt

SEQ ID NO: 22493 - DNA, 1047 bp, Homo sapiens
aggcgtgagctaccatggctggccatggttgatttttaaattctcattttttttttccatgatcaatagggctataatgaatatttttctgattctgtctttatgtacatttgtttatttcttcagaattcttcagaatgaactcataaacatgaaatttctgggttttgagataatacaagttccaagaatgtgaaattgaatcccacattacctgaagaaattttagtaagttctagaagctttaaaaaaagcccaacatgccaggtgcattggcttacacctgtaatcccagcactttgggaggctgaggcaggcagatcacgaggtcaggagatcgagaccatcctggccaacatggtaaaacctcgtctctactaaaaatacaaaaattagctgggtgtggtggcacatgcctgtaatgccagctactcgggaggctgaggcacgagaatcacttgaacccaggaggcagaggttgcagtgagccaagattgtgccactgtactctagcctggtgacagagcgagactccatctcaaaaaaaaaaaaaaaaaaaaaaagcccaacaggagtcaaagcacaaagaatggttttgtggggaggggagagatgtggtggtgctgaatgatgagtggctaaaagccttagctcatctgcactgcttgctgttcctgcttcaggcctgagctcctagcctgtgaaagagcttttgatggtcatgtagaaggggctttttttttttttcagaaggggcttttgagtgcagagaatacagttcatttatacggacttttggcgtaaccagtacgtgcaggaaaaccttgagaatcaaatcaaagagcttttgttggtggggttgtctctatgaccagaagacgatccccacctccaggtcagagggcattggtcattcagtttcctatgtctgtgatctttatgtcttgttaaagattacaggctgacctggtggcattgcctttcatccctatttggattgttgctaaggagatggccaggtagtcaccctgtagttcttcacctagt

SEQ ID NO: 22494 - DNA, 1052 bp, Homo sapiens
ttgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcctcgacatccctttagggcagggggactctgggtgccatggtagggagcgcctgtgtcaagcagcaaagccccctaatgtcaagagcctcctccagggcctgccacggcatcttcctggccagcaacatgtgtgcacccaccgaggtacgccccagccactcccatctgtgcccatcagggactccccatagcacgagcgaacagccagccctgtttatttataggccttttcaggaagagctagcagggcagtgctaagacaggaaacccagtccacattttagggcttccttaaacaggcttctgagagtcgtatcttttttcttttttttccagaaaaaaacaaaacaaaacttttttgccaaaacacctcctcaataaac

SEQ ID NO: 22495 - DNA, 1097 bp, Homo sapiens
tgtaggaaagtgtcttactattccacatccctcatttgcatgtggggaacagacagccatggaagaaaagagatttgcccaaactaaaatagggggagccacagccaagacaagaactggcctggtcactggtctctaccgctttggatcattgctatctctgagcatggacaagttgactgtagagagctttaaaggctaaaaatataattggtatattaaaaaaaaagtagagaaataaggtgaacatgattatgattgttaagacagtctcaggggaggtgttaaacaagttcttaaaaattgagtaaagcacctctcacttgacaccaaatggataataataatgttaggtggcactaaatgtggctcagattaatactaaacagccacttttctactggaagaaaaatgaggcaacctaatgatgaccaagggaaattgtgaactgtccattactgaagataggcttggagtggatcgccctcatggtttggagggatgctttttgtcttgccttagtgttggcgtgagaacagatgacctactagctcagagtcggctgtgtggctttgaaaacaatggaaagtaatgacacatggacttttcaaagcaaagatgttttttaaaaagagaccaataaacagtgtacagaattgcctggctgaaggtttgggtgtagctactggtgtttgctaactgagctttccctcattgtgggatcactgcataaatctgactccagattttttccactgatgtgattttagcagttttgtgaaaagagaacaggatagttttatgttcctaacactgctttctaaatttctaagagtgccctgattccttggtggacaccgttcactgaacttagtttgtcttgaagtggcctcatgttgataggatagtcacacttttacacttcttggggcagctgtagggacttaattggattcagagtaatccacatgtgactgcttttcgaaaccgtgccttcatttctgcaggcagcagcacagggatgcttcagagctggtgcgtcctccgagctcacacgagctcatttggtagcacgaagtggccacaggcacggcagc

SEQ ID NO: 22496 - DNA, 1065 bp, Homo sapiens
aggaggtacaatatgcgattacgttcatcagctatttttggctgaggaataaacaaaatggcccaaactgctgccattcgagattctagcaggggagtggcatgtagaaaagattaatgtacagttaaaacccgtgtacgggtaaattacagggtgacagctatctaatgcaaacactgcagacgtgtaattaagaggagttacagcgctcgaggatgaatttgctgagggaagtgctagggtgctgtctggagcccaggggcaggggcatggcactgggatggtgtgggggctgcagaggtggccaggaggagcctctcagcatcggggcagccttgtaaccataacaggtccattgcctgatgcacgcagcaagtcaatgtgctaagatgccaggttgcggcagaaaaagaggattaatggtaaggtcatggaacgaggagatggcagacaacctcaaatccatctccctggggaatgtggggttaggatttgtaagttttggagtgggtgaagtgtggagatcgttgatgggtggaagagtgcagggtaaagtcttgggaccgggagaggaagaagctgtgttctcaggctgatccccctcctctgtagggggtcctcaaactgttgggggcaatttggggtcttttcaacatcttaagtgaacaaaaaccttatgattctaaaatcaggggtcctgtctatagggacaatggagaagcaaatcaaatttttttttttttttttgagacagagtctcactctgtctcccaggctggagtgcagtggcgcgatctcggcttactgcaacctccacctcccaggttcaagtgattctctggcctcagcctcccaagtagctgggactacaggcatgcgccaccatgcctggctaatttttttttgtagttttagtagagacagggtttcaccatgctggccaggctagtctcgaactcctgacctcgtgatccgcccacctcggcttcccaaagtgctggaattacaggcgtaagccactgcgcccagcaaagcaaatcaattcttacaccattttatgaccct

SEQ ID NO: 22497 - DNA, 1032 bp, Homo sapiens
ttgttcatgtctttctagggctttgttcatttcattcaagttgtctcatttgtttagcataacagtgttcatagtattctcttataatcactagtgatgtcctcattttcattcatgatgttagtagtttgtattgtctctctgttttctttcaaagtctagctaaaggtttgtcaattttgttgatcttttcaaagaaccaacttttagtttcattgtttttgtctgttgttttcctgctttgtattttattatttccttgctttagtttgcttcaggtttagtttgtccttttttcctctcttttgtttgctttatttgttacttcctctcttttgtttgcttcagatctagtttgttcttcttttttcatttcttaaggtggaagattaggctattgatttgagattcttcttttctaatatagacattactgctataaattttcctctaagcactgtgttagctttagtcaactttaattgtctgatttccagatcttcttattaaatttctgtctgatctgctgatctattggttctaccaattttatcacaaccttgggctagctaagatttttgaattattttcagcaacactcttgggcatggaattttccaatcaatcaatgttcatgcctgattccccttggtagaatgtaagcccccagggaactgggcaaggtgatgaaagcagccccaggctacaatgccataacctcacactgttcagtagattttcttgaataaacgcttcttgatatgttgtatgcttttggtcaatttctggagtttttttttttttttttaaggggtagggtctcactctgtcacccagactggagtgcagaggtatgatcatagctcactgcagcctcaagctcctgagctcaggcgatcctccctcagccccccaagtagctggaactacaagcatatatgaccatgtccagctaatttctttattttttgttgagagaggcatctcactatattatctaggctggtcttgaactcctgatatcaagcaatc

SEQ ID NO: 22498 - DNA, 1046 bp, Homo sapiens
cttgggggcatgggggtgggtatttaatcctattttctattccacccctgggaaattcacaaggggagggaagaggagctgtggtgagctgcagtgtgccatctttgtcattttccgtggccactgctgggccctagaggctagcagcaggcttcccttggagctggtgctgcagtgactagctaggaatgaatcacatacctcatcagtggataaagggtctctggccaggaccctggttgggggctcacaggcaccctccatgctgctgaacttataggctgcccaggcccttgggcctgcgagaggtttggggtgctgggtgctgccagctctcctgctcttccttgcagggtgtttctctcctgggtgagggacctgctttccccgttggcacggcagcagggctgacccgagtagggtgggtcttgagcagcttgctcagccgaggatgtttgctcctggcacagagaggcggtcatcgctcccctggggctgctgaaggctgagcgtgggagggccaaggctgtgggcatcacccctgtgttatgcatttgaaataacaggaggagttaattaatcccccagatactgagggatcatctctggggagcatacacggcaggctgcattgtcaccggtgtggttcctcagagcagggaggatggtagtgcgcagaggtggctttccaagcctgttggggctgcaggggagcctgtgcaggtgcaggcatggtcccttgaggaggaaaaactggaaatgggtgcagtgtctagttccaaatttggagagtctagggtacagatggtgactggtgttccagtaccccaggtggacagagactcagcctggggccctgtggccttggggcttgtggggtggggacaagagccacggggccaggtcagcagtgttggcctgtgtgctcactcacagagccctgtctaggatgggagatagattctgcttatttaatttccattttgccttctgcggcatttctgagttgtttgagatagatcatcccttaatcggttgacgacgtt

SEQ ID NO: 22499 - DNA, 1050 bp, Homo sapiens
aagagatggtggaggctgagggacagatgttttcattcagtgcagtaatatttgctaacaggaagaaagtagtgtgggtaagggtgaagaaggggccagagaagagagtgcagatgtgcaaaaagtgagagtttgtggaagcaggccgtgatgtggttccaagagctggactgtcgaatcttatttttgtaaagctctgctcttaagtaaaaaacccagagtcacctttctaccatgctaccttcagggcctgagcaagagtactgcgttgtagaagaggtggtgctttttagtatttaagtaattaaaccttccttgttgtattaaatccatatataataccttattccaacatatctcagatagtttctgtatctcagatagtttcagcaagagtttgtgtatggcaccgaatggacaagagctgtacatatatataaatgtcagaaagagaagaaaaatactaactgtaactttttggtttcctggtttgctgcttttgcatgtagactgttcttaaatatgctgaggttgggtttgtttttcccactttcccattctatcaacatcagttgttatttactctaaacaatcattctttcattttatcctaagtgagtttcttttataatttaattcagttcccttggtattaaacactgttcagtactttggaagtagcttacttaatagctttttctgctgtgtgatttattcaagaaatattcaaatgtcagctatatgtagagcactgtgttagattctgtgggagttgcaaagatgatctagatacagatctttctccagatctttaaattctagaagggtagtatagacagaatgatagaatgctgtgtggttttcaaaggaagaacagattatttcagcccaggtggagttgggtgatggctaattttatgtgccaacttgactgggccacagtgcctagatatttgatcaaatattttcgatgtttctgtttaagtattttttgtatgagattaacatttaagttggtagattgtgagtagcctccatctgtgggtgggc

SEQ ID NO: 22500 - DNA, 1068 bp, Homo sapiens
ctactcaagagactgaggtgggaggatagcttgagcttgggaggtaaaagttgcagtgagccgagatggcaccactgccctccaacctggactggatgacagagaagggacgctgtctcaaaaaaagaaagaaaaaattattagggcaatgtagcagcatgatgaagtttaaaatgtagaggacaaccacccctagtttccccattctccccaactacttttgtcattctctgtattctcttgtaggctgtatttgtaggtgtgtgcgcacatgtgtgtttgaagttgaaaattcacattacatgcaattaaccattatattgtgtacaattcagtggcacttagtgtagtcacagtgttgtgcaactaccacctctccttagtttcaaaactttccatcatcctactaaaatacccctaggcattaagtaatccctcttcatttcccccataccctgttgaccactaacctgctttctgtctccatggtttttcctatttcggatatattatgtaaaaggaatcatacactgtgtgacgttttgtgtctagcttcttttactcagcataatgctttcacgcttcactcttgatgtaacatgtatcagcattgtggtttttttatggctgaataatatttcattacatgtatttttaaatatatatatcatatatataagatatatagagatcataatttgtcttttgttgatgggcatttgggttgtttctaccatttggctgttttgaataatgctgatataaacatttgtatacaagtttctgtgtgaacataatataatctctggtactttgttttggcagccctagcaaactatattgtgtgctttatttccagtgtagtgcttagcccacttgctggactgtaacttccctgagggtggggacataaatataatgcctgcctaatattacttaaatattctaagcctgctgaatcactacattttcgttaattcatgataatccccaaaatatcccagaatcagatcagtatctattcagctacataatactacttaatagtagtagtatggcttactttga

SEQ ID NO: 22501 - DNA, 1050 bp, Homo sapiens
ttaggcctttcatcccagcacattgagaggctaaagcaggaagatcacttgaggccaggagttcaagaccagcctgtgcaaaatagcaagacctcatctctactaaaaaataaaaaaagttagctgggcttagtggcacatgcctgtggtcccagctacgtgggaggttgagatagaaggatcgcctgagcccgggaagctgaggctgcaggaagccatgaccacaccactgcactccagcctaggggacagagacccagtctcatcaataaataaataatgaaaggacattttaacaccccactacaaccactaaagatacaaataaataaaaatataagaggaacacaacctcataatacagatagtcttttatattgcatatatttaacttcgggcaaaagccactctattttcctctttaaaaaaacttttttagctatagattaatgaatactttctcagacatttcagaactactgcttagtacttgaaatacaacatttagaatctggggtactacctgaatgtgatgagtagtcacacatctcatatcctttgttttcttgccagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcaggtaactgatggtaaatttgtcttggagtacaggtaaactccgcacagggttagccttggcttttttctctctagttgaatgttcatgtagcttatcatttccaagttactgggatacctgaaattactggataatgttctcatctaggtttttctctttgtatcataaattagaactaaggtaagaaacagctgaggaatttattatgaaatattttctaatttcaacaacaattaccatagctaacattgaaggctactctgtagaagtgctgtgcatataagataccctctgaggttggtactataattat

SEQ ID NO: 22502 - DNA, 1031 bp, Homo sapiens
ttagcgaggattatcattagatgctgaagtcattgggtgaaaggtgttaggacagcatattaaggtggtcttaaagtatcatcccacaatttacaaagggggaaaaatgtacccttgtaacacagacatctggtggttaccaacttcgttgagtgctcaagtttagcattgccatgaacaattatgtgtctcctgttgtgatgattggggtggggggcaaaacataatatcacctttgtggggttcttgctgaaaatacagaatctaattttgaagaaatgggcttatatatccagaaggtgggttgttttgcgagacagttatccacactcttcaaaagattcaatattacaaagaatggagagaggcagcagaactgctttaggctggcaaagactgaagagacataacatccaaatgtaatatagaatcgaatactgggcttttaaaaagttggcgtgtttgtttcctgcaggggagaaaaagaaaacttaaaaagttggtgtgaagaacattttagggactactaaggaacttttgagtatggactaattgttggattttgttattattgttaattttctggttaatcatatgggaaagtgtttttgtttgggggaggtggttttgaagtatttaaaagtaaaagggccaaattgattttagcctctctaaacaaaagaaaaatgtgtatattaaggtataaagatggagaaacagagtgggtttggttagatgttaacagttgatgagtctaggtgaggaatatattgatattctgtgtactccttcaattttaacataggtttgacatttttcataattaaaaattaattccttttagacttactttaggtgaaatagtgtaactttggtccataaatttccaaatccagtagtaagatcaatgttatttattcatgttaaatcaagatatactgtatgttaactgtaacttagaatcctttcctggggattcaagtaaggaatgattgcaaattgtattatcctttttgaggctcctttgacta

SEQ ID NO: 22503 - DNA, 1052 bp, Homo sapiens
tttaaaatcacccagaaagaaaattctagactgtttttactgttacattctaccaaacatttagggaagaaataattttcactaatcttacacaaactctttcagatagctatgcaccatgatgcatgcctgtagtcccagtaactcaggaggctgatgcagaaggatctcttgagcccaggagttcaaggctgcagtgagccatgattgtgccactgcactccagccaaggcaacagagcaaaaccctgtctcttaaaaagtaaaaaaagactgggtacggtggctcaaacctgtaatcccagcactttgggaggccgaggcgggcagatcacgaggtcaggagatcgagaccagcccagccaacatggtgaaaccctgtctctactaaaaatacaaaaaaaaaaaaattagttgggcatggtggcgcgcgcctgtagtcccagctgctcgggaggctgaggcaggagaatcgcttgagcccaggaggcggaggttacagttagctgagatcgcgccactgcactccagcctgacgacagagcaagactccatctcaaaaagaaaaaaagaaaattcagagaatacaggaagaggaaatatttgctgaccctataaccaaggccaaataactgaaataccaactgtgactggatcgttacaagaaaattatagatcattgtcccccatgaacataaacgtagtaatgtttattagatgtagaagccagcacttcagaagaaggattgtatatgatgacaaagatttatctcaggactgcgaagctgcaacatttgaaaatcagttgtaacttaccacgttaacagaccaggaataaagaatagagaatccagaaatagacccactcagatacttaaaacagagtaccaagacagttcaatggagagaaaagacattgttttaacaagaggtgttgcagcagctgtttatctgtggaaaaaataaaacttgacccctggcttaaactataaattaaaaataatttggaatagattatagacataaattggtagtagaattggagtagagcga

SEQ ID NO: 22504 - DNA, 1029 bp, Homo sapiens
aaaaggcaggagagaatcaggagcacaggcgaggtagaactttagctgtttactgttccttaattgactgatcaatgttttccactcactttattttcattagaaggatttacttcatgtgaatgatcccagaaaattaaactgaatatgatagaatgtttggtctttcaaatttgactcaaagtggtggtggtgtgggtatagttttttgggcattgcacaggctttgttttgggttttttggtttgtttgtttgcatttctaactatggaagtttttgatgatgtaccctgagttgatttggcactttgcatgtcttcttctgtagctgaagtacacaaagtttcaaggccagaaaatgagcaactcagaaatgataacaagagacaagtaggtaagttcttggatctaaaagtcatattctatgcttctcaacagggagaatattttaaatatatgatacataattactataaaaaaatgaaaggcgggggttgtgactgtaaaggaggagcacaggggagtgtcactgtggtgacagaacagtcctttatcttgattgtggtggtagttttgcaaatctatatatggtagaacatcatagaactatgcataaagacataccaaaaaatgagtacatgtacaaactggtgacatctgagcaaggtctgtagtttagttaattagattgtgcctgtgtcggtttcttggtttcgataatgtaccataattatataagatgtgactgttggagtttgggaagttgggtgatgggcacaagggacgactctgaactagtttttcaatttttcttttctataattactttaaaataaaaagattttttaaaattttacttttctgggcccggcacagtggctcacgcctgtaattccagcactttgggaggccggggcgggcggatcacgaggtcaggagctcgagaccagcctggctaacatggtgaaaccccgtctccactaaaaatacaaaaaattagccgggcgcagtggcgggcgcctgtagtcc

SEQ ID NO: 22505 - DNA, 1027 bp, Homo sapiens
aggtcaggagtttgagatcagcctggccatacggtgaaaccctgtctctactaaaaatagaaaaattagctgggtgtggtggcacacgcctgtagtcccagctgctcgggaggctgaggcaggagaatcacttgaacccgggaggcgaggttgtagtgagccaagatcgtaccactgcactccagcctgggcaacagagcgagagtctgtcaaaaaaaaaaaaaaaaaaaaattgagcccagatcctgtttttgaatcagttgtttaagagctgtagttttcttttatgattattgatttaataaggttttatattttctttatctgttttgtaatatataacattctaaaatcattcattttattaatattttcaaatttattaatggaaaataaattataattttacaactcttctaaattaaaaagggaatgtataatctaccttatttagaaaatgattgaaaaatgatctttcacttaattttagaaatctagatatgatatttttagatgtatatgtactcttctctacatttatatatatatatatttttatatcccccccccccgtgttttttttttttttttttttttttttgagacagagtcaacctctgtcacccaggctggagtgcagtggggcacgatctcagctcactgcaacctccaccgcccgggttcatgccattctcctgcctcaccctcctgagtagctgggactacatatgccatggaatacagaattttgtttaatttgactcattatattttaccctttttattcagaaaaagagagagctcccctcccaaaataaaataactgccatactatctttcattgcccttcaaaactcaccccaccaaagaggttcattaacagaacagtgcatattcttcccgattttttttgtagattttacagacacagacatctatacccaaaacctttttttttttttttttttttccccctggagatagaatctcgctctgtcacccaggctggagtgtagtggtgcgatct

SEQ ID NO: 22506 - DNA, 1051 bp, Homo sapiens
ccttttgtaagcctgtcctggaccctatgtgtttctgcaccgcatctctatctgcactgtttgctgtcagcttaaccttcctcagactgatctcatcatcttccttctctcctgtcatctcagctctgcctcctcccagtgttccatgttggctcatggtatactgcccaggcactagaggtatccatgattgtggcctgttgccatttattcctttgagatgtccctgtcaactaccatggtaacccaccagttgggcttcagaccttcgtctctctttaccccactttaaggcagatcagctacattttgaacaacctgtgacaactccttgttgaagaccacattgagtcagcttggtctgagaaaaagtacatttaaattagacttggatccagatgagaataatagcagtagttactagtatgacctttcagacccttggttttgacatttgtgaataaagagttgcaccatttattctgaaataacaccttttaaagatcattaaactttcagagttggaaaacatctgagaggtctgacctggttaaaacataaacctcttctgcagtatctcttataggggctgggagcttactcttcccaagggcatccatcccaccccagggatgttctaactgttacaatctcagctgggcgtggtggctcacacctataatcccagcactttgggaggctgaggtgggcggatcacctgaggtcaggagttcgagaccagcctggctaacatggtgaaaccccgtctctaccaaaaacataaaaaaaattagccgggcgtggtggcacacacctgtaatcccagctactcgggaggctgaggcaggagaatcattgaacctgggaggcagaggttgcagtgagccgagatcacgccactgtactccagcctgggcgacagagcaagactccgtctcaaaaaaaggaaaaaacaaaccttccatgcagtaactgtgtgtgctccatgtggttactaatacaaacatttttttgacaccatgtcacactgtttatcattttgagccttttg

SEQ ID NO: 22507 - DNA, 1006 bp, Homo sapiens
ccaggttcaagcaattctcctgcctcagcctcctgagtagctgggattacaggcacctgccaccatacctggctaatttttgtatttttagtagagacggggtttcaccatgttggccaggctggtctcgaactcttgacctcgtgatccacccgccttggcctcccaaagtgctgggattagaggcgtgaaccactgcacgtggtgctttgtgtttttttttttttaaatctacttagaaataaattattttcaccccctgatttacacttgaatttccactagcaacacaatttgttgtcacaaatgttttcatagtacttgggcacatttgatgcagaaatttttaatggtccaagactattttagttgatagatgaaaccttccttttacctgaacaaactttttcggaagtttaggagccagctttgttcatcctttggtgataggtggtggtttgtatgtgtttgtagacaaaactttccttggcggggatttgccccttttttcgttgtttcttcttcctttgaagatctctgtttaacaaagattttttttttggctcacagtgttcctgtaatagaattccttcaagagttctaatactagttttgttttgttttgatggcagcaggttttgagagtgagcttttgacttcataagaagactaaaacaacagtcttagagtacagttaagtccatttgttaccagaaaatcagacagacagctaggtctgtcctcatcaggaccaagtaatactggatttttttttttcattaaatgttcactatttttctttgtatgaaattgaggccaggtatagtgactcacacctgtaatcccagcactttgggaggtcgaggtgggagggttgcttgagtccaggagtttgagactggcctgggcaacacagtgagactccgtctcttaaaagaagaaagaaaaaagaaattgaatatgtggtgattactacccgtttcatttacttttttacttattaacg

SEQ ID NO: 22508 - DNA, 1064 bp, Homo sapiens
gctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagtggtttaattggctgtacaggaagtatggcagcatctgctcctggggaggccttagggagcttttattggtggcagaaggcaaagcggagcaggcatcttaaatggcaggagccaggaccgagagagagaagggaggtgctgcccacttttaaacaaccaggtctcatgagaacccactcactattgagtacaaaggggaaaatccaccacatgatccagtcacctcctcccaggctccacctccaacattgggaattactattcaacatgagatttgtgtggggacacagatttaagctatatcactagtgattagtgatgttgagcatcttttcatgtgcttattagctgttcgcatatttcttggggcaaaagtctattcaagtcctttgcccatttaaaaattggatttttgtgtttgagttgtaggagttctttatatattctggatattaattccttttcccatatgtgatttataaatattttcatctatggattgctttttgcttgtaatgtcctttgatgcctaaaagttttgattttgaagtccagtttatctgttttttgttgcctgtgcttttcgtgtcctatccaagaaattattgctaagtctgaactcagtaatttttatatatttaatgattttcacccctaaatggttattctttttgatgcttaagttgtcccattattgatcgttaatggcacttatttttcgggttttctaggtgcttttgacatgagcctagtagtgttatatgagttccctgctttctggctttacaagaagtccggggcttatcggaaaaatttctgatcccagatccagaatcagccatttctttaactagttctgattctttttggtgggaaatggtattaagggcattcattacaattaagatgtaaattccagtaggtt

SEQ ID NO: 22509 - DNA, 1071 bp, Homo sapiens
tttatgtagtagagaattttggtcagggaaagtccttattctgccatttttgatgatactctttccctcccctttttaggcttttattttcatgaatcttgtatctcttggtgttttgttttgttttgttttgttttgttttcgagacagggtcttgttttgtcacccaggctagagtgcagtggtgtaatcatggcccactgcagcttaaaactcctgggctcaagtgatactgctccctcagcctcccaagtagcagagactacaggtgcacaccaccatgaccagctaattttttaaattttttgtagagatggggtcttgctctgttgttcagactagtctcaaattcctggcctcaagcgatcctcttgtctcagcctttcaaagtgctgggattacaggcttgagccactacacccagcctaatttttgtatatgatgtgaggtcggggtccagattcattttttcatgtggatatttagttgtcccatcaccatttattgaagagactgttctttccccactggatgtttttggcatcctggtctaaaatcagttgactgtagatgtatgggtttatttctggacttctaattctactccattgatttatacatctttccttatgccagtatttcactgctttggttactatagctttatagtagattttgaaatcaggaaatattacttttacaacattttttctttcagtatttgttttagtcatcctggatccctcgctttttttttttcttgcgtcagtttgtttgtacaaatagcacaggaggatccccgccccatgcagacggcagcccgagggggtcgcagcagtccttctgttctcacatttgtagacagagatatctactctgaagcctttgtaggggcctgggcacctttgggagcttgagctggaactgaagctggagctgcagtctgggcgctgatttgatccttggccttggcctttagccggcacagcctgagtcccttggcagtgcgggcacgagcacacttcccaagcttggggtgggcaatgtaggcaagtcgatcgagcttgtggc

SEQ ID NO: 22510 - DNA, 1057 bp, Homo sapiens
gagagaattgggtgcactgaaccttgggcaggctcagctgccaagattctctctgaggagtccaaggtctagctgggcactagcagagcttgcgttgttgttcaccctttccaggcttctgagcctggccggctctcatttcattctctgatatatttcttcccaagtcaaagtcatgttagggagtactgctacctccttgagtgactttgtaagtgttgagttcaccatttagcttccagagtgcccaggatctggcagacatcatcttcctagtagacctatgctgctcagactgttttccctctcagaaaagggctcttggccagaccaagtggctcacacccgtaatcctagcactttgggaggctgaggcaggaggatcacctgagctcaggagtttaggaccagcctgggcaacatagcgagaccccatctctacaaaaaaattaaaacattagccaggtgcggtggcacacgcctgtagttccagctacttaggaggctgacatgggaagatcgcttgagcccaggaggtcgaggataacagtgagctttgatcacaccactgcactccagccttgaggatagagtaggactctgtctcgaaaaaaggttggggggctcttggtgtaggtaccctgaatggacggtggagacccaaatgatgagaagcagttggccataccaaaatctcaggaaagagaaattcgggcaaaggcagcagcaagagcaaaggtcctgaggtgtggacaaacccatccagggaggaagagaaggcctcacagctgggacaaggttgaggggctgggcacagagggctttgagggctgtggtgagggtttagattttatttcaatcacgatgatatcccattgaagagttttaagcaggggagtgatgtgctctgattggcactacaggaagctcactctggcccctatatgaaggatgggctttggaggtacaggagtagagaaaaagaggccaggtgagagcttggtcctgagacccaggagtggtggtttcctgaagcagggggttcataaacaaggtg

SEQ ID NO: 22511 - DNA, 1094 bp, Homo sapiens
tgtcctaggcatatatgggtcccctcctctcctcctgactgtctgcagcacataagtccttggggagctcctactcctctaagcatacagtgggttcttggaacaaggttatggtgctaacagagacctcagggcctgcctgtctagtggatagagggccgagctatggcaccatgcccagctgggagcatggctgcctggggttggggggggcagtctttatatcctgaccgtaatccccagggtcgagccgtgctgcacgtggctctgcggaaccggtcaaacacacccatcctggtagacggcaaggatgtgatgccagaggtcaacaaggttctggacaagatgaagtctttctgccaggtaagtggctactgggccggactcacccttggccgtgtgtgtgagttatttgggaatctgggagccctaaggggcagctcttccctcttcttgtaggcaggactcaggttctcactgcagcttaagggaggggttgcctgtgtgatcgctgaccctggagtctctgctgaggcctgaatttctcctggctctgctctgaaggaatctgctgctggcagaagtggggccagtttctttcctgaattgtagacacctatggactcatggtgacaaaccacagaggcttcaaatgaaaagtggggcccctgagagacaggacagtcaggaaaggaaggagctttttcttttttctttttttttttttgagatggagtctcactctctcgcccagagtggactgcagtcgtgctatctcagctcactgcaacttccgcctcctggattcaagctattctcctacctcagcctcccgagtagctggaattacaattatgcgccaccctgctcagctaatttttgtatttttagtagagacgggatttcaccatgttggccaggctggtctcaaacccctgacctcaggtgatctgcctgcctcacctgggattacaggcatgagccactgcgcctggccggaaggagctttttctaatctcttttgtcatacgcccttatcacccagtctagaaacagataaaacattgtaaaatttcctcaaccctggctgggcg

SEQ ID NO: 22512 - DNA, 1070 bp, Homo sapiens
acacctgtagtcctagcactttgggaggccgaggtgggcggatcacttcaggtcaggagtttgagaccagcctggcctacatggcaaaacccgtctctactaaaaatacaaacaaaattagccaggagtagtggcaggcgcccataattccagctactcaggagactgaggcagcagtatcatttgaacccatgaggtggaggttactgagagctgagatggcgccactgcactccagcctgggtgacagagcgagactctgtctcaaaaaaaaaaaaaaaatttataactgggcatggtggtgcatgccggtagtcccagttacttgggaggctgaggcaggagaatcgcttgaacccgggaggtggaggtttcagtaagctgagatagcaccactgcatgccagcctgggtgacagagcaagattccatctccaaaaaaaaaaaaaaaaaaattaaaagaaaattgctggatcttattagtgtatagtaattttttattgatgtgtgggaaattattccaaaatttagcaactagaagcaacaatcaccgtctctttatgtggggaatttgcagtggctgtgtttggtgtagtggctctgatattctaaggttgcagtcaagatgttggctaaggatgtggtcatttgaaggcttcatgggggttggagggtctgctttgaagatggctcactagcagtgctgcctttgggaggcacagacagttcgagtgtcctcatgacaaggcagcttatttctcccagagtgagtgatccaatagagagtaaggcagatgcctggaggtcttttgtgacctaatatcaggattcacattctttcttttttttatttttatttttttgagacagagtttcactcttgtcacccaggccagagtacaatggcgtgatcttggctcactgcaacctccggtccccggctcaagcgattctcctgccttagcctcctgagtagctgggattacaggtgcccgccaccatgcccgcctttttttttttttttttttttttaaatttttttagtagagatggggtttcaccattttggcc

SEQ ID NO: 22513 - DNA, 2537 bp, Homo sapiens
ggtatgaggatatgggtcttccatgtctgaggaggtagcacctggcacagatatgaggatctgcgtcttccagtgtttgaggaggtgagtttggactcaggtttgaggcccttgggcttccagtgcctgaggagatagcatctggcacaggtatgaagccctgagtcttctagtgtctggggaagtgaggctgggtacaagtatgaggatctgtgtccatcagtatctgaggaggtgggatcgggtcctggtatgaggatctgggtctgtccatgtctaaggaggtaagatctggccctggtatgaggatctaggactgtccatgtctgaggagttaccatctggtacaggaatgaggatctgggtctgtcaatatcagaggaggtaggaatctggtacaggtatgaggatctgcgtctgtcaaagtctgaggagttaccatctggtacaggaatgaggagatgtgtcttccagtgacttaggaggtacgatctcttataggtatgaggatctgggtctgtcaatgtctgaggaggtaggatctggccctggtatgagaatccgggtctgtccatgtctgagcaggtaggatgtgtccctggtatgaggatccgggtctgtcaatttctgaagaggtgggaatttggtacatgtatgaggatctgggtctgtcagtatctgaggaggtaggatctggtacagttgtgaggatctgggtcttcgggtgtctgaggaggtggcatttggcacaggtatgagaatctggatcttctagtgtctgaggaggtgggatctggtattaattatgagaatctggttctgtcagtgactgaggaggtaggatctggcataagcatgaggatctgggtctgtcaatgtctgaggaggcagtatctggtacaggtatgaggatctgggtctgtcatgtctggaggtaagatctggcatgagtatgaggatttggttctgttcatgtctgaggaggtaggatctggtgcaggtataaggatctgggtctttcaatgtctgagaaggtaggatctggtacaggtgtgaggatctgggtctgttaatgtctgaggaggtaggatctggcactggtaagaggatctgcatctgtcagtttctgaggaggtaggatctggccctagtaagaagatctcagtctgtcaatttctgaggaggttggatctggcccccttatgaggatctgagtctgtcaatatctgaagaggtaggaatctggtacaggtatgaggatctgtgtgtgtgtcagtgtctgaggaattaggaatctggtacaggtgtgaggatcttcatgtctctgtatctgaggaagtaggatctgatacaggtattaggatctgggtctatgtctgaggaggtagcatctgatacaggtatgaagacctgagtctgtcagtgtctgaagtggttggatctggccctggtatgaggatctgggtttgtcagtatttgaggaggtaggatctgtccctggtaggagggtctgtgtcttctagtgtctgaagaagtaggatctggccctggtatgaggatctgggtctgtcagtatctgaggaggtaggatctcatacaggtatgaggatctgggtttttcaatgtctgaggaggtaggatctggcacaggcatgagcatctgggtctgaccatgtctaaagagttgaagctgtgtgcaggtatgaggccttgggtctgccagtgtctggggaggtgaggctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggtgagtgtgtttctgtgtcttgcagcccctgtgggagacagtgttgcagtctaaggtcggggtagggggcttgtgtccctgaacatcatgctgtcctcacaggctgctggcctctctgcagctggctgggatatttatttcatgtccagaaggaaggtctgggtttttttgcgtgtgcaagttggcccccgtctttgcccctcacaactgcagtcctgtttctctcctatcctaggc

SEQ ID NO: 22514 - DNA, 1043 bp, Homo sapiens
gagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtaaaaaaaaaaaaataagaaaaataaaaaataaatttttgtagtgataggatcccactgaggccagagaatagggtctggagacaaaggagcattcacttcagcctctgactgg

SEQ ID NO: 22515 - DNA, 1050 bp, Homo sapiens
ctgtactgataatgatgaaaatgctataccagaatgtattgaatgtggtggttggcaaaaagttacagatttacatacatgaagaaaggctgaacattaattactaaatctttactaagaatccaatttaagttagaaaatgaaccacagaatacactttaagaaatgagaatggtgtgggcatggtggctcatgcctctaatcccagcactgtgggagggtgagatgggaggatcccttgagcccaggagtttgagaccagcctgggaaacatggcaaaaccgtgtctctacaaaaaatagaaaaatgagccaggtgtacctgtactcccagctacttgggaggccgaggtaggaggatcagttgagcctgggaggttgaggctgcagtgaaccgagatagtgccactgcactccagcctgggtgatagtgagatcctgtcttaaaatgaagaaagaaagaaaaaaagaatgagaaggaaggatattaattgaagtaagagcacatttgattacaaaatagaagaggagtaagtgagaactaaacggggaatacagatagcagagattaaataggctataagaaaaaaaagggatgataataagaccatggtagtacataaaaaatttaaatgatctgggtaaatacatttttaaaaacttactaagtgcccagtgcggtggctcaggcctgcaatcccagcactttgggaggctgaggtgggtgggtcacttgaggccaggagtttgagaacagcctggccaacatggcgaaaccccgtctctactataaatacaaaaattaaccaggcgtggtggtgggcatctgtagtcccagctacttgggagactgagccatgagaatcacttgaacccagtgggtggagattgggccactgcactccagcctgggggacagcatgagatgatgtttcaaaaaaaaaaaaaaaatgaaaggaaaatagaatgcctgaatttagcagtataccttagagcaatgtaagtagtttaaattattctaaataatgcaccgaacctatgttatttttac

SEQ ID NO: 22516 - DNA, 1032 bp, Homo sapiens
aaataagcaataagcaagttatgttttaatcataagacttacttggaaaattaagtataagaccatagtaagctacagatgcttctcagatacttcccgataaactcatcataaataaaaaataccattaagtaaaaaatgatgctttttttgttgttgtttttttgagatggagtttcgctcttgttgcccaggctggagtgcagtgcaactgcaatctctgcctcctgggttcaagcgattctcctgctcagcctctcgagtggctgggattacaggcgtctgccaccacgcccagctaatatttgtattttagtagatacagggtttcaccttgttggccaggctggtctcaaactcctgacttcggttgatccacccgcctcggcctcccaaagtgttgggattacacatgtgagccaccacgcccagccaaaaatgcattttaatataacctcaataaacctgttgtaaaggtgaaaaatcattggtggaccattttaaattagcggctgtctactattttgcactcactagttggcaaagcgttaattttaggaagtgttaacatgccattgttgggagtgactatcagagctttgaaattatagttgggtggggggttgtacaaaggatttctgtaagataactttcattaatcatatacttgaggaaatactggaaacttttatatccatgagttattaaacagtttttaggataactttattaataaaagagaatctcagcttaatactttcaaattgtttgttaacactctgttcagcagtaaagagccattctaccatgaaaaaaagttaatcttgttcattgctgaatttctatcccctagatggggactctgcacctgaggtatataataatgtttgttgaacaggtagctgcaggtgtaaacacaaacattattctggtgttagaatgttatccaggttgtaagtgaaaaccactcacctgtttcttgagcagaggttttaacattgaaatgtgcagagcctcgctgataggaatgga

SEQ ID NO: 22517 - DNA, 1054 bp, Homo sapiens
ttataggcgtgagccactgctcctggcttcatgttcacttttatttcttgctcatatctgctattagcagtttgactgacatgtgtcctaaattgcccttgaaccccataagcccctttttcttggtgaaatccctcttcatcagtagtatatactatttgcctgttaaatatttctagagaaatctgtgaaattgtttttattgggtctacctaattattgttcatctagacccgtaggtccgtgttttaaaagtttttttgttctgtcttgactccctagcaagttgtacgtgtgtggggtttttttgactctttttttcctttttgtggagaatggggtctcaccatgttgcccaggcagatctcaaactcctggtttcaagtctcaaactcctgggttcaagcgatcctccagcctctgcctccctaagtgctgggattacaggcatgaaccactgagcctagcccctagcaagtttatcacagagcttaaaactttctcagctcttatcaaactgcctcagtattcttgcaactctcactaagcagatgaccttaaggatataataacaggtttgaaaccattggacataatttacctgttgagagactgttccacataaccgaaaactctttttctttctgctggagagaatccactttcggtaaaggctaacttttgcatgtggtgttttgctttccttttgtaccattcttcagacaggattttcgtctctgtcctgtgtctcggatcttttttttcttggtttcttttgtctgctttccaacacgcacaggttctgctgtcttaatcaaatgacatactgctctccccagcttgtatttcgtcttatttcctcagtggtaacagatgtcacatgttgacttttttttttctttctttttttttttttttgagagagaatcctgctctgtcgcccaggctagagtgcagtggcatgatctcagcttgctgcaacctctgcctcctggttcaggctattctcctgcctcagcctcctgagtagctgggattacaggtccgccactat

SEQ ID NO: 22518 - DNA, 1088 bp, Homo sapiens
ttaggtgtgcgccaccatgcctggctaattttttgtgtttttggtggagatggggttttgccacgttgcccgggctggtcacaaactcctgagctcaggcaatctgcttgcctcaacctactaaattgcttgagactacaggcatgagccaccatgcccagcctaaaacagttttcttaaattgctcgtcttttggcctggattctgtgtttgtccagcaaccttctctttactgatgaatggaaccaggaaagggttgccattgtcagtgagtggaattgagattccggtgtatacaactgagtctccggtgcctttgtttaggctggagtgagttcctagaagctggtgattcttggtgttcttgtcagactcattactggaccagaggagctgatgatgagaccccaccccctacttaacccacctccatgctactgtgaggtcctagctgactggtctttccctcagcaacctcttgttctagtcgaaagtctatagtattataaacacgtgaaagtattgttctgaaagtaatgcttcaaaatagtcaatttgtggagaaacttgttaaattgtttaaattattggcaggatgacccatctgcaatggattttgtcacctctgctgcaaacctcaggatgcatattttcagtatgaatatgaagagtagatttgatatcaaatgtaagttatttgtactaaagttgtatcactaaaaccttgaagttgttttttaaacagtgaaacatactcatccttttttttttttcccagcaatggcagggaacattattcctgctattgctactactaatgcagtaattgctgggttgatagtattggaaggattgaagattttatcaggaaaaatagaccagtgcagaacagtgagtatttctgtttgcatttttatgcaaccccccttaaaaaaatcattaattaaaagtacattaaacagataatttttaaaatgaaaacaataaaattggtttaaagcaatggaaaagtaatttttctggttaccaagtgagtgtgtgtttaagcttcctggaaattgcaacaaaaaggaaaaattaagaagttg

SEQ ID NO: 22519 - DNA, 1049 bp, Homo sapiens
tattttaggagtctacttgagtattcaagcctcattctagccagctgacttttaaaaaaatgtttgtttgtgattatatgctgtcccttagttgtagccagctctttcaaatgctagcttaaaaatggaaactggtcaggaatttcagtggcttcagcgtgacccttctgtacggaatacatgtggtatggagggtgagacagcacttaccagaatatgtgtggagtcctgtatgacaggcatagttttgggtattcataagtcaaggatgaataagacaacagaccttggcttgaagtgccttgcagcctggaagaagggagattgtcaacagctggattgagcatcgtccaaggaaaactagaaagagtgtgtacacagtatgaatctaaggaaagtatattcagctttgtgaaacggagggggagtaataggagagggagtactcttgggtcagtttttgaagtagtagtgaggactccctggacaaagaagagagcatttagacagaatgaacatctgtctacaaaggtgtgaacttgtgaaacaacctaaactgccttgggagtggcccattatttggtttcgctggaagttggggtgctgaggggttggcagcagtggtgaggttgaagtctttcttgtcacatgtgcagtgtgtgtcttcctcctctcccttgacccctaccctccagaggaaggggcagtatttcactgccacctgccaccagggtttaaacaggggagtagcagggagctattagggaggaggggattgagggatttttactaaggcagaggcaggtgatagatttgagatttgcaaagtcagaacttggagcccagttgaggaatagcattacaatgttagcagcgttgttaggcgagcacaagacttcacaggtgatgctagttcaccaaaatgtgaacccacattaactggttttccttttgaatgtgatggttccaagaggtttgcagtcagtggagatgtgtgaaagggcttggaggtggaaatctgggtaagaatgccaagggcattcctggta

SEQ ID NO: 22520 - DNA, 1021 bp, Homo sapiens
atggtggaactgtgcctgacttgagatttatgggtagcatctaacaaacataaagggtttagtggtgctgccacctgcgtccagttattttgtcaatattttcatgagtatacaaacatgcatagtgttggtgtggttatttggagagaactacatttcatactttgtttataaaaagcataaaatgacaggaaggaggccaggtgcgatggctcatgtctgtgatcccagcactttgggaggctgaggcgggtggatcacgaggtcaggagttcaagaccagcctgaccaacatggtgaaaccccgtctctactaaaaatacaaaaattagctgggtgtggtggcatgtgcctgcagtcccagctactcaggaggctgaggcgggagaattgtttgaaccggggagccgagtttgcagtgagccgagattgcgccattgcactccagcctgggcgacagagggggactccatgtcagaaaaaaaaaaaaaaatgacaggaaggactgaatgtgagttattagtaagtagtgtatttcacagttagataatggagtcaaagtggtcctgcttcagttggacactagatataagtggcatgcttgttttcacttgtgaaagaaaagacagtggaaggacatgtacaataaagtggaaataccacaaggtatctaaaagaggaggcataattagggtttttaatcatattttttagctctctgggaacagaaccccaccccttaaaacgtgtgtcttttgtttgacttaaatgtttctgatgtttttgggagttcatgtacagaagcatggtgtagcttgtaaagatggggggacccagaaatcatgtagttctgcccataagacaccacattactatagttaagatcacattgtaggccaggcgtgacggctcacacctgtaatcccagcactttgggaggctgaggcgggcggatcacaggctcaggggttcaaaaccagcctagccaatatggtgaaaccctgtctctactaaaaataca

SEQ ID NO: 22521 - DNA, 1599 bp, Homo sapiens
aaaaattagccaggtgtggtggcgcgcctatagtcccagctgcttgggaggctgaggcagaagaatagcttgaaaacctgggaggtagaggttgcagtgaaccgagatcacgctactgcactctagcctgggtgacagagtgagactccgtctcgaaaaaaagaaaaagatcacattgtaagtagaggatgtagaaatctttttttggcattgtagctaaagaaataatgtccaagagttgctttaggccaccaagctttggacccagttttatgcttcagcaataaaagttatttactgttttaaagaaacaaaaaaccaaaaccttgccctgatttgaaagtgcatgtagagtttttgattatcacagaaatttgttgtgtaccgtcttttttattataagttcagtgctttgaaaattagaatccaaggtgggtatggttggctcacgcctgtaatcccagcactttaggagaccaaggtgggaggatggcttgagcccaagatttcaagaccagcctgggcaacattatgagaccctatctctcatttttttttaaataaaaattaaaaaaaaaattagaatccacatatttggtgtatacatagtgtatgctttgaggaacaacaggatttctctggtgctcctttgctttctaaatagtcatagcagtgacctgtgtgattctcctacagtgaagacctaggaaaggacgttgaatttgaagttgttggtgatgccccggaaaaagtggggcccaaacaagctgaagatgctgccaaaagcataaccaatggcagtgatgatggagctcagccctccacctccacaggtgagtatggccccagccagcaggttgttaaatacccacaaagcagaagtaaaaacaaactgattattaggaacattgaccataaatccataaaactactagaggtgtgtattggtttggtattgattgttgtaatggagctttgaatttatgaaccatgaagacatttaaggctgggtgtggtggcttacacctgtaatcccagcactttgagaggccaagatgggagtattacttgaggccaggagttggagaacagcctgggcaacacaatgagagacccccatctctacaaagaaaaaaaaaaattaaccacgcatggtagcgtgtacctgtagtctccgctactcaggaggctgaagtggttcacttgaacccaggagttcgacactgcagtgagccatgattgcaccactgcactgcagcctgggcaacagcaagaccatgtctcaaaaaaaaaaaaaaaaaagtcatttaaggcctggcatggtggctcacacctgtaaccccaacgctttgggaggccgaggcgggcagatcgcctgagctcaggagtttgacactaacctgggcaacacagggaaatcccatctgtactaaaaatacaaaaaattagctgggcgtggcagcatgcgtctgtagtcccagctactcgggaggctgaggcaggaggcggaggttgcagtgagctgggatcgcgccactgcactccatccagcctgggtgacagagcgaggcttccggctccaaacaaacaagtcattta

SEQ ID NO: 22522 - DNA, 1023 bp, Homo sapiens
tactcaggaggctgaggcaggaggatggctggagcccagaagttcaaggccagcctgggtaacatagcaagaccctgtctctaaaaaataagtaaataaaataaagcttttaatggcagtgggttttttgttcgtttttgagatgaagcctcacactgtcatctggcctggagtgcagtggcgcgatcctggctcactgcagcctccgccttccaggtgcaagcgattctcctgtctcagcctcccctgtagctgggattacaggcgccctccaccacgctcagctaattttttgtatttttagtagagatggggtttcactatgttggccaggctggtctggaactcctgacctcgtgatccacctgcctcagcctcccaaagtgctgggattacaggcgtgagccactgcgcctggcctaatggcagtgtttttaaaatttggattgtcagcagttggcctttgttgagaaaatgtgtgactttgcccaagcccagtaacttggagccttgaatttgagatgctggaaagggagtccttcctcctttctgcagtgtttgtctgggttgtcccctagtttaccaaagtccattttgaatgtaccatccccagcccaactccagcctacagatagtgccagaccgccagtaggtggagtagcactgtcttcctggtcccggacctcagagggctttgcctgttagggtactcttatcactcagagatgggccttgagttttcagagaacagaaagccattaagctgtttcccctattgtattcatgtgccctttgtgtttctggcaataatttattttatatttcaactaaattttaaatttctaattcatgtattgttccttgtgtaatttgtactgtaccattcagcttattaaccattactccttgttttccaccatttgtaaattcagcatgtaatcagagctttcagaaaaaccatgtagaagactgggtgtggtggctcacacccataagccttgcactttgagaggctgaggcagg

SEQ ID NO: 22523 - DNA, 1053 bp, Homo sapiens
catccttggccgggcatagcagtacctgcctgtggacccagcttcttgggaggccgaggtgggaggattgcttgagcccaggatgtcaaggctgcagtgagctatgattacaccactggactccagcctgggcaacagagcgagactctcctaaaaaaaaaaaaaaaggccgggagcagtggctcacacctgtaatcccagcactttgggaggccaaagtgggtgaatcacctgaggtcaggaatccatgaccagcctggccaacatggtgaaaccctatctctactaaaaatacaaaaaattagccaggtgtggtggcacatgcctgtaatcccagctactcgggaggctgaggcaggagaatctcttgaacctgggtggtggaggttgcagtgagtcgagatcacgccactgcactccaacctgggcgacagagcgagactctatctaaaaaaaaaaaaaaaaaaaaaaaatcctgcatctaacgccgtagcactcgtctctgcctgacgttatttgactgctgttctctgccaccttccactcgatgcaagcttcttgaaggtggggacctgggtgcattgcagactgagtggtgcctgaccttaggggcatgtgactcatctgtgtgctgactgaccaagagaataagtggaccctggcatacagaggaggacagagtgggtacagaggaggacagagtgggtacagaggaggacagagtggctgcagaggggtggtgactgcccctgagtgcccatgtggtcttcattctttgtgtctgggtcacaaaacatgttgaagaacaggatttggttcacaaacagcatgaaggattttccctcagtccaagagcaggccatggatgaaagggcttaaagcaactgtcttggtataaagataccatgataggctgggtgtggtgactccacgcctgtaattgcagcacttggggaagcccaggcaggaggattgtttgagcccaccctgggcaactgggcaacacagcaataccctgtctctacaaaagaaaaaatcagccgtgcgtgatgg

SEQ ID NO: 22524 - DNA, 1022 bp, Homo sapiens
gtgggtggatcgcttgaacccaggaatttgagaccagcctgggcaacatagtgagaccccatttctattaaaaaaaaaaaaagaagaggccagtacaggaaggcatggcagaagctgttccctgtctgccccgaggtgtgcacacagggagagagggcctgatacttgggctacgtcagtgggttcctgtgggtgcccctgtgcttgtgcccttggcctctggtcactcagctgatcacttctggtttcctttatttctctagggtttttgcaccaaaatgcgcctcctgtgcccgtcctatcctccctgcacaggtaggagccactcacccagagatgatcaggtgcctggcccagccggctgctgtcctgtctagcctgggtctagcccaggtcttgggcgacagtgggagggatgagcaggtgcttctccgcagatctttcagggctgagggatgtgtgttgtgcttgtgtacgtggggtacagctgtcccctggcacaaggtcgagggaagtggtggcccctgccgctcagctgccccactgccagcctctgctccattctccattgatggaagggccgttccctgggtcttctcagctctgcaggctgaggtgggggtgctgggggagcagatgagagatggacgtggtctgtgcgggagccacccatgggtgctacagctctcctggcctggggtcttcccacagtgctggctctgtcccaggctggtgtgcctggcaaagcagaactggcagtgcccttttgagactccaaggaagtgaaaacaggccgggcacaggggcccacgcctgtaatcccagcactttgggaggccaaggtgggatgattgcttgaagccaggagtttgagaccagcctgggccgcctagtgagaccccatttctacaaaaaaaataaaaaattagctgggtgtggttgtgcatgcctgtagtcccagctacttgggaggctaaggcaggaggattgcttgagcccaggagtttgaggccgcagtgagc

SEQ ID NO: 22525 - DNA, 1030 bp, Homo sapiens
gagcacagggccgctccctcctccacccacttgcttcactttgccctcggggctgccaggttgtggttgtcttcactttcgtttctccttgagtctcttctgcccaggcctgttctcttcccacctcctcatggaaggttctgctgtttgccgtcttctcttttctagtgatctgcaccccctggaagaggtggtctcctgttttgtctttaaaaaccatcacgtgaccgggcgcggtggctcacgcctgtaatcccagcactttgggaggccgaggcgggcggatcacgaggtcaggagatcgagaccatcctggctaacacggtgaaaccccgtctctgctaaagatacaaaaaattagctgggcgtggtggcgggcgcctgtagtcccagctactcgggaggctgaggcaggagaatggcgtgaacccgggaggcggagcttgcagtgagctgagatcatgccactgcactccagtctgggcgagactctgtctcaaaaaaaacaaaaacaaaaaaccccatcacgtttggctgggtgcggtggctcacgcctacaatcccagcactttgggaggccgaggtgggaggatggttgtgaagccaggggttcaagatcagcctgatcagcatagcaagacgccatgtctacaaaatacaaggggaaaaaaattagccgggcatggtggcacatgtctgtagtcccagctgcttgggaggctgaggtgggaggactgcttgagcccaggagtttgaggctgcagtgagctgagatcgcaccactgcattccagcctgggcgacagagtgagaccctgtctaataaacaaaaaacaggccaggcacggtggctcatgcctgtaatcccagcattttgggaggccgaggtgaaggatcacttgaggtcaggagttctagaccagcctgagcaacatgaaaccccatcactacaaaaaataaacaaaattcacagggcgtggcagggtgcgccagtggtcccagctactcaggaggctgaggtgggaggatca

SEQ ID NO: 22526 - DNA, 1032 bp, Homo sapiens
gagaattatgggagtacaattcaagatgagatttcggtggggacacagagccaaaccgtatcagaccccgtctctacaaaaacaaaaacaaaataaaaaaaagtagctacgtgtttgggcctggctttcattatttaccaaggatcaagacctgaacatgaaaatggcaggccaagggttcctgcctttggatgcacatggccaccttgcccactagaacatctgtgccaagcagtgttcccatcaatcataggaaaataccatttcccgcatccttaccaaccctaggtattgccaataagaaaacaaagtctgtatcaatttgatgaaaataatttgaatgtgtgcatttgatgagctgtgagaatgagaatcttttgcatgcattggccatgggcttcccttttgtgagttgcctgtgaatgtccttttcccagtttactagtttgggattgaatattcttacacatttatttggtgaagaacttttatttcaaattatgaaagaaaaaaatacttgctagaattctgatttgaagtgctttcaaattctgtgttaatttggagctgacaccctttaatattgagtcctggctttgagggtctggtgcgtttcctccattcactgaagttttattttacatctctcagtaaagctttatggattagggtcttcagaagccttacttgtttttctggctctattttcttgtccagaaactccaccactgtgctaaagagacagtggtggaggtgctgggcgtgctgcttttctcctggctctaatgggaaggccaagaggcaggtcagggtcagactccaccttgagtctggcattggctgttggcatcatgaggaccccacgtattgtactttgataaagttaataaatggaattctcctttacctcaagaatgccttatgtgttgtgtgtagcatgcaccttcttgtggaaacagcttcacatgtgagagccctagcacgcaggtgatttcaggaccacccccagcccatcccgtggcgcaggatcca

SEQ ID NO: 22527 - DNA, 1031 bp, Homo sapiens
tttgatttgggataaagggaattaactaacacagtggcaactccaattaacaggtgaatttaggataaattatgtgtagcaaattgaactgtaaggtcttacttgattatttggaaaatgtatgtattggattgtatctgcttggctataaaaaagagatttcttcctgtccttttaatctcattagtggattgcctgtgaagtgcatcacagttgatttagtgattattaagtaataaaactgtgttctttttttctacatttgtggagaggattttctgccattggcaggagatttgaattttaattattttcccaacacctggcaaaaataaattctgcctttaaaaccaaagacgagtatcactggtgaacatgcatgcaaaatatccaaataatgtaatacaatgctgaattaactctcagagctaaaaaattaccacaggcaagcagtctgtttcacaaatcaaagacagtaataatgctgtattaaatagatgtattttttgtacatattataatttgactagccaataaactattattgaatatttaagcttccaaagttttactaaaaagtaatattgtgaaatgagtactattgaaaggaatttctaagccacatctgtgaacatttccttattttctttgaaacgtacccctttatttttttccctttactttcaggtcttatttaaggactatctaaggcagtggtgcccaacctttttggcaccagggatcggttttgtggaagacagtttttccacagaagcaggaggtggtggtttgggggtgaaactgtttcacctcagatcatcaggcattagttcaattcacataaggggcgtgcaaccttaatcccttgcatgcgcacttcacagtagggattgcgctcctatgagagtctaatgccatagctgatctgacaggaggcagggctcaggtgataaaagtcatttgcctgccactcatctcctgctctgtggcctgatttctaacaggccacagactggtaccagtggttatgt

SEQ ID NO: 22528 - DNA, 1049 bp, Homo sapiens
accatgctcatccacttgccacatcataagcttccagcctatgtgattgttatgttattgctcccttactacactgaaacgttttattccctctcctttcaccttgaaagcattttctttgattttaccagaaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatgggtaagtgtacttctctcaaataattgagaatctgctccctgttatactttctcctttgcagattttagggctagcttaagaactgaacacgatttcttcttgttgccagagaaatgatttgagctttgttaggttggaaatgatccagtggcaggattagaattctggattgtctattgcaaaacattgacaaaagaggccaggttttctattatgtttttgctctaaattgctctaaatgctctgtgaaaatctgacccaccttgcaggcagaacagctagacaaagggtcttgatttgttctatctgaagacctatacaacttatatgccggcggattggataaacaaatcatttaaaactgaagttacctcattttatttcatataaaataatctgattttgtggttaaaattcatcatctctgaactttgcatttaagagtaaatgcaaattaaatctatatcctatagatatagatgtctaagcagactttgtttttgtcttagcaaaataacaataataatgttattaacacacagcgtgcttactgtgtgctgtttcactgttctctgctctttatattaatatacatttgtattaactgatttttaaccttacaagcactctataggtgctaaccattttaggtgagaatgctaaataaagcacagtgtgtttaagtgagttacgcaagatcacacagcccataggtgacggtagcagaaacttgaacccaggcacttaggttccacaatccgcgttct

SEQ ID NO: 22529 - DNA, 1030 bp, Homo sapiens
gtccagatctgttatcgggattacaatgctaatatggttctccccattttgagggtcctcttgtgtagcgtgacattaaaaggcttggaggtagaaggaaacagtccaaagttctgtttcagtggtgactgaagttttgttttgttttgttttgagatggagtctcactctgttgcccaggctggagtgcaatggcgcgatcttggcttactgcagcctctgcctcccaggttcaagtgattctcctgcctcagcctcccaagtagctgggattacaagtgcccgccaccatgcccagctaatttttgtatttttagtagagacagggttttgccatgttggccaggctggtcttgaactcctgacttcatgatctgcccactggtttcccaaagtgctgggattacaggcgtgagccactgcacccagcctgactgaagttttttgacacaaactcaggtccagtttctctcctctttgaattaagttatctaaaggtctctttttctgacaagggggatgaatgggccacagtgatcctaggagataacaggaaccatcctaaaggcaggtattgagttcagtgagttaacatatctaatccagttttgcagttggtttttgtgtacaaacccagtgctttagtggccaccccagtgatctcgtcctatgggcttatcaaataatatggcaatattttaaaaggtggtaaacagttttgtctcaatatatcaaaggaggcaatgtgtatcttatcagcagatatctaatgtctggccgtgctcctcattaaaagactgtttactagattacagtgataatggtccaaccccacattattgagtatgtttctccttgtgactaaacaataatctgtgtgatcttagtttattctcaagaagtacacgtttattcagtttagcagtatatcttgtcatggttttaacaacaaatgataattctcattggaattataaaatatcattctttgtatggagatattttattacgattatttcttttgtataga

SEQ ID NO: 22530 - DNA, 1048 bp, Homo sapiens
ccgctgcagaggtcgggggcctctgcacatggctctggccggggcgatcggggtgggggcggggcagggggcccccgggcgaggggtgcagctggggagtggggcgcggacgcagggcagggcccggggtctgggtcgccactgccggcccgcgacgcactgggttgcggggtttggctgggggcccgcgggttcatctggcggggagggccctcaggcctggcaaccccctgcctggtaagccaggggtgagcgcgaggccgaactggggctccggcctgggatggagacaggatcgggaccagcccaggcccacaggccgcggagccctgggcgcgccgggagtaggcagccccctcctgcctgggccccctcccaccgtccttggctgttgcgggtctcggggctgccgggggtgggggcttcctgcgtctctccaggaccgcgtgcttgaggtcatggagggcggggggtcctgtgtgctcggaattgacttcttactccccttccggtccaggtgggcgcatgtgcttccgactgtgaattgtcttgcaagtgtgtgtacgtgtgtctggggctgctagcctgcagcagctttgggcctctgatagagttcctgcgtgtaacttaaccactaattctgaccgcggctctgtgtgtcactgtaagttacctgtgtgtgtctggggctccaaatctgtggctgtgagcagctggttgtgtgcgtgttgtgtctcattccatctgtagctccctgtgcaaatataaattacccctgtgtgtctgagtgtgacgttggagtgtttgtacatgtgtctggagttaccgtgtgtagcagctctgatccttcttgggctgtgtgtgttttaccattaattctatctgtagctccaagcgttgctgtaagttaccagtgtgcgtcccattgtgacttagtggtgtgtgtacaagtgtgcctggggctctgggttctaccatgaccctctgtgcctgcatatgcctgtaatttagctctgaaacgctcttctttttttttttttcttttgaa

SEQ ID NO: 22531 - DNA, 1059 bp, Homo sapiens
gtcaccaggcctgtgcacctccgctactccctcagccccactggccacctcactcacactcagacctgccaggctcagtcctgtccctgagcttgatgttctccacctggagtcttctcccagcctttgccacatgtgttctttgtcctcaggtgaacaagtgggctttgttcaggaaggcttttgctgactgttactaaagaaattggttgggcacagtggctcatgcctgtaatcccagcactttgggaggccaaggtgggaggatcacttgaggtcaggagtttgagaccagcctgggcaacatagcaagaccccatcactacaaaaaaactttaaaaatcagctaggcatggtggtgtgagactgtagtcccagctatcagggaagctaaggctggaggatcgcttgagcccaagagttcgggcctggagtgacctgggaggctgaggattgagaattccttgagcccaggagttcggagctgccgttaaccatgattttgccactgtactgcagcctgggtgacagagtgtgaccgtgtctctaaaaaaaatttaaaaagcatctctgcccccctagttgtcccatcccttatctctgtggtcctcaaacttgaatgtgcgtcggaatctctggccccaccccagttctgattcagaaggttgggagtgggtcctggactctgccttttgaacactttccaagtcctgcctgctgctctctggggctcatactgagcagcattgctttatggcgttcaccagtgtctgaggtcgccatccctgctcacttgttttcttactgacggtctatgtttccctgtttcagcgtcaggtccttgcaggcaggggcttgtatgggctttgctcacttccttgtggcgggtgcagggtatttagaggtgaaaggctggagttgagggtcagtcatggaggcgcctaacatcaggcgtagtgcttgtgaggtccctgtcagggtcagcagagcgtcatgggcagtggtgcactgggctggcagccgcgctgtacactccatcttagtccgccagtccctgtg

SEQ ID NO: 22532 - DNA, 1035 bp, Homo sapiens
ccctgggccccttggatctgctgcccagtgaggagctattgacagacacaagtaactcctcttcatccactggggaggaaggtgaggcaggcgggcccaattcattcgcctccggtacttgcaagcctcgctcagtcttaagcaagaggggatggattcgcccgcagcactgagaatccaggggcaggcgggatggcgttcaggcgctgttgctagaaatctctgtctttactctgttttgaaggcagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatgaggctgggtgtgatggctcacacctgtaatcccagcactttgggaggccaaggtaggaaggattgctagaggccaagagttggagaacagcctgggcagcaaagcaagaccccgttttgtacaaaaaagaaaaaaaagaaaaaactaggtgtggtggtgcacacctatagtaccagctacttggcagaccaaggcaagaggatcacatgaggccaagagtttgagacaagcctgggcaacatagtgagacccctgtctttacaaaaaatttaaaaattagccaggcatggggtcatgcaccctatgtagtctcagctactggggaggctgaggcaggaggatcgcttgagcccaggagttggaggctgcagtgagctatgattgcaccactgcacttcggcctgagcaacagagcgagaccctgtctctaaaacgaacaaagggagagaattaagtgatttcatacatttaaagcacttgggccagttagtaagcattgactattagtatttctattatcattattgtattcattttctctctccactaattttcagctagcctctattcttgtctcttatggggcagagatggcctca

SEQ ID NO: 22533 - DNA, 1052 bp, Homo sapiens
atcctcggctctcctctgtctccagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacaggtcagcgggcgcatgaaggagaggctgaggttacccaggtgcaggggaggggtgaggaagggtagcccaggacaggggaaggcactgctagccagtggggcaaggcgaggtggtgaaaagcaatgtctgtcagaccagaagcagctctgccacttactagctgggtaggcttgggcagagttctgagatgctctgtgcctcagtttctccttctgtataatgggggtatgataatagtacctggcttattggttatcatgagaactaagtgagttcatactagaaaagttcctagagcaataccatatagtaagcgtttaataaatacaagttaagaggctgaggcggggctggtgcggtggttcacacctgtaatcccagcactttgggaggccgaggtgggcagatcactagaggtcaggagtgtgagaccagccagggcaacatggtgaaacctcatctctactaaaaatacaaaaatcagctaggtgtggtggcacacacctatagtcccagctacttgggaggctgaagtgggagaattgcttgaacctcggaggcggaggttgcagtgagctgagatcacactgcactccagcctgggtgacacagccaaactctgtctcaaaaaaacaggggcggggggtggggtgctgggcacagtggctcacgcttataatcccagcgctttgggaggccgaggcaggtggatcacctgaggtcaggagtttgagaccagcctggccaacatggtgaaaccccatctccactaaaaatacaaaaatattttagccaggcatggtggcgagcacctgtaatcccagctactcaggaggctaaggcaggagaatcacttgaactcgggaagcagaggttgcagtga

SEQ ID NO: 22534 - DNA, 1033 bp, Homo sapiens
ggaaagggcggggcaggatggggtggggaggagatgaaggctgaggccccatcactcatagagagggtaggcagggccccccatcctgcgttattttattttattcttttgagacaggatctcattctgttgcccaggctggagtgcagtggcacgatcatggctcatcgctgcctcgaactcctgactcaagtgatcctcctgcctcagcatcctgagtagctgggactataggcaggcaccaccacacctggccaattttaaaattttttgtagagaccagagtctcaccatgttgcccaggctggtctcaaactcctggcctcaggcaatcctcccgcctcggcctcccaaagtcctgggattgcaggtgtgatccaccacgcctggccctgagttaaatttttatcattttcctctctgtcaaactgctaagggtgcagagttgacgtcacagattggtgctcacagtagatgtagactgagcacttacctgcagctgggctgttctaggttttaagcatgactgctttatccccacagccagcctttgagaagatgctcttgttatcccagtttttttgagacagtctcgatctgtcacccaggctggcgtgcagtggtgcgacctctgccttccaggttaaagcgattctcgtgcctcagcttcccaggtagctgggattacaggcacccgccaccacgcctggctaatttttgtatttttagtagagacgggctttcaccatgttggccaggctggtcttgaactcctgaccttaagtgatccaccggtctcagcctcccaaagtgctgagattacacgcatgaggcactgtgcccggccgttatcccggttttatacataggtaggcgatatgaggcatccagaggttcgaggagctcaggagcttgcccgaggtcacagagtgggtaatggtgacagctaacatgtgctgagcacttagtgtacaccaggttctcagtgctcttcagaaccctgaaataatcctgtggagcagatgtgttatag

SEQ ID NO: 22535 - DNA, 1051 bp, Homo sapiens
cggtccggaggaaccccagtggaagtggagaagtcaggcgccaccaacaagcctctcccagccaggactttgcttagactcgctcctcccggcagggcgcacctaggcgggtccatcgccagccggggagaggggtttgggcagggagggaacaggtgcgcggcgggacccgccctatctcaacaggtgaatcgctccaagtgggtctcggttgcatggatctcggtgcgcttggtttggccggagcagatgggggccggaagggacctgtggtccgcaggcgccctcccagcgggccagtcacttggttcgggccctgggggacggagcgcacctgggtcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacaggtacggggcacggggcctctgacgctgcggaacgccggagggaactgtagagggggatggatggagttggaggcggcgggaagcgggaagcgggggtctcagaggctgggaccttccgatcccctgggtcttgggcgatctgttgcgcgcgggagtgagaggaattccccatttgtgccggggagcgctccccgcgcccttatctggaagatagcaggaagtgaaactccctggac

SEQ ID NO: 22536 - DNA, 1025 bp, Homo sapiens
ggagccccgggggtggggcaggtgtcgcccagcggatgctgccttcaggcctcaggctgcatggggccagatccctgttgtgcaccgtgaaacctggggacagtgctcttggaatttttttttcccgcaaaatgggaatgatgtgtcttaagaggaaagtttcttagagtgcgaaacggatttgctcagcaagtgatcgctgacctcccgccatgttccagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggtgaggagtagaagtcagattggcaggtgggggaggcaacgggcccagcagggagggaagcccccccagccagttctgacttcaccctgccttgccactaaccccccactctccctgcaggccagttctacgtcatgatgacgccccaggatgtgcttcagacaggaacacagaggacgatcgccccccggacacacccttactctccgtatgtgcaggggacacctggagggcctggtgttgaaatggaaggaagaggggtttctggagtagaagctgggcagttagcatgaagtgggcacatggtgtaatgttttttttctttgcctgtttctgctgctctagtgcacataaagtatcatgtcttttgtttttgcagatggatttaccttgcaaagataattttcaaatctaatacttagcagatgcttgggcaaacagctctgcgataatacatgccccctttttttttcctcctcttgtagaaaaattgatggaa

SEQ ID NO: 22537 - DNA, 1051 bp, Homo sapiens
gagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggatttagagatgaggaaaaaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtccttgggctgagcctctgccctgtgaggacggccgctcaggcatgatccgtcagcgaagccgtggctgtgactctgttttccgcagtggagcggaggcggagggacaagatcaacaactggatcgtccagctttcgaaaatcattccagactgtaacgcagacaacagcaagacgg

SEQ ID NO: 22538 - DNA, 1062 bp, Homo sapiens
gtgaataagtatcaactgttacatgaacatatgataatcttccgaatgaaggtacatgtgtgacatccatttgccataacacattaggacacagacctctgggattaactcctgcctcttgagtgggcaggtgtaggacttgacactgggtgcaatgtggtacagtatcttttgcctgtttccatgtgacatcaaatttgttttttaatcctgctgcatttacatgagttaaagcatgaagttcttgtgcttttatgaatgcagatgataccagtaagtcagcttgttaatttgctttagtcaaaggccctagtaaattagtgtgtgctcgaatatgagtaacataaaatgggaaatttctttttcttacagtttgttgtaataaattgaatagctggtttaactgatcatccatgctatatttgattagagctgtctcaacatcccttgtagcctgtactacatatgcagaatctgatacaatattgataggttgatcaaaatcttgtaacactgtaatgactgcaaccaactctgctctttgagtcaattgatattgagttttgattactcgctcatcagaccccagaaaaggtgttggttgatatagacagcaggacggtggccatggaagtcagaatccactaaggagtgtgtaacaactcacctgccgaatcaactagccctgaaaatggatggcactggagcatcaggcccatacccggccatcgccagcagtcaatggaatgtgagtgccttagaggtcttggggccgaaacgatctcaacctattctcaaactttaaatgggcaagaagcccagctagctcagtcggtagagcataagactcttaatctcagggttgtggattcgtgccccatgctgggtgccagatgaagaggtgagttgcccctaaaaaggataccctattccttctctttcttaatttcttttagtctcaattgggactttaatgccattttcattttttcctagtccctttcctggtatatatcccatctcagtcatgattttttgatttgcggggctgtataatggagc

SEQ ID NO: 22539 - DNA, 1050 bp, Homo sapiens
tccagcctgggcgacagagcgagactccgtctcaaaaaaaaaaaaatagttcttatctgttaaggagacataatggcgcatttatgactgagttgatgtctggaatttgctttaacatactccagcaaaaaaatataaaaataagaaaagtataaggccatgcgcagtggctcatgcctgtaatcccagcactctgggaggccgaggcgagtggatcacttgagatcagaagtttgctaccagcctggccaacatggtgaaaccccgcctctactaaaaatacaaaaattagccgggtgtggtagtacacacctgtaatcccagctactagggaagctgaggcaggagaatcccttgagtccaggaggtggaggttgcagtgagccgaggtcacactactgcaatccagcctgggcgacagagcgagactccgtctcaaaaaaaaaaaaaaaaaaaagaagaaggtactttgtaacattctccccgcccttgagaatgtactttataagcctatcccaaacctgtaagaactaatgataatcccaccaccctttgctgactcctttttcggactcagcccgcctgcacccaggtgaaataaacagccttgttgctcacacaaagcctgcttggtggtctcttcacacggacgcgcgtgacaaagaagtatagatcaagtgaaatccagaagtgttgaatattggtagcgtttgagatgtacttaagagtgcgttatactattccccttaatgtgcatgtttgaaaatactcagaataaaacacttgtgagggctacgggaaaaaaaaaagggtcagctgtggcccaagaaaggacagggaccaagcccacggacgtgctcctctgagttgcactagtctctgggccttggctcccaccctgaacagctctcatctttaaatgtcttcagctgtcctcctccaggaagccgggtcaggcgcttcctcccgggcgtctccggtcttcctggaaaccacaggtcgggtgtcaacctactccaggataggggccccgaggggccagccaggcct

SEQ ID NO: 22540 - DNA, 1027 bp, Homo sapiens
gaccaggcttgattttgctgaggagttgtaccccaaccctgccgcgacctcgacactcagatgtgtggattcgccctgcccctcatctctgtgtatgttgagaggcaggaacttgttcacacccagcccattgttccgtgcctgccctcttccattgatcctgggtagtctggcttgctcagggcccctggggcccctgctgacacccactcctttcgcctccaggattcagcaccatggcggaagacatggagaccaaaatcaagaactacaagaccgccccttttgacagccgcttccccaaccagaaccagactagaaactgctggcagaactacctgggtaagcaggacctttccctggccacatacctcgagtcactcaccgcttgcctcttcctaggggacccatccaccccagcctcctcccttttattctgaacatccttactctggaaggcccatgcctctcatcacctgctgttcaggtccaggctagggttacaaactttagttcctgcaatgattttttttttaatttaaattttttattattattatggtttggttttgtttttttccagagatggggtctcactttgtcacctaggctggagtgcagtggtgcaatcatagctcactgcagcctcaacctcctgggctcaagaggtccccctacctcagcctctcgagtagctgggaccacaggcccacactactgtacttggctaatttttttgtagagaagaggtctcagtttgttgcccaggctggtctcaaactcttggcttcatgcgctcttcctgcctcagcttctcaaagtgttgggattataggtgtgagccaccgtgcctggcccctacaatgatttttttttaagctgtatgtgtgtgcgtactgtaacatgtacagaaagcacataacaaacatgtacagctaaatgaataattctaaagtgaaccccttgtgcaaccataacctggagagaaaagcagacattgcccacactctcatctccctgccttctt

SEQ ID NO: 22541 - DNA, 1062 bp, Homo sapiens
tgggattacaggcatgagccaccgcgcctggcctccccaccttctttatgtcctgtctggaacacagcaccccgctctccccagtagagaagtgacgccactaactgggggttatcacatctttgtttttggttttggtttttgtttttgagactgagttttttgttttcgttgcccaggctggagtgcaatgtcacgatctcggctcactgcaacctcttctgcctgctgggttcaagcaattctcctgtctcagcctcactagtagctgggattacaggcacccgccaccatgcccagctaattttttgtatttttttttttttttagtaaagacaaggtttcaccatgttgatcaggctgatcttgaactcctgacctcaggtgatccacccacctcagcctcccaaagtgctggaattacaggcgtgagccactgtgcccggcctcacatctttgttttttaccaccatgtttattattttattttattttatatatgttatgttgttatgttattgatggagtctgtttcttgttgcccaagttggagtgcaatggcacgatctcagctcattgcaacctctgcctcccgggttcaagtgattctcctgcctcagcctcctgagtagctgggaatacaggcgctcgccaccacacccagctaatttttttttttttttttttttgagacggagtctcgctttgtcgcccaggttggagtgcagtggtgcaatctcgactcactgcaacctccgcctcccagcttcaagcacttctctgcctcagcctgccgagtagctgggattacagtcgcctgccaccatgcctggctaattttttttttttgtatttttagtagagacagggttttaccatcttggccaggctggtcttaaactcctgacctcgtgatccacccccctcagcctcccaaagtgctgagattacaggtgtaagccaccatgcctggccaattttatttatttatttgagacagagtctcgctctgttgcccaggctggagtgcagtggtacaaccttggctcactgcaacctccg

SEQ ID NO: 22542 - DNA, 1059 bp, Homo sapiens
ggcctcatcctaaggccgagcacagtggctcacgcctgtaatcctaacactttggaaggctgaggcaggtggatcacctgaggtgaggagtttgagatcagcctggccaacatggtgaaaccccatctgtactacaaatacaaaaattagccgggcatgatggcgggcacctgtaatctcagctactcgggaggctgaggcaggagaatcgcttgaacccgggaggcggaggttgcagtgagcggagatcttgccactgcactctagcctgggtgacagagcaagacactgtctcaaaaaaaaaaaaaaaaaaaaagcctcatcctcaaggagcttttagggactagtaggggcccaaaacaggggcatagtggaggcagctaaggtactgctaatccttgaacagagacactcagggctgagtgggaactccagcacctctgactccttctcttccctttctctaggaaactactgcccgatctgtacacgctgctatgaagacaacgactatgagagcaagatgatgcagtgcgcacagtgcgatcactgggtgcatgccaagtgcgaggggctctcaggtgagtcagtggagcacctgggctgcagcctcaaccctgtggggacccctgcccccaccacaggccccaagaggactggtgggctaagggtccttgctggcctaggggctgctgggagccctcacatcctctgaaaccacttttccctttcccacttggctatcctagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccaggtctggagggccctggaggcaggatgggccggggctaggcccacccccagccctgctaacttccccgctttgcagtgtgggccagatgggaagcaactgcacccaggaccctgcggcctgcaagc

SEQ ID NO: 22543 - DNA, 1052 bp, Homo sapiens
caggtctttccccaaaaccaccccaggaacccgcccagcttttcttttgtttattcatcgaatacgtgtctatcaaatacctcccatggacctggccccgtccctagcactggggacccagcactgagcatggccctgtcctcctgggactcatgttctcatggaggagatggaccatgaacatcaacaggaaaaatacagagtaaagtctgatggtgatgagtgctgaggaggagagaggaggagggaagggcagtgtgcagggtcagggcagtgtgaagtttttagcgagagtggcaagggaggctttggcaggtcttctgtggccagcagcagaataagcctggaggatttgatggtgaacgagacaggcatgatctctcccctgccggagttcacagtcttctgggggcacagatacataaacaagtaaaacaggtggtatgtcagaggacgggcgtaagatgtacggagaaaaataaacgagaaaggccaggggtacagagaagggagtgtacagttttgaataaagtgggtgaggaagactgcactaagaaggcaatatttgagtcaagacctgcagaggatgagggagggccccaggtgcgcacgtggggagtgacaggctgagggaacggcaggtgcagacatctgggcctgggccggtgcctggtgtgttggaggagctgcagggaggccggtgtggctggagctgagtgagtgaggggctgagggagaggagatgatgaggtcagagaggtgacggggaccagacagaggggtgactcacaggtcatgggtcacagtgaggactttgctcttgcctggagcgaggtgcagccagggcagggctctgagccaggcgggccctgatggaactcaggtggtctcaggctccctctggctgcaggtgggagcatactttagggtggggaccggaaggaggctctgggatgtccaggctgggggagatggaggctgggccagatggggggcagtggagggggtgacagattgattgtgggagttaaagaggggggctcagggcaacc

SEQ ID NO: 22544 - DNA, 1047 bp, Homo sapiens
tgtatccagggattctctttcccagcagcgccagtgcgactccatgggaggtggggccggggcgcgtctttgagagaaggggcgggtgcctacgcctttaagcgcgggtgcgcgcggagcctgcgcctttaagcgccggtgcgcgcgctgccctgggttgccggcgaggaggccgcgggagcgcctggacccggcccgcccagcccggcccccgcccggcccccgcctcggccccggcgggggaggggtctctgagcgcggcccctcccccctgcgcccccgcctgcgctgcggtgcccccatcccgcgtgtcccagtctgtctgaccgtccctccgctcccaggcctcgccccacccggccctggggctgcccggtcgcccccctccccaccgcagccggtcccctccctcccagtcagcctccgccgcagcccaggaagccagccgggacgccgccgccccggaccccgcgccctaacctccacctcgggggcctgcacccccagattgaatcgggaattccggaaacccgagcctggaaccctgatctgggaccagcaccccgagatccggccgtggaaccccaagatctggagcctgaaccccagtatatggggctggaatctcaacatcggtcactgggacctcaatatttggagccggaaccccacaatttggaacacagaccccaatatttggagcagaaccccaagatttgacatctaaaacctcaagcctggagctgaactctgaattctgggcctgggaccttgaaatctgggactggatttccagtactgtaccctggaacccactcttggggacctgaaccctgggattcaggcctcaaattccaagatctggactgtgggattccaaggggcctgaacccgagtttgggcctgaagtccttgctgcagacctgagtgcttaaatctggggcttgagacctcccaatcttgactcagcaccccaatatctgaatgcagaaccccgggatcggatctcagactctaaaccccaccgtttggctgcttagcatccca

SEQ ID NO: 22545 - DNA, 1034 bp, Homo sapiens
gtgggccatgtggggtgggcttcatacaaggcactgggggtttcttgagggtgcagagggtaggaagacttggggggtcctgtaattagcacttccaggactgttttggtgtctgtaaattaggggtgacagtgggctggttatggtgggtttcttcttgagggataagaacaagggtctttgttaatgaaggaagtctctgattgaggggttggaatctaagggcttcagggtgaccatggggtcacgacatcttgagaggactgatgttaaatggggaacaatgacatgaatgtctgttactcttttgctttgggggtgtgacctatgtttatttcaagaggacttaaggggcagtgtttgttaatggggaggtttctgatccagggttgggtgattcaagaatgttctgttgtaatgcattatgtggagagggtcaccatcatttggggtgatatggaaatctgttaatctgggaatctgctctgaggggttggggatagggactagcctgaaggtgctactcagggaatctctttctgggtgacatggggtctgtatttgggggttattatgggagtatctgttaataatggggcctcaatgatcgagggctggctaacaggggtctctactctggatgtgttactgggaatctctatctcagggtgactcagggctcctcgggtgtcaggagatgctagtggggactctgtctctttgtcaggtgtccagggcctctaagactgcatctccgccctcagcatccaggggaaccagcagcagaacagcaacctggaaaggaggatgacagggtcacgcccttaggcaggcagcggggacatctgcacccatcacccccagcctttcccccagtgtttgctatcaggcctttctggattctgcctctacctctctggctgtggtttgtttgtttgtttgttttctgagatggagtctcactctgtcacccaggctggagtgccatggcacgatctcggctcactgcaacctctgcctcccaggttcaagca

SEQ ID NO: 22546 - DNA, 1025 bp, Homo sapiens
agccactgagcccgggaaagccagaaatttggaaacacggctgaatgttctgatttttgaataggggatcctagacaaaatgaaaacacactgcaggccaggccaccacccatggatggggctgccaggctggggtgccactcaccaggcgctgcagaccccggcgtgcccgtgccagcaggctctccccgtgtagctgctgtgccagccgttccagggcctgcagctgcgcctggtgccgctcctggcaccgttgcagcctccgcacccggcgttgcagtgctcccagcactgggcccagcccggtctgggcctgttgggcagggacttcaggttgtgaccgctcaggagttggcgcaggggccaggggggtcaggagcatggtggccacagtcttggggctccccgatgtggggcccagcaccactaggcgcactgggccagagactgggatggcagggctctggggcaggggtgtattcttctgtaggggaggcggcggcgagactggcttctgggtgcttcgggtcctccgctgactctggaagacaaggcatggggtgcaggggtgccgtggtcagacttcgactcaggaggaaagggatggagggtctgtttccaagggggacttgcctaggtaaggccagacctcagggaggaagtgtcgtcaggaggggagggccaaagttcagactcaaggagggacttcccttaggcagggaggtctgggggttggattccagcagcaggacctcccagcgctcaccttggcaggtggtccccgggagaagatggagggcactgcatcaggccgcaggtagcgcacaccccagcgccactggaagcaggagggtgtgaagtgctcgctgcacaagtgctggtggcagctgggcacccagtgctcacagcccatgtgctgcagccaggcctgcagccggggaccatccttcagtgggaacctgcatgggtggttggggggctgggtcagtgctacgaggttcagacttatccctcccagaggatac

SEQ ID NO: 22547 - DNA, 1049 bp, Homo sapiens
cgatcttggctcactacaacctccgcctcctgggttcaaacgattcttctgcttcagcctcctgagtagctgggactacaggcgcacgccaccacgcccggctaatttttgtatttttagtagagacgaggttgcaccatgttggccaggctggtcttgaactcctgacctcaggtgatccacccaccttggcctcccaaagtgctaggattataggcatgagccaccaagcctggcatttcttcttattattattaatttgaaagctccaccttttaaacacccagcatcagcccacctctgccccctccactgcccctccttccagcctccttcctggtcttcctgcccacagtcccgcccctccactcccaatttgttcttccacatcaacttgttggagcagtttataaaatcagacagttacgatgtgggagatcgtgcagccaagcgaaaacgtttcttccacaccatataaatgggggtgtggggtttctggattaagagagatttaagaaacatcagcacaaacgcaggatgtggaccttgcctacaacaaacaattcagtaaaaagacattttaagacaattggggaaaactgaacatgaactggttataagataattgtaagaaactggtcaggcatggcggttcatgcctgtaatcctagcactttgggaagacgacaaggtgggaggatcgcttgagcccaggagttcgagaccagcctgggcaacatagggagacctcgactctacaaaaaaaaaaaaaaattagccatgtatggtggtacatgcctgtagtcccagctactcgggaggctgaagtgggagggtcacctgagcctgggaggcagaggttgcagtgagccgagattgcgcaactgtactccagcctgggtgacagagccagaccctgtctttaaaaaaaaaaaaaaaaaattcattttgctaggtgtgataactgtattggtttatacttctgaaacagtcttctgttagaaatcagtctgaaataattacggataaaagatctgatgtctgggatt

SEQ ID NO: 22548 - DNA, 1028 bp, Homo sapiens
cccaggccaagggacagctccccagcctccttaggacacagaggctttttgatcatgcgttggtgaggccaagaagaggtgggacctgagatacatgcctattatctttctatgctcagagagagagcaggagcttgggttgggtgaaatgatgggcgataaatgttcataggaatcaaaaactcaattgctctcggggccaggcaaaaatttccggtttgtagcctctatatgaaaagcaaagcagaggaagagggaagagggaaaagtagaattggagcaggagagatggatggccacaaataccatgagggatggcattgccggggaggcatctccactgtcactagaggtggctgtcactactcagtgacattgatggtgattgattacccatgtggccttgttagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgagccccccccccacccccttgcccctgcttggcctctgcacagttccccacagtttgggaacccattcagtaattccttcagaagatactcattgactccctcctatgcatcaggccctgtcctaggtgctgaggacacagacacaaaatccctgcccttaacaagctcacatttggatgggaaaggaaacctggaaacatcatcagtgaataacacgccaagcagcagtaaccctctgaagaaaaatgaggcggggaaggggaaggggaatgcaggtggtattctagagaggagaggggtcagggaaggcctccctgaggacatatgagcagagacctgcaggaaatcggggagtgagacctgcaactgctggggagaaccacaagcacagaggccctgcggcaggaacatgcactccacagag

SEQ ID NO: 22549 - DNA, 1028 bp, Homo sapiens
gtgatcctcccatcttggccttccaaagtgttgggattataggtgtgagccaccacgcccagcctgtgcctcattttaaaatgacacttatctcacagagttggattaaatcagccaatacctggaaagcactttaccccatgcttggcacacagtaaatactcagtgaagtgccagctgctatgattgtcatcccatgtatttgtgtaatgttattatgccaaaaaccagtctccttccttccctgccgccaaacctctgcatctcctcctccaggtgccttcaaatctcttgacaaagatggcactggacaaatccaggtgaacatccaggaggtaaggacccccatattggggtatgggtgcctgggaggaccccacccctcagcccttcataccagctctgagctgcagtccccttcctcctattttgccagccgtccctgggtgagggcaaaggggctggtgctcttggggttccctgtcctcactctccaccctcctctccccagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataa

SEQ ID NO: 22550 - DNA, 1024 bp, Homo sapiens
cacagaaggaggcggccaagttcgcggggggaggggaggagacagagagtcgaccagtaaagcctcaagggaaatgtagtccaaggcctgagaagcgacgttgctggtaatagaaggtaattcagtaccagcctgggcctggccgcggtgaccgaggcgggccgcgtcgcggagacttctgggagtgcttcctcgctctccgagtgcgcaagcgcagcgcaccgagtggacattttggtctttgtccgcgggtcagtacggcccctgggtccacgtggcgcgaaagtaggaggtgggatctgggcgtctcgggtcggtcggaccggggaggttaaaggggaggattcctgatctttaggggcgcggcgcgagggcagggagtgggtgtaagagcttctggcctacgtgcggggcggagatgggggcctctgaggcgggtttgagcgagtgtgaccgagtttgtcctcaaagtttgacctgatgtttgggattgttgagtgaatgtgaaactgggtgcgggattgtgtgtgattgtgcctaagagggagatgtaggagaccagcattgaggtataacgtttgagctgcacttcccttgtcgaaagtgctgataattataacggtgccatcttcctggagcgtcttttttacttgaaaattgaaggggtggaaaagctaagtggtgaataattttaaaacgagtttttatataaaagcatttctttttaattggagtggcatgcaaatcaccgtgacttttttttttaattaaacgagagtgtttcgaaggaactttagtttcggggtgcctacttcagactattcaaatccccatctttggggtacttaaatagggctgttaagcaaagccctagactaaacagcattgtacgctttgagaagcaatcccatataacggcgcccaggatgagggagtcaacggttttaggttaggcacagttatcctcattttttgaagaaagcttaattgttgcagtgtttatctatgagtctggactaaatcc

SEQ ID NO: 22551 - DNA, 1019 bp, Homo sapiens
tttgtatttttagtagagacggggtttcaccatggtgaccaggctggtctcgaactcctgacctcatgtgatctgcctgcctcagcctcccaaagtactgggattacaggcatgagctaatttttttttttttttttttaaattaaaggaagacataggccaaggagccagacttcctgtgttaactccttcctctgccactttttaccttggggacctcaggtaggtacttaaaccttgggcctcagttgctcatttcatagtatagaaataatagcaatatttgattcaaagggtggttgtgtagctccagaagttaatacatgtaaagttctaagaatagtccccagtgtgtagtaagtacttgattaatgttaaatactagtactttttattactagctgcaaaaaaaatgcttcctcagaaaatattatagtcctgtgtctggtaggaatttctgaaagaataagatatgtagatgcacttttgttattaatatttcttttttttttttgatggagtctcactgtcgcccaggctgcagtgcagtggcctgatctcggctcactgcaggctctgcctccctggttcatgccattctcccgcctcagcctcctgagtagctgggactacaggtgccagccaccacgcctggctaattttgtttttgtatttttagtagagatggggtttcaccgcgttagccaggatggtctggatctcctgaccttgtgatccacctgcctcagcctcccaaagtcctggcattacaggcgtgagccactgcgcccggcctaatatttctatattttaatttttttacttaaaattttctttttttttggtggagggggggacagagtctcggtttgtcgcccaggctggagtgcagtggtgctatcttggctcactgcaagcttcacctcccaggttcacgccattctccagccttagcctcccaagtagctgggactacgggcgcccaccaccacgtccggctaattttttgtatttttagt

SEQ ID NO: 22552 - DNA, 1050 bp, Homo sapiens
cccgcatcagcctcccaaagtactgggattacaggcttgagccaccgtgcctggccaaggcactactttttaaaaaatgaatttgattactattgaagtaagtaatgcatttctgtgattcaacaaagatctatctcacagagatatctcattctgctcccttcccccagtcacattcttctttgtcttatgtaaacatgtcttgtttttttttgtttgcttcttgtttatccttcaagtgggttttttgttttttgttctgtcactattatatatttctcttcactcctgtttccctccaccttacataaaagatagcataccacatgcacctccctatatctcactttctttaataacagtatgtcctagagatagcccttccttttttctttcttttttttttttttttttttttgaaatagtctcgctctgtcacccaagctggtgtgcaatggtgttaacatggcatactgcagcctccaactgctgggctgaagtgatcttcctgcctcagccgcctgtgtagctgggaccacaggcacactccaccacacctggcttttttactttttgtagagatgaggtctcactgtttcccagattggtctcgaactcctgagctcaagcagtcctcctctcttggcttcccaaagtgttgggattacaagtgtgagccactgcacccagccaaggtgttccttcttaatcataatctttaaaagaaatttttttttcagctgctgtataaataagatgtcattatttggatgcaccatggttgattcagttaatcccgttgttgagcatttggattgtttccagtcttctgctgttgctaacaatgcagtaatgaataatttttttatgtgcgccattttatactgacacaggagtagctctaaactagactgctattaatacaaatggcgctgcccagtgggtaagtacttacactcccacaagccatgtgcgagagcgtcttccccttaaactcaccatgagtgtagtgtcgaatatttggtatttcgctagggacataagagacaa

SEQ ID NO: 22553 - DNA, 1088 bp, Homo sapiens
gcagtaggcatccttgtctgtttagaatctaatagaaatgccttcagtgtttttctattacttttattatcatgatttgcttttcagtgtttttacattagataagatactggcttttgtggtcagatacagattatgattatataaatatagattacccatgctgcctgggtcagtgggagtgtgagcagaaagactgaggacactgctaatagccaaggtgcaacaaccagggaaaatctgttgattgaggaaacaacaatccctcaaaatttcgttattgcatccttaaacaaaaaatcaaatgggacaaaaataagatgtctattcctattcttctgttttctgtcgattcccttcttttgggtgactgtttctttactcatttcctctgtttatcttttgtggtctatttatagctttgcttccttcttaaaagttttgtgtcttaagttcattttgttatgtttcagttttcatctgctttgtgattcttacttttttttttctggctcactgcaacctcaacctcctaggctcaagcagtccttttgtctcagcctgtcaagtagctgggactacaggtgcataccaccatacctggctagtttttttgtatttttttttagtgctaagcacgctggtcttgaactcctgggctcaagcagtctacccacctcagtgtctcaaagtgctgggattacaggcatgagccaccaagccctgcccctgctttgtgattcttttttttttttttttttttttttttgagacagggtcttgctttgtcacccaggctggagcacagtggcatgatcacggctcactgcaacgtccacctcccaggcttaagcagtcctcctgcttcaggctcccaagtagctgggactacaggcatgtaccaccccacaccctgctaatttttggatttgaattttttgcagagatggggtcttgccatgttgcctaggctggtcttgaacttctgagctcaagtgatcctgcccacctcagcttcccaaagtgctgggattagtggcatgagccactgcgtccagcccacggtaacatttctccctgtgtcttca

SEQ ID NO: 22554 - DNA, 1071 bp, Homo sapiens
tcacattgtgcccatgtgctttagttctgatgggaacgtgttaaagtcagacatgggtgttgaattcatccacgaataagggctgtagttaaaatcctctcaggaccctgagtgggagtgtggtgctagagaaaaacagcaatcactcacacaaggtgtgaacagctctcctgtgtaagtaaaattctgaaaggtaattctccctttctcccatttctggatgtgtgtagactttaaatggtttaatgagcatggctttgaagtttaggattctaatggccctagtccctttgcccacatgattgtgtgtgctttagtcactaaggcagaaggtcattactttgttctgtgcatctttggaagttgcaccctcattcttcagaaggccaggagaccccagggctcagcctgagttctaggatggtactttggacccagcattaacattgtaatactgtgtcattttcccaatagttaatatgatcctctgttgaagcaagaagacaaactgtatggtggagaaagaagtgggaaggatctgcgcgggtgagtaaatgacaggcaggccacagtttttcagtcagcattgagtcctctgaagtgcttcaaaggatgttttcttccaggctgtagacatatagagtattgcttggtatgagatttttagattcctgaatgacgcttccagtcatcatttttgtgtgtttcattattcttcttctttcaccagattctagaggggccaggcgcccctcctgttgctgttctgatgtcagccttcctgcttcgtctgtgccgccactgtggtggctgttctccttcatccacataccttttcctgtcctcacacattgtcctttatactttgtaaaaccttacatattgtctgatattcaggttcctttttgttactaccttctctcatcctttctagtggctgaatgcctcagaattatattttacacctgttctcacacttcccgttgtcttctcactcatctctgccatcgtagatccatggactcctctgcctacctttcttctgctcccatgtacctctgtcataagttg

SEQ ID NO: 22555 - DNA, 1074 bp, Homo sapiens
aaattccgtctcaaaaaaaaaaaaagaagaaagaaagatgaacattatttttcttccttagcatcccaggtagactttctaattttcatctttttcttctatttggcaattcttcattatttgttatacaacttgctaaattctgaaatggaaaggttatttttcaagagtactttcagctttgtggacccatgaatgttaattttctacctagatcacctcaagtagggttcccttctcataatttagttggaagcattaataatatagattattttcatattgggagatgggctaccagagttaatctcaaaaaattttattgctagtaatgggaaaattaacaaataaaagtgatagtaatataaaggtaaaatgaagggcttaccatatggcagccatggttctgggcactttatgaatttaactcctttgtgctatggttctttgtactccattttagaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatga

SEQ ID NO: 22556 - DNA, 1653 bp, Homo sapiens
ggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgttttaattattttaacatggcatacacactatatcggggtccccagctccccccagctgcatggcaggaggtgagtggcgggtgagcgagcattgccacctgagctccacctcctgccagatcagcggtggcattagttctcataggagcgcgaaccctattgggaactgtgcatgtgaggaatccaggttgtgcgcttcttatgagaatgtaacgcctgatgatctgaggtggaacagtttcatcctgaaaacatcccatccccattcttctacccccacaaaccgtccgtggaaaaattgtcttccatgaaacaggtccctggtaccaaaaaggttggggaccgctgcactatatgatctctgtcttcgtatttctaacattttgcagaatgagcttagaaaactttaactttttctttgttcatacatgcacaggcttcatataattggtctttttcagttaggctgattttggaatgtcagttttcctctcctgcatatttccatgggaaacgtgtgcattaaatattaaatttttgataatatctttttttttttttttcccatcttgctctgttgcccaggccagaataccatggcaggatcttggctcactgcaatctcctctgcttactgggctcaagcagtcctccgacctcagcctcccaagtagctgggactacaggcacgcaccactatgctgtgccaattaaaaaaaaaaaattgtagcgatggggtctccgtatattgcccagattagtcccaaactcctggggtgaagtgattctccatggcctgttcaagtgctgccattacattacaggtatgagtcaccatgcccagctaattttatttttaaaaagagaaaacaacttcccataacttccacagttcagtgcattagataccaacacctgcgtgtctgtcttaacctgcgagctctgtcactcctcccactgctgttacagagagagaatgggacgggtatgagaaaaatggctcagaccctagacagagttctattttgtaaaccagcccttcatgaaaatttttttattctttgatcacattataat

SEQ ID NO: 22557 - DNA, 1053 bp, Homo sapiens
gcggaacccgaccgggatcgccccgcgagatgcagtcgttgagggagtcaggagcccgggtctgggcggggaccccaaggctgctggagccggagctggcgcgggggagacgtgtgtgtgcgcgcgtgtgtctctctgtgcgcgcgtcagtgtgtgcacgcgtgtgtctgtgtttgcatctctgtgtgtgcacacgtgtgcctgtgtgtgcgtctctgcacgtgtctgtttgcctgtggtgcacacgcgtgtctgtgtgcgtctctgcgcgtgcctgtttgcctgtgtgcacacgtgtgtctgtgtgcgtctctgtgcgcacgtgtctgcgtgcgcgtgtctctgcacaagtgggtgtgcgcgcacgtctccgtgtgtgcgtgtgtgtgtgtgtggcgctagccctagccagctgtttgacgtgcatgattgtgacagcagcatgcatgattgtgacagcagcattaggtgtgtggccacttgtaaccacgtgaatggcttttcttgactgtgtgtaactcttgcttatgttattgactgtatgtgaatagttacagagggagtgtctgtattgccgaagtagtgagagcatgatggtgtgtcatgagcagttttagtgaaaggtaggaagcaaccagggtgtttttctttctacatttacacacaccactcaccaatgtgtggagtttttttctcccacactaaacagttcttcagcggacaccaactgggtgtgctacagttcagtgcaattccaactgtacctggagatagcagcagaacccatcggttaagggcttagtcccaaaatactgcccccgcttcagatgccaattgcaggtcccaggatgtgacctgtgcttctgacctactggctataaatcaaggttgccatgacccctcaagtttgagtattttgctagagtggttcacagaactctgagaaacactttatttatgtttacccatttattataaaggatattgacaaggatacagattaacagccagaaggaagagatgcatagggcaagatatgggggaggggtgcag

SEQ ID NO: 22558 - DNA, 1032 bp, Homo sapiens
agaatcagtgagcacagtaaaatcattgtattatactactgagtttggagtggtgtattatacagcatcagtaactggtgaacaatgactgatatacccacacttgtttatgtcatattacacacacacacacacacacacacacacacttttttttctttagaggtggggtcttgctgtgttgtgcaggctggtcttgaactcctgaactcaagtgatcctcctatctcagcctcccaaagtgctgggattacagatgtgagccactgcacctggcctatactgacatattttattttacttaaaaaatttttggctgggcgcggtggctcacgcctgtaatcccagcactttggaaggctgaggtgggtggatcatgaggtcaagagatcatcctggccaacatggtgaaacctcatctctactaaaaatacaaaaattagctgggtgtggtggtacacgcctgtattcccagctacttgggaggctgagtcaggagaatcgcttgaacgcaagagtcggaggttgcagtgagctgatatggcagcattgcactccagcctggcaacagaatgagactctgtctcaaaataataataataataatatgagcaagaacaactgcacctaacaaataaaaactgatggtaatacataaggttacacaaatattcaaagacatatcatgattcgaaaaccacattaactgttctcttggctatcccataccaagtggagccaaaggctctgcacaggtttccaaacccgaatcatagccatgatagcaactgtggtcctctccctcctggttacctgctcacctgaagcaggtaagagcctgcttggcttcctagagaggcacttctgaggcaggagaataggaaattagtataaccaagccaggcgcagtggctcacgcctgtaatcccaacactttcagagtccgaggcaggcagatcatgaggtcaggagttccagactatcctggctaacagggtaaaaccccgtctcaactaaaaatacaaaaaataa

SEQ ID NO: 22559 - DNA, 1024 bp, Homo sapiens
gggtgcgtgcgtgtgttgggatgcatgggcaatgaagggcggtttcttgtaccttggcctttcttctggtgagtctctcctcgcatctctgtctgggtcatgtggccgggtgtcattcgttttccaggcggttacagtttgggttcgtgaccggtgggcaacgtggggagctacatgagacacggcggggattaaatcagctcccaatcatgagcggcctcattgctagaatcaagacaactacaccccagcaaaggaaaaaattctcacaaaagctcatcataaacctgcttatgcaggtcgaggtgcccatcgacctcactcctctcaatcctctcgcgtgtgccctcactgagaaatctagccacagctcgatacagggacggaaaaggaagccggcaacgggatggggcaaacatctctgtggctccaacgctggccttcgtggccaagtcacccgtttggcactcctccccggatggccgtggtggtggcattgccgccaatcctgcctgggctctggcctctgctctgtcctccctcttgctctgtctgccctgtttctgagaggcctaggggcttgttagtctggctcaatgtcttcaacccagaagacttcccagtccatccgggagaaagttcctgggggtcggtgtcatgattgtttccttctccaaacctctttcagcatgattgggcaggtgtggtgatcctggagctctgggctttcatagctgtctgggacagggaagctttctgggtctctgtggccccgtggtcggtccaggaagagcgggaggcaacccgaccgttcctgacatttgccttctaggaaaggcggtgtggcatgccacctgcacttcctctctgattcttgagggccatcgggttcctctgctcctggggaaagagacttctagcactgaatcttctggctgccacggatgtcagggagccaaagggactgggttttgctgggtgcaggggaggtcgcgtcgggggtacctacccggtcgcggggtgg

SEQ ID NO: 22560 - DNA, 1024 bp, Homo sapiens
tatgttgcatgacaacgtccacaagtgataggaatttttcagctccattgtaatcttatgggaccaccattgtatatgtgtccatcattgagtaaaatgttattacatgacacatgactgtgttcatcaggaatatgtatgctagtatgaacctataatgagagtgttaaattttatgaagcaaaaactaacagaacaaaagaaatagatccacaagcataattggaaatccacaattatatctcagtaattgatagcacttgtaggcaagaaattcagtagtatatgtaatcagctcttcatatatgcagattcaaccaatagcaatgcacaaatattcagaaaaaacacaatgacagtaaaaaaatacaaattttaaaatacagtataaaattatttacatagcatttacattgtattaagtattataaaaaatctagagatggtttaaaatatacagaaggttgtgcataggttatatgcaactactacaccattttatataacaaacttgggcatctgtaggttttggtatccacaaggtgtcctggaaccagtcccctgtggatagcaagggacaactgtatagaagatatgaaccacaccagtcaacatgacctaattgttgtttacagaacaccatacccacaattgaaaaattacattcttttcatgtacctgaacagtccccatgatagactattggctggaccataagtcacaataaacttcaaaagattgccacattacagggaatgtgcattagaaaccaataataagaaacctatacagtccttcaatacatggaaattaaataacacacttctagatctacagatcattgaataaataaggggaaaatgttttgaaatatgaaaaagtgacaacagcatatcaaaattggaaggatacagctaaagcagagttgagaggaatgttaagtacttaaataaaaaaaggagaaattcatagcagcattattcacaataaccaagaaatacgtacaacccagatgttcatcagt

SEQ ID NO: 22561 - DNA, 1078 bp, Homo sapiens
attacttcctttggtccagcttacattttcttccgtttcccattttcactttctagtcccagcagccatgcatttgcctatgcagataaaatgcctgtatcttttccactctacagccaatttacgaccatctctgttgtaatggtggtcatgtaggagcagttgtcctctgtcagcccgctgacacttccttaatctaggagacatttctaaccatggttacttaattgtcatttccacctaacatgtgataagccttttccagtcttcaggagtattacctcaaaacttttatcacataacgtgtgtcaacttatgtttattgatgttctttacattccttaaagcaacagacccaaagtagggcatgcctcacagtagaatgtataagacggtctattggaaggaaataaaatactaacaatttacattcgagagcagtattcattaacaatgtagattttcataaatgcctattgatggtttataaatagctacaatgttgggaatgtgttcagtatatctttaagaccactgttctgtaggaaaaaaaaatctagtatcatgtcataatatccccattgcctatctccatataccttttccttcttagagctcaaagactgtttcctaacatactgtgccttttgctatttcctgatttactaactggtttttttctccccatgaatttttaaaagctgatgccctgtattcctacaaaacaaattcgttgtgagtacaaaacttttatgtcctcaatgaagcctcggagtacaaaatgaaatttttccttgttttgtgacactttaccttgtacgtatttctgtcattgcatctgtaaaacctactaagtgcatgtatttacatgtatgcccctctcttagcctataacttctcatgagcagggtcagggttttattcattttggtctaccaggcaaccagtcacattcaggacaaatagtgtgatctcagtatgtttagcatgagattataagtaaatacaaatggatgtattttcagagagaattttatgcaatataaaacataaataaggaaactagtctgaccagtaa

SEQ ID NO: 22562 - DNA, 1096 bp, Homo sapiens
gagtgtctcctgtgttagtcatgttagtcaatttcaggtataataggacctacctcactcagggtttttgtgagggtcattggatctacatcacagggaattattttggaaagtgtaaagaaataattgaattccaaatatccaagagaaggaaactggttggattaaccaagtacagtgccactgaggagtattatgcagccatgaaaagggatcagttgcatggatttatggagaagggcctccaggatactttggatttttttgttttcttgttttgtttgtttgtttctgagacaaggtctccctccgttgcccaggctggagtgcagtggcttgatcatggctcactgcagcctcgatctccctgggctcaggtgatcctcccacctcagcctcccaagtagctgggactacaggcatgtacaaccatacctggctaattttattttattttatttttgtacagttgggggtcttgctatgtttcctaggctgttcttgaactcctaggctcaagtgatctgcccaccttggcctcctcaggtgctgggattataggtgtgagctaccttgcctggcctccaggatactttgttagtgacaaaagcaaccgaatattatattctatcttttatctaagctttcagcttatcctttcattattttaatataagcaaatgtatatatttggatttttttaaactcatgtcaccaccatcacccaaatttaaaaagaaaacaaaaacagaacacttctagcccccatccaatcaccctggcacagaagtaacctctgttgtaatttcatctcatataaaaggagtcatgcagaatgtagccttttgagtctggcttcattcagtaaggatgttgcaattagtaaactgtagctgggactacaagtacatgccatcatgctggctaatttgtgtatttttattttgcagagacagagtctcactatgttgcccaggctggtctcgaactcctgagctcatgcaatcctcctgccttgtcttcccaaagtgctgggattacaggcatgagctcagttcagttgcatgttgcaattcactcatattattgcatgtat

SEQ ID NO: 22563 - DNA, 1015 bp, Homo sapiens
agggcaggcgaatcacttgagccaggagttcaagactggcctgggcaacatacaaaaatacaaaaaaaattatctggatgtggtgggcgcctgtaatcctagttgctcaggaggctgagacaggagaatcgcttgaacccaggaggtggaggttgcagtgagccaaggtggtgccactgcactccagcctgggcaacaaagagtaaaactccatctcaaaacaaaacaaaaaacaaaaaaagtgtttcttcatctattggtttttcacattatatggcttttttctttttttaatattactataatgaattatgttgattgatttttgaaaaatttagttgtcctgggataaactccacttggtcatgatataatacttttgtatatattgttttatatattaaatatgatgaatttgctaatatgttgttactgatttttcttgtctgtggttcataatggatctaatgtatagtttttctgtttgatgtcagggtaatgctatctcataaatgaattgggttgtattctctcctcttattattttctgaaagaatttatatagaattggtattatttcttaaacgtttgttagaattcactgtgaagccatctatctgacttggagatttctttgtggaaagttgtttaaccagtagttcaattttggtaatagaatgaagactgttcaggttatcagtttttcttttaattcaatgagcttttgtagtttgtgactgtctaggaatttgttcagttcatctaagttgtaaaatgtattggcataaagttgttgccctttttatccttttgatgtttgtataatctgtaacaataccccttttttattcttgttattgatgatttgtatgtctcactttttcccctggttctttggctacaggtatatcaatgtagttgatcttttcaaagtaccacagcagcttttagtttcatggatttcttctagtatttttgttacctcatttctcctcttttattttgtatttccttt

SEQ ID NO: 22564 - DNA, 1035 bp, Homo sapiens
gattacaggcgcacaccactatgcccagctaattttttgtatttttagtagacatggggtttcaccatcttggccagggtggtttttaactcatgacctcaagtgatccacctacctcagcctcccaaagtgctgggattacaggcatgaaccactgtacctggctaagtccacctgttctgattacagttccatccattctagggatcagtgtctttcaatgatgtgactgtggacttcactcaggaggagtggcagcacctggatcatgctcagaagactctatatatggatgtgatgttggaaaactattgccacctcatctctgtgggtaagaaaaatcctctttgaaactttagtagcatgcacttcctctcaaagtgcctaattgtgtataatcttgaatttcaggaataagaggtgatgaattccttttcgttagcagaatgaatgattgtgtcttcacttacccagtgcaaggtgctacctatattgttacacaaatgggtgtcttaatttgcagtactgaacatgcccctttcctcatttttcagtggtattatagcccaatcaacttaagtctttttttcacttttcagggtgtcacatgaccaaacctgatgtgatcctcaagttggaacgaggagaagagccatggacatcatttgcaggtcatacctgcttgggtgagtttctggctcttaggcagacacagtctagcagaatgtaaatttaaaagggtcaagtgggggtgatacctttgaaatgtttcaggagtatctttttttaaaggctcttgacctctgaaaaccttcatgcctataaaactcaaaaccagacctttaggctaggtatggtggctcatgcctataatctgacactttgggaggccaaggtgagaggatcacttgaggccacgagttcagagccagcctggacagcatagcaagaccccatcactacaaaaagataaaaataaaaaattagccaaggttgggtgtggtggctcacacctttcatcccagcactttggga

SEQ ID NO: 22565 - DNA, 1291 bp, Homo sapiens
tttaaagatcaccaataaagtatttatttctatgaagaaggatcactatcgagtctgcatttttcatgaaatatttatgtcaaagtgtaaggttgttaaaagatttgttaacagagttttcctaggcaataattatattgcaaattttaaagaagtagagcttaaaatggtaggggaaacatatgaagggtttatgagatcatggaatggtatgatttctttgaagattctctaaagataaatagaaataaacctggaaggcaagctaattaattaaaagaatgtgtgcacaagtgtgttattaggaataagtaaggtatatatagggcagtaagtatcaggcctgactgaggcaaaaactacctgttataaacaggtgagatctgtcaggtatgtggacaaccctgaaaacttgtgagaatataaaaaatgaatctagacaatatagttttgtttacaggagaaattccttgtatatgttagaattgaagttcttggactcaatgaagaaatagatttttgagcatagctttaacattgcttcatcagatatagatgattgcaaggtaagtaaagttagaaatagctatacttttataagagaaatgaaggttaaagttactctgatttaggaccagattgttcaatctaccatttgaaattggtattctgatctaccatatgaaaaactggaataaaggaatgttactgcattggggaaggatgtaagccagtcttaaacctggaaaagtgagtcagtaactgaaaagaggactaggcatgagagctttgttattgaacaattctgaaagaagtgatttagcagcagtctgaatatagcaattgaatatattctgatcttttttaaagttgctatcggaagtattttcctaattttccattcataagagaaaataatacataattatgtagaggattagagcatagactgtagaaaatgaattgataatttaaaagctaaattaatcaatgttgactacatagaaagaggaggtgggttgaacagctggaagtgttttaccacagtcatctagggatgtgtgtataaaagtattggtgatcagccgggcacagtggctcatacctgtaatcccagcattttgggaggccaaggtgggcagatcatgaggtcaggagttcgagaccaacctggccagcatggtgaaaccccgtctctactaaaaatacaaaaaattagctaggcgtggtggcacatgcctgtaatcccagctattcaggaggctgaggcaggagaatcgcttgaacccag

SEQ ID NO: 22566 - DNA, 1055 bp, Homo sapiens
aaatttaacaaagaaattgaaaaaaataaaaaaacggaaatcaaatcttgcaactaaaaaatgaaatttctaaacagaattcattataggctctcaatggcagaatgggtccaatagaagaaagaatccatgagctccaaaataagttatttgaaaacacaaagtcagaggggaaaaaaaagaacacagaatgaaaaggaacaaagatcatctacaagatgtagaacattacctcaatagaccaaatttaagaatcattgatgttgaggaaagagttgaataagagacaggggtacaaagattatttttaaaaatattaataactttccagtcttctttggaaagaaaactttccaaaacttgagaaagatatacatttccaggtacaggaaggtcagagaacaacaaacagagttgacccaaatatgattaccccaagtcatataataaactctcaaaggtcaaggaaaaagagaggatcctgaaagcagtaagagaaaataaacaaatggcatttaaaggagctctaattcatctggcaacagacttatcaatggaaaccatacaggacaggagggagtcaaatgacattttagaagtgccataagaataaacattgccatccaagaataccctatccagcaaagttagctttcaaatatgaaagagaaagtttttcccagacaaacaaatgctaagagaattcaccaccaccatacccctgttacaagaaacgctaaagggaatttttgttttttcttttttgtccttttcttttttattttttgagacagggtctcactttgtcacccaggctggagtgtagtggtgcgatcttggctcactgcagcctcaacttcccaggttcaagcaatcctcccacctcagcctctcaagcagctgggactacaggtgtgtgccaccatgtccagctaattttggtattttttttatagagatggggttttgccatgttgcacaggttggtctcaaactcctgagctcaagtatctgccctccttggcctcccaaagtgctaggtttacaggcatgag

SEQ ID NO: 22567 - DNA, 1087 bp, Homo sapiens
aacaggagcagaactccgtctcaaaaaaaataaaataaaataaataataaagcaaggcacacggcctgatcttgcctagattttttatcttccatgaaatgattaatgctgctcataagacttgagagaaattaaataccaaagagtaaaattttatgcaattggtcaggcacggtgcctcacacctgtaatcacagcactttgggaggctgaggtgggcagatcactggaggtcaggagttctagaccagcctggccaacatggtgaaaccctatctctactaaaaatacaaaaattagctgtggtggctttcctctagaagagctgggtgcagtggctcatgcctgtaatcccagcactttgggaggccaaggcaggtgaatcacttgagcccaggagtttgagaccagcctgggcaacctagagagacctgtctccacaaaattattggggcatggtggcacatgcctgtggtcccagctacttgtgagtttcaggtgggagggtcacttggacccaggaggtcaaggctgcagtgagctgtgatcacgcaactgcacttcagttcggatgatggaggtgagaccctgcctcaaaaatataaagtattggtactctacaacaagagcattgcattgtcacccatgtagacaataaattgactcagaatcacaaatacttatattggggacctgtatgtcaagccctaggaagagtgccaggtcatcatctgggaaaggaaatattaggagtattggggtgtgaatagtactgcacagaattccaattcatttcaaaatatatttcacagattatcacaaaccaggaaatgagttgtgtgtaattttctttgtttttgagacagaattttactcttcttgtccaggctggagtgcaatggctcgatctcggctcacctcaacctccacctccccgaaacctctgcctcccaggttcaagtgattctcttgcctcagcctcccgagtagctgagattataggcatgtgccaccacacctggctaattttgtatttttagtagagacggggattcaccatcttggccaggctggtcttgaactcctg

SEQ ID NO: 22568 - DNA, 1033 bp, Homo sapiens
actccatcctggacaacagagtgagactccttctcaaaaaaaaaaaaaaaaaaaaaaagaacagttgatgaaggatggatagactaaaacaatgctgcattaatgaggctacgatagtgcgtatttgtataaaaagcattaatttgcatttgttggcattttgaagctctgttgttggatgcatacacatttagtatctatatgtcgttatgatttgtaaatcatgtaatgcgtctctttacataatgatttttaaattattttgtaatgtttctcattacgttatgtaatgcccttattaactttccttggaaatcttttttacccgttatccatacaaccactcttgctttcttaatactgatgttagcatgatataccttttttcttttgttcgttttttattttaactgtcaacttacctatgctgtgtttgaagtgaggttcttgtacgtggcatgtagttgggttatgttttattttatttaaactgccatctctgtcctttacatcaaaggtaaattgatgttcttagaccacgtacctttaaagtaattcttgatgtgttaaagcttaattctgccattttattatttgttttctgtttgtttcctgtttccctgttctagtcttccactggatacttgatcacttttaaaattccatcttgtttaatttatactgtatttgagtatatcacttacatagttcttttggtggttgctctaggtattacagtatatatctataacttagcctattgctatccacatttaagtacttgcagtggagcattgaaaacttactttcatttaggtctttaccctctctaccttttagatataattgtttccaatgtttcctttttcatattgagcattccaacatatgcttttataatttttgcttgagtcatcaaatatgatttcagaaattcataagaaggagattcttacggctttgtggccctagatatactgcctgtagtatactgaccagtggctccagacctcttttctttggtgggagaggg

SEQ ID NO: 22569 - DNA, 1027 bp, Homo sapiens
accaggagtgaatatggcagtgttttcttatttatttagtggtttcttttctcttggatcatttagctttttttttttttttgagactgagtcttgctctgtcgccccggctggaatgcagtagcgtgatctcggctcactgcaagctctacctcctgggttcaagcagttctcctgcctcagcatcccaagtagctgggattacaggcacatgccaccacgcctggtgtgccaccatgcctgactaactgttttgtatttttaatagagacagggtttcaccatgtgggccaggctggtttcgaactcctgacctcaagtgagccgcccaccttggcctcccaaagtgctgggattacagacttgagccactgcacccagcccatttagttttttattaatgatttgagaaagatcttatattttacctgctagttctttgacagttaaatgttttgtaaatatcatcacccattctgtggcttgcgtctttttaacagattttattcataagtgagctgtgaatcacgcttatatttttacgcaactttgttttccatttaattactattacctttttgtccatatatttatcactaatttatattcaaaatctactggaaaataaatctttttccagtatgttctgtcagtttcttgggtttagagacatctcttctatgatcctttttttctctactgactgcttgtaccactattactctagaattctatctttttaaattcactgcccttctgcgttgagttctttgtttcttggattccttgccttcctgtttcttggtttggttcttcttgatattggtggcatgtgagaaaggatgaatgagaattaaattttgtgagttctggtatatttttcaaccactatattgattctttggcagggcatggaattctacattaaaaatatttttcctcagaattttaaaattatgatctctgtcttatagtattgtttagaactccaaagccattttcattcctggtctttggtttataccct

SEQ ID NO: 22570 - DNA, 1040 bp, Homo sapiens
tgcacgtgatccacttgagctttttcagagaaattatgttgtatggctagagaaatctagtttttagatgtttatttgtaaggataatacattttgcaaataatttattatattattcaataaatgcatttaggttttttttgcatgtaccagagttcaagttgattaaattaatagatattatctttgtcttcatgaagcttggctctattgtagcagacagaggttaaacaagcattcaaacaaatatgaaaaatttaactgtagggaatggatacgtaaattacctattatcaaaacaaaacacaaagaaaagaggaaaaaagagctctgagaaatgatagtagagtgtgcataattcagactgaacatgtaggaaatattttaaagatacatcatttagcagagacctaaaccactgccagaaacttgcaaggccaagagtaggggcagtggatatagggggacatttcaggcagatgaaaccatgatggggatgggtcggtacagttttgtgcatttgaagaactatgaagactacatagtagctacagcttattgttgggtggggggtgcagggagggatattaggttgaagagacaggcagatcactgaggaacttttaagagcgagttcattttgagcagaacagttccaggctaaatatcactctgggtgctaagggtgcaaaactggaaatgcaggcaggtagaagaaatgctggtttagtgtccaagcaaaagataattttgatttggattagccagttggagactgaaagaacaatttcaagacatatttagacctgctctaaacaggattgttatgtaagttgtagaaagagattggtgccgaatgttttcactttttgggatttgaggtattcactcagggccttagatagtatctttaaatccattccctttcctagcctctacttttgaggcaaataagtctcccaaaataataagcactgcatagttactttatgcaagtatgtaagtagatttggtgtgatcagaatcattccataatcatc

SEQ ID NO: 22571 - DNA, 1027 bp, Homo sapiens
ttaagcttcgtgattatattatttaaatatcctctgattattttgtttaattctgaaaagtgggcacaaaacgcccagctatattgtttcaaggtcttctgttaatataggggttttactttttatgtttggttgctgtatttttcactgtgatgttgaattccaatttctctaatattgaaaattctgctttggccagtagagctgcactaggtctgttgtgtcagcttgttctaggtatatatccttataaacaccatatagttagtgttttatttttaacccaatttgtttttgtattttaattggagaacaccatatatctataggcaggcttactcaatttctatgaaatcaccttttaaaatatctttttctattaaagagcagaaaagtaactaaaattctcaaactctgttgctctttcctatgtagctactcgtcatggtcatttaatgcatcgtttctcttcatctctctgttccctaaagattgaagttttctaagactcagcctctgacacatttactaattatacttaattgttccttggtgatttcacccccgtgggtttgtttcccttgaactccacactcactacgttcagtagccttctctacactacttgaattatttttatttaggtatataaaatactggtggcaatagcataaattctaagtgttaaacttgatgaagtaatattgtacacctatgtaagcactgcccagactgatatacatttacagcctaaggaggcttctttgtgctgctttgctattaatattccattgcccagaaatagcccctctcctaatttccataaccagagataagcttacatgtttttccacttcatgtaaatggaatcgtacgctgaaccctttttgtgtctggtttcttttgctcaacattatttcatgcaacaataaggatggctctctcagacataatattcatttttatttatgtagtgttttatgggaattgcactgagttagagaaactgaagtctgaaggaatagtt

SEQ ID NO: 22572 - DNA, 1035 bp, Homo sapiens
tctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagtatgatactgtatgttttgcaattcgtagataactgtcagacctacatgaaaggactgttaagaataacaaatgtgttgaaaggtttaaatgtcgggggcgggtggagttcagtgactgtgcaatggtatactggcaaatcaccagcctccgacaaatctaatatgctgaacacaactggtgggaagagtagacaggtacatctcttctgtgcatacagcatgatatgggctaggaactcactgaaaataatttgctctggaattctgtgatgttgaccttgggagaaagaaatgaataattcaagtcatagcagtgattgagaaggaaggtggctcaagtttgagacacaagagagttaagataggatgaaatgtactctatgagaagaatggaactccatgtcaacatataaacagtgagccccagttctatgctttaaggcaacctctgagccctcttttccttgtttattaaaatgggactgacacttaacttatgattgctaaaaagatgaggaataacgtatataaataatctgatataaagtaagcactcagtattggtagctattattatgaaaaaatgtcatagcaaaaacagatattgggcaaataaaatggcttgaagacatcaaaataaagccagctagactatcttaagtattccctccacacaatcattggccaaacttagtctgggtgagtccctaaaaatctcttaaagttgtcctcatttaattactgaatcccctctttcctagaccactacaggaatctcctaatggtttccccagtatgttctagcaccctctaatccattcagcacctggtgtgatatttggtctcac

SEQ ID NO: 22573 - DNA, 1023 bp, Homo sapiens
gtcataaacccaggattcaaatccatacagtctgactctagggcccacactctacgatactgtacagatggaggctcattatgagtgaagaaatacaaaagccaattacccattcatattgtttgtctattttgtaataatagttttttctgtattcgaaattagaatattttaagaatgtctatttcagtattaggacttaggatttatgcagctaccttctcccaatctgtcatttttatgttatttattttttgttgtatagacattgaagtttggatagttacatttagtgtatgataaatatgtatacataatagaattcagtcaaaatatgcaactattaatatttagtagtcttttctcatgagttgccaatgttaatcttttctaagatatctttcctaattaatattagatcatagagataatctctgttcaaagcattgttttccatatttagtctttaatccaactggattataatattgtaattggtttgagataggaatttactgataattctattagtagaattatctttgcatgtagaagaccagttgttccaacaccgtttattaagtagatctttcctttgtgatgccacctttactgtatacatacatgatggtttctaggcttttactttttctgtaatctatttgtctacatttatatcagtactgtactttgtgtgtgtgtgttttacattggtttaattacaattactttatatgggcaatgatttcaccacttctttatgcacacacattattcttagtttttcaaaaatttttcagctactttgggacctctgggcttccatttgaattttagaattagtttatctagttctaggaagaaatcctattggggatttccattgaattgcacaactagttggagaagaattaagcaaaaaatacatatatataaaaaatatataaatatatatatatataaagatatatgtgtgtgtgtgtgtgtatatatatatatatatatatatatattatatatata

SEQ ID NO: 22574 - DNA, 1035 bp, Homo sapiens
acggtgtttattaccgcgtgtttccctgatttcgtactgggttgggtgactgtctgattgtgtgtgactgtggggttgtgtgtgctgttttcatgactgtgtaaagagactaaaattgcagctttgaaagggtgtttttggcggtatgtgtctctgacaaggtgcttggatgtaattatatgccttgtacttaatgggattttgtttgagacaaggtggtctaacaatgtagcataattgggtgattgtgcctctagctgtgtaactgtggaaatgtgattatgtgtgactttatgtggccatttgtatattctgtgaccttatgggggtttagtccagtacagaagtaaatttctttttggtatttctggggttcatttggggctgaggtctgcctatggattgtgagtcccatgtggctctgtgctcctcccatgtggctctgaggacttaaggactttttgatttgaccacagtggctgccctttcatccatggcctgtattgcttcatttctgtatccatcctcggttcaccttgggaaatgtagttacttacgagttcacgacttcttccctgcgtcctcttgccttatagccttaaggggattgggtgcagggaagtggcaagaagtaaggaagtcagacatttggacacctgagtgatgaataggagttatttgcaagttacagacctggtcttaggatgagaattttagggctgataataccttcaagacagccactggatgctgtgcgcggtggctcacatctgtaatcccagcgctttgggaggcagaggcgggtggattacctgaggtcatggtttcaccatgacctctactaaaaatacaaaattagctgggcgtggtggcgcatgcctgtaatcccagctacttaggaggctgaggcaggagaattgcttgaacccgggaggcggaggttgcagtgagccaagatcaagccactgcactccagcctgggcaacaagagtgaaactcattctctaaataaataaataaataggccactggaaa

SEQ ID NO: 22575 - DNA, 1032 bp, Homo sapiens
ctctttcattataccttccttctgggatattttatttatcatgaaatacattagggaaggcttattggttttatttttttcttttcttttcttttcttttttgagatggggtctcattcttgttgcccaggctgtagtgcagtggcgcaatttcggctcactgcaacctccgcttcccaggttcaagcgattctcctacttcagcctccccagtagctgggattacaggcgcccgcagccaagcccagcttattttttaatttttagtagagacggggtttcgccatgttggccaggctggtctcgaactcctgacctcaggtgatccacccacctccacctcccagagtgctgggattacaagtgtgagctaccacccccggcctgtcttattgttaataaatgctctaagtgtttgtttttgtcattgttgcaaaataaccttgtttcactgtcattcttgcctgatgatttaactaggtataaaattctatactgacaattatttttttctcagcactctgaagatattattccactgtcctctggcttctattgttgctcttgagaagtctgccatctgtttcattgttattccttttgtaagtaatctgtattttctctggctgcttttaagatttttttctttaagatttaaatgtaattgattatattgtttcacttctagatgtttgatgttctccccctctcccagatcttttttttttaagctcatccctttctcatggtttttatcttatactttcatatatttccagcacttatgtgtcatacaatcccaatttctgggaaacaggtctaattttgctgtttcttgtatccatggggactcttgtgtaatgatgaattatccatagcactttttttctccttttctttgagagtccaggccaagactgaaaagtcccttgtcattttcctttaaggtttgctggatttgtttttctttctctgaactttatgtcttgaatatttccaattttgtaaagaggtttgtttgtaatccctgct

SEQ ID NO: 22576 - DNA, 1043 bp, Homo sapiens
ttgcaggagggcccaaggcaaagactgggcttcctcaaggtctgctgtgggacagaggttggtgagcccatcgtgaagactccaactcccaaaccatgagatacggatgaatcttactctggatccttgtatgagcggttctgagctggcacccccagctgaggaggctggagctaagccacagagcaactgtgaggttcactaccaggactgttgtcagcaggcataagagactctccacctagacactagtgtgcatgattcctcctggacctttaggcagatggttttgattgcacgcccaaggccaaatggggctgtagccaagccctctggggaatggggccattttcaagctttgaacatgggatcagcatgggagatcagccacctgcgtgccagtctgcactctcaaaatgactttcctaggtcttgggctttactcaagttttacaacctcctacctgaattccaaagcttctgcaaagagacttttatctgtggatgggtgcagaattctcgtgaggggatatgagtgggttacctcctatttctgccatcttgctgacgtcactcccataatctctcataaacactttttaactcctcaatttatggttacctttttctctccagtgctttggatttgtgctaaatctaatttttttctacacgtcactttttttgtattatttatggatattttcaaataattttggtattttgattttgctaattatttctgctgtttctacgtttctaatttactcattttctgattttttatctcacttatattttggtttttagttatgctttttgctcacttcttcttgaggtgaaatcttaattctcttaactatagtatttcttgttttttaataaatgcacttaagactgtaaatttccctgggtacaattttagctgatttcttgggatttcacacaaagtttcttttgctatttggctctaaattgttttaaaattttatttttatttccttctataacaaacatcatatagaattgtcttagtaacttaa

SEQ ID NO: 22577 - DNA, 1048 bp, Homo sapiens
ggtttcattgtgttggcagggctagtcttggactcctggtctcagtgatccgcccgccttggcctcccgtagtgctgggattataggcgggagccaccatgcccagtccatttcccccagtatttgaaatgcacagtttctgctctggttcattggtcagggcaggactttctcgtttgccttaaacctaacagtagtttagaaattggcctgtaactttttttggcatgatttccttctgtttgtgctgatatttttctcacctcaataaggataggagcttcttttcctttttttttttttccaggtagaatcatgttttcttttaattgaatacttaactcacaatgtttcctgttttgcagctgctctgctaataattaggttcccacctctcaagatcattaggagcttcttttccaattcctctgttttgcatgcattggaaggtaagtttccttgtaaaccagattttggactctgcaggctttgccaaatggcctttttaccctcatgtatattgcattttctttggatagtctcatggattctcaaggatattgtattcctgtattttaccattcatgagtttagaagtgtgtttactttcctgagttttcattttctttttcttctgtcatatgtaatttacagagcaaatacctaccagaatggataacttgagagatgtggaaagtgagtttctttgcgcttatctagtgagggtgatttttagtcaataagcatttggtatatgcctgggaatccaacagctgctatttagattcagagccagcctttatttatcagctttctgatgctgaacccatcagtgaacttctctgtatatttgattcatcataaggaaaatggtgacgccgagggtgactgatttccaggtttacatcggttgccccaggggaagtgcctggcccccatctggtccttgctgctctaactttgccctgttaattgaagaaatgcaggtataaacacttcctgggttgttgctggcatttattgtcctcacagtttacagagaagccca

SEQ ID NO: 22578 - DNA, 1089 bp, Homo sapiens
ttaccggtgtgtttttcacgtttataaagctgaatacttctgtatgtcagcttagcacccctagcatcagccatgctactctcctgctgtgcatagatgggggcctgtccccctgctgaatctcctgggttcctgctgtcaacacctgaaggtacccaccagatgtgtctgtcacttccctccatccacctctcttgtgtttctcatgtttctgcctccctagagaccatttctctctagagcagtgctttccaatagaaatacaatgccagacacatacgtcattttagattttctagtagtcactttagaaaagttaaaaagaggctgggcatggtagctcacacctgtaatcccagcactttgggaggctgaggtgggcagattagctgaggtcaggagttcgagaccagcctggccaacatggtgaaaccccgtcactactaaaaatacaaaaattagccgggtatggtagcaggtgcctgggattacagcctcccgagtaggctgagacatgagaatcacttgattctgggaggtggaggctgcagtgagccgaggtcatgtgcaccactgcaatccaaccttggcaacagagcaagactttgtctcacacaaaaaaaagaaaagaaagaaaagttaaaagggagcaggtgaaattaataatgtgttttatttcacctaaaatgttagtattatccagaatatcacttcaacgtcttatcaaaataaaaattattaatgagatagtttgcattcttcctcttttttgagatgggctcttgctttttttttggcccaggctggaatgcagtggcaccagcatagctcactgcagcctcaaactcctgggctcgagatcctcctgcctcagccttcctagtagttaggactacaggcacacaccaccatgcccagctaattgtttttcttttttgtttgtttgtttttcttttttttcttttttcttttttttttttttttgagaggaaatctcactctgtcacccagggtggagtgcaatggcatgatctcagctcattgcaacctccgcctcccaggtttaagtgattttcctgtctcagcctc

SEQ ID NO: 22579 - DNA, 1067 bp, Homo sapiens
gcagtgagaaggggtggaaaagagggattccagagtgccaggcacacaggttttctggaaggtttacatgaggactgctgtggtttgaatgtgttccccgaagttcatgtgttggaaactcaacccctaatgcaacagtgttgaccagtggaacctttaagaggtgattaggtcatgaaggctctgccctcatgaatggatgaagctagagtgggttagttatcttgggagggggttcctgataaaaggatgaggttggcttccttccctttctctttccccctccccccttcacatgtggtcactctcttgcccttccaccttccaccataggacggcacagtgagaccttcaccagatgcaggcccctcactttcccagtgttcagaaccgtaaaccaagtgaactcttgcttataaatcacccagtctgtggtattctgttatagcaacacaaacggactaagagagggacactcagtgggctcttctctctacttgatggagcactccctgcgtggtgccttgtatttgtagacatgatgctgtaaatgttttttgaatgtcttgaaggcttttgtttgaggagtttacagagaagcccctacaggcttcaggtcccttcttctgttgcttctttgctccttagttcctcccctaacctggtgctaaattagatcatagtgtggtccttggaccaacagtatcaatagcacctgaaagtcatgctggaaatacagattcacaggctgctccccagaatactgaagaagaaactctaggagtgagacccaacaatctgtgtttaacaagtccccaggtgagtctgatgcacacagaaatgtgagctgctgtattagatggtgttgagttcatgccaccggatcactgacacacacgtctgctcactgcttgctctttgcacaggcccctggatcctcctggaatccctgatccctgttgctccctggcggagttttctagtccctcttacttgaagcatgtctttcagagcccggcaccacccaagttgggtatctggtgaattctgtggtctgcatgtccatg

SEQ ID NO: 22580 - DNA, 1037 bp, Homo sapiens
ggggaagtgcctggcccttgtctggttgttgctgctctaactttgccctgttaattgaagaaatgcagctgtaaacacttcctggggtgttgctggcatttactgtcctcacagtttacagggaagcccatattttcagcctcttcctctgctttctgccatttctaaaccatctcacccgatctggtgtaatcttcattgtgtgtgagtttgcacagatgtaatttgggcctacatgtgtccaaagcctaatgcccacctcccacctccacgaaaatctggagctcaggacccactaccctcccccacccactgcaagcttgaacatttgatggtggaaaccccgccctgagtttgtattatggtgggttctcttgggtcttgttctctgtgggtctgtcctgcgttatagtgtgtggagccggggggattttcactgtgttcctaaaggagggtcacaaggagttgttgggcaaacggtctgatatttcctttttttttttgaaacagagtctcactctgtttcccaggctggagttctgtggcaccgtgttggctcactgcaacctccgtctcctgggttcaagcaattctcttgcctcagcctccagagtagctgggattacaggtgcccaccaccacgcctggctaattttttaatatttttagtggagacggggtttcatcgtgttggccaggctggtctcgaactcctgacctcaggtgatccgcccgcctaggcctcccagagtgctgggattacaggtgggcacctggccaaggggctgatatttcttaagggctttccccaagaaggaagaagccaaacctactcaggcaaatcttgtttatttattcttctaggtccagatttggaacaagtctctctagagattgaacaggtaaggctcacctttcaatagttacaccaagaaaggcctagctgatgacttaagctatggttttgggctgcacgagagtggtcaggtggacagtagggaagtctacatgtaacccaaacggaaaagagaaaaggc

SEQ ID NO: 22581 - DNA, 1067 bp, Homo sapiens
gctctgttgccaggctggagtgcaaaggcgcaatctcggctcactgcaacctccgcctatcaggttcaagcaattctcctgcctcagcctcccgagtagctgggactacatgcatgccaccacgcccggctaacttttttgtatttttagtgttagccaggatggtctccatctcctgacctcatgatccgcccacctcagcctcccaaagtgctgggattacaggcgtgagccactttacctgatgccctgcttgctatttaaacaaactgtgaaataatttgtctcaatttataaaaataatacagagagtttccatttactcttcaccctgctttccccaatgataatatcttatataaccacagtacatttcaaaaccaggtaactgacattggtacagtactattgagtaaactaaagactttattcagattcagatttcatcagtttttgcatgtactcttttttttaattgttgctctatagtagtatgaaatttcattacataaataagatttatgtagccaccatcaccacaataaagatgtagaactcttctatcactacaaagaaaactctcctgtgctatcttccctccaatcttaacccctggcaactactgatctgttccccatcactataattctttttgcttttttttttttttttttttttgagacagaattttgttcttgtcccccaggctggagtgcagtggtgcaatcccagctcactgcaacctcggcctactggactcaagcgattctcctgcctcagcctcctgagtagctgggactacaggcatgtgccaccatgcctggctaattttgtatttttagtagagacggggtttcaccatgttggccaacctagtctcgaactcctgacctcaggtgatccacccacctcggcctcccaaagtgctgggattacaggcgtgaaccacttgtgcccagcctcaaattttatttctactaaaatatataattattcttatgctacatttcttcatgtgtcagtctttttaaatttgtgtattttaattaatttgtccacttaacctc

SEQ ID NO: 22582 - DNA, 1053 bp, Homo sapiens
gcatatagttgatttttttcttctttatccagtttgccaatctctacgttttgttggagtattgaatgcattagcactcaaatgttattgttgataagtaaggttatttctacttttgccagatttttctttgttttctccaatgtgtttttacttgctctgttttctttagcctacttttgttttaatgttttaataaaatactttttagattcttttttcttttttttttttttttttgagacatagtctcactctgtcaccgagactggagtgcagtggtgagatcttggctcagtcatcctctgcctcctgggttcaagggattctcctgcctcagcttcccgagtagctgggactaggggcgcacgctactacgcccagctaatttttgtattgtcagtagagatgggatttcaccatgttggccaggctggtctcgaactcctgacctcaagtgatctgcctgcctcagcctcccaaagtgttcagattacaggcgtgagccaccgcgcccggctcctttttcgatcttcatgttaatttctctcagctatctagctatgtatctgccttgtgtgtgttcatgacttttccagggcttacaatatgtatttttaacttaaaccaattagagttattatttgtttaaggtaatgtaagaatctcacaagagtatgtttacattcccctcatcttcagtgctgttgtcatatacattatttctgtaaacatcctaaacccaatactacagtgttaaaatttttaagccatcgtatagtaatacgtatttttaaagaaattaaggtaaatgtatgtagaaatatgtgtgtgtgctttatatctgtcacatttcttatgctcttcactccttaatgtagatacaagttgccatctgataccattttccttcatcctgaaagacttcctttaacatttagtacagttacctggcattggattttccattttaatctgaaaagattattttctctccagtttgcgaaaattaactggagatagaatcgctggttaacatatttttctctggca

SEQ ID NO: 22583 - DNA, 1035 bp, Homo sapiens
cctgggttcacgccgttctcctctgcctcagcctctccgagtagctgggactacaggcgcccgccaccacgcccggctaattttttgtatttttagtagagatggggtttcaccgtggtctcgatctcctgacctcgtgatccgcccacctcagcctcccaaagtgctgggattacaagcgtgagccaccgcgcctggcccctctgagatttctttacctcagcaaacacacatctaataagtatccttggtggtggctcaggagatcgagaccatcctggctaacacagtgaaaccccgtctctactaaaaaatacaaaaaaattagccaggcgtggtggccggtgcctgtagtcccagctgctcaggaggctgaggcaggagaatggcgtgaacctgggaggcagagcttgcagtgagccaagattgtgccactgcactccagcctgggcgacagagcgagactccatctataaaaaaaagaaaaaattagcagggtgtgatgatgagagcctgtaatcccagctacttgggaggctgaggcaggagaattgcttgaaccagggaggtggagggtgcagtgagccgagattgtaccactgcactctagcctgagtgacaagagtgacactctgtctcaaaaaaaaaaaagtataaaaagtatcctttcacataggcagcatggcccagtggctgaagcacaaactctggggccacatggtctgggttcacactgtgactctatcctatattagttgtgataccttgggcaaatcatgtgtccttctgagccttagtgtcctgatctgaaaatggggatgataccagtgtcttccttatagggtggttgttgagaggtttcataagattatctatgtcaagccttcagggcagggccagctgtgatcttttttttagagacagggtcactctgttgcccacgctggagtgcagtggcgtcatcatagctcactgtaaccttgaactcctgggctcaagtgatcctcccacctcagactccctagtagctggggc

SEQ ID NO: 22584 - DNA, 1025 bp, Homo sapiens
ttgttttttttgagtcagaggctcgctctgttgcccacgctggagtgcagtggtgtgatctgggctcactgcaacctccgcttcctgggttcaagcgattctcctgcctcagcctcctgagtacctggagttacaggcgcccaccgccactcccagctaatttttgtatttttagtagagatggggtttcaccatcttggccaggctggtctccaactcctcacctcaagtgatccgacggcctcagcctcccaaagtgttgagattacagatgtgagccatgcacccagctggaaatggtgttttaagcacactagccatgtgggctgttaaagtatcatactatagcccatcaactaagacaatgattcttggacctgtaagggccccaggtccctgctccggcatcatgacctgtgtgcactttgatttgctgtagcgtgggcgtattttgaatgaagggtagccctggttagatgtgaggacagtagtgggtgcttttaagactaaaaatattgggtgggcatggtggctcaggcttgtaatcccagcactttgggaggccgaggtgggaggattacttcagaccagaagttcaagaccagtctgggcaacatagaccccaactctgcaaaaaaaaaaaaagtttttgtttttgagacagttctcactctgttgcccaggctggagtatagtggtatgatcacagctcactgcaacctctgcctcctgggttcaaatgactgtcctgccttagcctccacagtagctgggattacaggcgcccaccaccacacccggctaatttttatatttttagtagagatggggttttaccatgttggccaggctggtctcaaactcctgacctcaggtggtcttcccgcctcagcctcccaaagtgctgggattacagacgtgagccaccgcatctgacctcatctctgcaaaaaatttttaaattagccaggcttggtgatgtgcacctataatcccagctactcaggaggctgaggtgagaggat

SEQ ID NO: 22585 - DNA, 1049 bp, Homo sapiens
cccagcactttgggaggatgaggagggcggatcacctgaggtcaggagttcaagaccagactggtcaacatggtgaaatcccatctctactaaaaatagaaaaaattagccaggcatggtggtgggcacctgtaatcccagctacttgggaggctgaggcaggagaatcaaacgaacccaggaggcagaggttgcagtgagccaagatcacaccactgcactccagcctgggcggcagagcgagactcggtctcaaaataaataaataaataaataaataaataaataaataaataaataaacaaactgctgctttggacatgaaacctgttgtgtcgctgactctggccctcattgctgtgtattctggtgggtgctgtgggctctggtggaagcaacagcagagcttagcttgtgaatgtgtcttacccttgctgtgctccaaagacattgccagtggatggggtgtggggaagggacatcacagtggtttcctctgtcaactctatgagagtcgtggttctagactttttggaggtgtcaggtgcaggttgaatcctggccttctacctaaacagggcaggtgctggagattctcagcttgttcctgtccccagatggtgctcaccacacttatctccaactgctggacagtgcctggcatgtgagagatgctcagtaagtatctgttgaattaatgatacgagccagcattcactgagctcttactatgtaggaggcactgttctgactgcttctcagctaatatcttattgaatccttagaaccactccttggggtaggtactgttgttattaccatgtctcgtaagaggaaactgagttacagagaagttcaagtcacagagctggtgagtctcaaattcaggattcctatgcaagtcactggctccagagtctaggctcttaaacactcactgtgtggtctttcgatgaacagacagacgaacagatggggcagacaagcaggaccattctcacttgttccggcctcctcactccacacgtggtctccccctgttttggggg

SEQ ID NO: 22586 - DNA, 1070 bp, Homo sapiens
caggcccccattttccctgtgtgacctcatctgtgacctctcagctgcttgcttgctgtaccccagctgcactggcctcctgctgttcctccctcggagactttgccctggctgttccctctgcctgcaacacttcccctagaattccccagcgccgcctccctccctccttccctcaagtctctgttcagatgtcaccttctccatgaggcctctctccttattaaattgcaccttctccctcaccctcgcccttactctttgctttatttttcttcatagcatttacttccacttgacatattttgtctatgctctgcttcccagctctaggctccatagaagcacaggcacttttgtgtccatccttgtagaaccgttcctggcacgtggtagatgcgggctaaattgtgatatgaatgaatttatatcaggtgcaacatgatccaaggatgggtggccagccccgtttggggtttgaggagggtgtcagcttttccaggaacctgtggctgtgggtgaggcggcatgtgcagatgcctccccctggtcacccagtggctctctggcacctgcctgcagcatccagccctctgccttcctgtcctgcaacccctgcagtctgtgcagcccaggcctggtagtgactcatctgggcagcctgggtgcctgtggcatggaacaggaaagcttggcctagtaagtggagaggatgtcaggttcatttaggtggagaagactgtgtggaagataccacccatatacacacatctcatatgtatctccagcccctgcttgctgttcctgcagggggaggccagggagtgcctgggaagtagcaattaaccagccaggcacagttgagccatctcccctgctttaatgggtaataattcttgctctggggctgaacaagttttaattaaatggtgagcgcgaagaatctgaccgtgtaatagctgacacgtcctcatctattttctagctcccggtgtcagcaattgattctgtaaaaatatcctgggcagggcttccctgagctccatgagtgaggtcagtggccttcttgg

SEQ ID NO: 22587 - DNA, 1025 bp, Homo sapiens
tcaaatgaatgaaagtagagtttaagtctgcagtttttttcctctttggaaaaaaacattcctttcctgcccatgacccagccttgcacactggccgctaaacctggcgtatcgcatcatgtttcaggaggaatttggtcagatctgtgcactttattaggataatggttgacccagtgtgtacctccccaggtaactttggaaagagctggatagagttcatgaccaattcggaacaaagtctgctcttaggaggaattttgctaatagtgggaaatattcaagagggtaatcactgacttagttcaaggtaatttaaggtgaatgcattcctcatgtgtgtgtgtgtgtatgtgtgtgcatgcgtgccaaacttacttgaggtgaaggaggggcgaaagcccttttactcgaatgaaaggaaatcttttgaattgacctatcggttcagaaaatcccttttcaaatcttcccttgagcagctttgcttttgaggcccctgaaagctgggaaagaaggggctgtgaggcctgactgactcctcgctgctggctgtacccccaggcacgtgtgattttgccattgtctgaaatcttgctttccccagaatttgtgccccatgctgagttcctacagctcagccaccaggaattagggcatgggttagccaggattattcaaatttaatctgatcatcgttaaacatttttgcttgcatcctccccaaaagaattttgataagcccctgtatacctccttgtacactgtaaagctaacatctaaaataagcttatggtaactttaaatttgtcttatttgtgggagaagaaaatagtacacattttgaaggtcgaatgtaattgaaatattttatgatgtggttagataaaaaaaagtttttactaccttattgagtaaagtacacagaagctgaaagcaatcatgtaaatttttccctgggaattttttcttggtggatctagaaaaattcagtggtcctgaaaaatgttccctttgaacaaatc

SEQ ID NO: 22588 - DNA, 1026 bp, Homo sapiens
aaatattttttcccagaaaatatttttatttttttagtcatgcctttggaagtataaaagttttgtttttttttttttttgagactgagtctcactcttgtcacccaggttggagcagtggcacaatctcggctcactgcaatctctgcctcccgggttcaagcaattctcctgcctcagcctcctgagtagccgggattacatgcacacgccaccatgcccagctaatttttgtatttttagtagagatggggtttcgccatgttggccaggctggtcttgaactcctgacctcaagtgatccgcccaccttggcctcccaaagtgttgggattacaggtgtgagccaccacgcccaccctaatataaaagtttttaattttggaaattccgtttatcaattagtcttttatggattgtgcttttggtattatatttaagaactctttgacccagtatcatgaagttcttctttcatgttttctcctagaagttgcatacttttaactcttgcctttgaatctatcattaattttgatatcatttttgtgtattacataaggggcctaaatttatctttttgcgtattaatatccaattatcccagctccatttgttgaaaaaaagaccattttcctccactgaattaggtagcactatggtaaaagtcatttgattattaatataagggtttgtttcttctgatctattggtttaaatgtctatcctactgctagtgccacagtcttcattactgtagctttaaagttactttagaaatcgggaagtgttaagtcctcaccttgttttgttttccaaaattgttttggcttgtgtgggtcctttgcatactgacaagttttcagatcaccttgtcaatatctgcacaaaagcctgctgggatttgatagactgtgtgttgactctacatgtcaatatggtgagaattgccatattaatgtttagtcttccagtttgtgtacaaagaatgcttctctgtttatttagattgtctttaatttcttt

SEQ ID NO: 22589 - DNA, 1034 bp, Homo sapiens
tgaatggctctttctccaaaacatccaaatggcctataagcacatgaaaatggctcaatataattatcattagggtaatgctaatcaaaaccacaagattctatttcacaccaactaggatggctagagccaaaatgatgggcaataacaagtgttggccaggatgtggagaaattggaaccctcatacatggctggtgggattgtaaaatggtgtagccattttggaaaacaatttggcagttactcaaaaaaatatatacatagagttaccatatgatccagcaattccactcctaggtatatactcaaatactaatatatgttcacataattacttgtgcatacatgttcagagtagcgttattcgtaaccccagaagtgaaaatgacccgatgtccatcaactgataattggctaaacagaatgcgatatagacccacaatggtatattactctgtcatagaaaggaatgaagtactgatacagactacaacatggatgaaccctgaaacacacatgaatgaaagaaaccagacccaaaagagcacatcttgcttcatcccatttatatgaaatgttcagagtaagcaaatctacagagacagaaaatagattagtgtttgctgagggctggggatgctgtgaacaggaaatggaaagtgattgctaggagtacagagtttattttggagatgataaaaattttctaagctcaggttgtggtgatggtgaattacacacttttaaagggtaaatttcattcattgacgtttgatgtgattgttggtgtgtttggattaacatctgtcatttttgctgttttctgtatgcctcacatcttttttcctccttttattctccctttattgccgtctttctgataagcagatattttctagtgtttcatttttattttgttgggttttaaaaaactttcttttttttttttttttaattgggtctctagggatcacagcatgcgtctaaatttatcacagcctacttcagattaatattaaaacttagttctag

SEQ ID NO: 22590 - DNA, 1034 bp, Homo sapiens
tgtgtgcagcctggcctgtggtggggaggatgtaagaggagaggttatacctcctctttttcaggcagttgtgtttttttttgagatataatttatgtgtgttaaaatttgcccttttttaaaaatttattcctcccccacctcccatgcttttttttgtttgtttgtttgtttgtttgttttttggagaatggggtctcactctgttgcccaggcaggtctcaaactcctgggttcaagtgatcctcctgtctctgcctccctaagtgctgggagtgcaggtgtgagccactgcacctggcatatttgcccttttaaaacatttgatggttttcagtgtattttccaggctctttaatcatcataacaatctatttgcagaacatgatcaccacctcaaaaagaaaccctgaacccattcccgcttccctgattctgccctgtgattttcccatcccttcagcccctggcaccactaatctttctgtctctatgtatttgcctgttctggacatttcatgtaattggaataatgcagtatccatttctgtctggcttctttcactgagtgtcatgttttttgttttttggggttttttttttgcagagacagagtcttgctctgttgcccaggctggagtacagtggcgcgatctcggctcactgctacttcgcttcccaggttcaagcagttctcctgccttagcctcctgagtacctgggattacaggcgtgtgacaccatgcccagctaattccttttgtattttattagagacggggtttcattgtgttgcccaggttggtctcgaactcctgagctcaggcaatccgcccgcctcagcctcccaaagtgctgggattacaggtgtgagccatcacgcccggcctgagtgtcatgtttttaaggttcacccatgttgtgcatgaatcagtacttcattcctttttgggttggataatattctgttgtacagatagaccacattttgcttatccaggcatcacctgatggacctttgggttgtttccacg

SEQ ID NO: 22591 - DNA, 1046 bp, Homo sapiens
gtgagccgagatcgtgccactgcactccagcctgggcaacagagcgagactctgtctcaaaaaaaaaaaaaaaaatttaggtttcactgtctataaatatttattggaacacggcccgcccatttggttgtgtattgtctgtggctgttcttacactgtaatggcagaattgagtggttgcaacagagacaagtgtgacccaccccccaaacctacaatatttgctctttggccctttacagaagaagtttgctgatccctgcactacacactttcctttagtaatgcgtgttagagacagttggctctcagcacttttcttgcgtgctaactgtgctccccaaaagcagagcccagctgcaagccgtgggcatgcccaggttcggctggcggtgggtctgttggtgcctccgcgtgcacactcactctgagcatttcttgggccctggctgcgtggcaggccgctggctgggagccagggcaggtctaggcctgccctcaggaatccacaggccggtgggtggggagagtcagacagtatcgggcagtcctgtggagggatgtattcaggcctgctctcacaggccttccttgaccctctccccatcactcccactttgtttttatttgtggcacttaaataaaaaataggtcatgcatttatatgcttcaaaatcaattctatgtggatgtgtgagcagtctctgtcctccactcctctccctgcccaccttgttccttctccccttacgtaatgatttgtattttcccttgggtatccgtctaaggtatcattatatcaatacaagcaaatatgaatatatatttttgtcttctccttccttcgacaaaaggtagcctactcagtactctgctctgcactttgcaaatgtttactgaacagtatgccctggagatcctcttattttagtgttctggtggaaactgaagggtgggtaggagttaataaggcaaaaaagaaaggtgtatcttagggtgggggaagcatgaggaagagcattctaggcagagggaacagtgtgaac

SEQ ID NO: 22592 - DNA, 1034 bp, Homo sapiens
ccgccatgtaaatggctccagcttttgcaggccacatgcacgtcttcagagctttctccataatggactcttttggaagaccctggcctccaagggctgtatagtggcttatggctctcccagttaatggtgcttatgaatgtggctgtggagggagagaggctggggctggacaacctgggctttcccggtgtgacctgtggcagccagaaagagggacggggtcaagcaggggcatctttgtccacccttagctcctcctggctattcaggacccaccttacaggttcctgtggcctccctgggttgtcttcctggggtcgagggttctctggcaggcataccatggtgcccttgcccctctaccccgacatcccagccaggccatgttgaaattgccttttcatttgttagttgatctatgcaaaatgttgggagggcaggggccttgcatctacttcccttggcccaatcctggctgtgcagtaggttttaaaaacacgtctgaacaaatgaataaataaatgactcatgtgatggaactaacatctaaacagaacttaacttgcagtatcttctgggcaaatgccacatctgggctagagaggcagtggagggtggtggttgaaagccgaccctggagccacgtgctgggagttgaaatccagttctgtcgcttacttgctgggtgacctcggacaagggactgcacctctcaggacctcagttttctcatctgttaagtgggataatagtaggacctgccccacggagcagttgtgaaggttacgtgagttgaaatgttaaagcatctggcacaggcactggcttaagagttagcagctgctcctaggcaccgtgcagtagcgttgaccatgaagagtaaccgagtcttagcctcaggtatgcggagagaccagctcagttccaggggagatgttgttcaccttgtgaacctaagaaacagtggtttcatccaaaaaagattgctcagacctggcatggtggctcacacctgtaatcccagcactctt

SEQ ID NO: 22593 - DNA, 1068 bp, Homo sapiens
ctgtggaggatgagggaaggagggacaggaaggattctcccatgtgtctgcatcattgctggatccctgctgacagacacacaggttgtctcctgtgtctcccaacatgcatgaatgcacatccttgctgggctgtgtctttttttttttttttgagacagggtcttgctctgtcacccaggctggagtgcagtgatgtgatctcggcttgctgcagcctcgaccttcccggctcctggctcaagcaccctcagcctcctggatagctgggaccacaggtgcatgcccccatgtccagctgatattttttttttggtagagatgggggtctcactatgttgcccaggctgatttcgaactcctgacctcaagcgttcctcccacctcagtgtcccaaagccctgggattacaggtgtgagctaccgtgagtcttaagggatgaagggcaagggcatttcaggtggagggaagcatctaagtaaaggctggggccctgttctggtgctgtacagggaacctcccctgctcccagcccagctcaggccagagtgtggggtgaggggcagaactgtctcctgggctgtggaacagcagcatccaacctcaatccactacccgaagcatgtggagttgctgcccattttgagattctttcatgtcctccatcccccgtcttctccagagctgctttctcatctggccaagtccattccccccaccccccatcctctctcctccccaggtgagtccagagtttcagctaatgttgcagcggcagatgcatcacattggatatcctgccattctcgggcccttgctgtctgcatttaggtcagctttgttttcctggggattgaaagcagtggctggtgtggcctttggttctgggccagcctcacaaggaggctggacctgcaggaagtaaacgagaggcctcttgtttgtatgaacttgattcttctaccatctttgtcccctgttcccttctgtgtcttgtttctggccttgttcttgagagtgcaggtcccacaggcagtggccagtgctgcaggcctcctttacccttt

SEQ ID NO: 22594 - DNA, 1025 bp, Homo sapiens
gcacatctccatgcctgagtaatttttctatttttctttaatagagatggggtcttgctgtgttgcccaggctggtctctaactcctgggctcaagcaatctgcctgccttggcctcccaaagtactgggattacaggcgtgagccactgcaccccgcgtatgaatccagtcctttttgtgaggagaggggaaatgcttctctagaattcctgaatgagaaacctttgccctccccaaggttctgaagatacgcacctgtgctgtcttctagacatgttcatatttttcctttttcatttaggtctttgacccatctgacattgatgtctgtatatggaaggagacagagttcaaggctaagctcatactcttcactgttgcatttagtaggcaccattgttggtggttctagagccagacccgctgggttcaaatccctcctggctgtgccgtctacttgctgtgtgatcttgggcaaggtacctctctgtacttgagttttctggtctgttaaaaatggagatcatagtacaacctacttcacaggttattaagaggtttaaatggattggtagttaaagaacagaaaacagagccgggaatggtggcatgcaccagtagtcccagctactcgggaggctgaggcgggaggatcgcttgagctcaggaggtcgaggctgcagtgagctatgattgtgccactgcactccagcctgggtgacagagtgagaccctatctttaagaagaaaaactgtaatcccagcactttgggaggtcgaggcaggcagatcacgaagtcaggagattgagaccatcctggctaacatggtgaaaccccgtctctactaaaaatacacagacacacacaaaaaaatcgggcgtggtggcaggtgcctctagtcccagctactcgggaggctgaggcaggagaattgcctgaacctgggaggcggagcctgcagtgagccgagatggtgccactgcactccagcctgggtgacagagcgagactccatctcaaga

SEQ ID NO: 22595 - DNA, 1004 bp, Homo sapiens
caaggtgggcggatcgcttgaggccaggagtttgagaccagcccagacaacgtgacgaaaccccatctctactaaaaatacaaaaattacctggggtggtggtgtgtacctgtaaacccagctactcgggaggctgaggcagaattgcttgagtctgggaggcagaggttgcagtgagccaagatggcgccactgtactccagcctgggcagtagatcaagactccatctcaaaaaaaaagaaattattctgaggagtctgcaactaattcaccaggttgccagtaggagtccctggcatgagaaaggttaagaacccccttgggcttctccaggaaccccaggggaatgatcattgaagttgtcctgattcctggaccctggggtgttagctagctgcttgctaggcttccttcctgggagattcctggaggagctgaccggcctttgaggttggcggggatatttgggtagcatttggacattatggtattggggaagtggagcagggaggtgttgccagcccactgccttcattgaccattgtgacagagtgtggtctagccaggtggtcagaaacagactctgggaccaggttgctgggttcacatcctggctgtatatagtacactttttttttttttttaaacagggtcttgctatgttgcccaggctggtcttgaacttctgagctcaaatgatcctcccatcttagcctcctgagtagctgggactataggcttagtgggactatagaccactgtgcctagcttagtatacttttgactgactgggcaacctcagctagtgggtcccttatgaattctgtgcctcagtttcctcatctgtaacatgaaagtaataatagtatcttcttcttgggtgatcgggagagtgaaatgagtcagcacttgtctgctaggacagagccggcacattgggagggattgttattagtgaatggccattgcatataggacagctctagaccctctcagctctcat

SEQ ID NO: 22596 - DNA, 1153 bp, Homo sapiens
acaagtcccagggccccacccaaccacaagggagccaagaagtgcaatcccactgaccccaggaaggagggagttcggggcctttggagccacagctcatgactgccatggtctctgcaaggttagaagccacggggtcgcatatccacatttcccctccagaaatcaggaagccaggctgggaccgggtgcgtgttccccctgcgggtcccctgccatcacccgggaaggtattaatagatgggagttggcaggtttttggcttcaaagcggggaacgtgaccaggggtcttccagaggagctgacccaagcagcttctgaggctcgatcctgcctgtggcctgcaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggtaagggcctccacctttcagccaggtggtgggtggcagctcccagatcgctggcatgaggcctccctggcactgtcacttgaggtcccaatagaggggggataggcaggcccttctaggcaggaatagtggcaacagtgacaggacggggagggcacatctacagagcgcttactgtatgccagttattggtttagcccttcatacgtgcatgatcgcatttaatctccacagttgccctgtgaggggagagcctcattcttcccatttcctacatgaagcacaggatgttaatagttgcttgcctgtgggccccccacacttcattcatttgttcaaaatgtgtttattgagcccctactgtgtgcaagctctgttcaaagtgaccacaacaaagtgcctgctcccttgcggtttgtgttctacagggaaagacaggccgtgaagaaataggtgtgtcataccggatcaggtagtactaagtctcagaaggaaattaaagcagggtaatgaaggggctgcagcacgat

SEQ ID NO: 22597 - DNA, 1027 bp, Homo sapiens
gttatggattgaggcgagggtagacttaatagtcttgtttcagagtggaatatggagtgatggtaggcatgagtagtgatgagttgcattgtgctgataggttatgaaatgtaaattttttattttttgatatggagtctctgtcgcccagactctggagtgcagtggtgcgatctcggctcactgcaacctccaccttctgggttcaagcgattctcctgcctcagcctcctgagtaactgggattacaagcatgcaccaccacgcccggctcatttttttgtatttttagtagagacggggtttcaccatgttggccaggctggtgttgaactcctgacctcaggtgatccacctgcctcagcctcccagagtgctggggttacaggcgtgagccaccgtgcccggcctgaaatgtaaacttttatatctaaatattttatatagaaaataccaagattttatatctgaaacaccaagattttatgagcctcataacttaagtaggatttgtaattgtaaatgttctttcctcataaatacctgaggtttttttttgaaaggttctgaattgtctcaataatgaaaacttccagacacccaagcctagaggagatgggtagttggtagctttctgtactggaaacagaaacactcaaatatatagaacctagccagctaaccaaagtaggtagatttatagatcatcttaaaataaggctgattacacagtaaatgtcacctttggaatctggcttggtagaattgaaataggcttcagtacctcctgtcattcagtacctgttttcttgaactcctgacttcaggtgatctgcctcggcctcccagagtgctgggcttacaggcatgagccactgtgcccggcctcagtacctctttttaagatgctctcattcattccctggtgaaaagatgcttgaagtgcaagtgcaagtaggtgtggaaagcatggagggtttgtgttgcttcatttgttttggtatttgttttttccaccagtccctcc

SEQ ID NO: 22598 - DNA, 1025 bp, Homo sapiens
cactacagcctctgcctcccgggctcaagtgattctcctgcctcagcctcccgtgtagctgggactacaggcacccgccatcacacttggctaatttttgtatttttagtagagatagggttttatcacgttggccaggctgatctcgaacttctgacctcaagtgatcctcccacctcagcctccccgaagtcctgggattacaagcatgagccaccacacccagcctatttttctatcaatattaaaaagtaaccagtatccataccctcctaccccagcagtcaaggacttctgcatatttgtactttctatgggtctccaaatctgtccagtcttccccacgccaatggcctgtgtcccctgtatccacttgggggtaggggcggtttctcctcaccgtatctgtttcccaggaagggtgtggggattcagtctgggtccaggcatggcgaagctggcacccagtctcaggctccagggatagcgtgtaggagtgattttcctcggagcctgtttgtgggtggatggaagggatgtgggtctgatgggaaggacctcttcttgaccttggactcaacccctttcccccaggccccttcccagcaccggtgtgctctaggtcttaccacagctggcatggggagctggtgtggatgggacaggagctccggggggtcctgcatcgcccttggcccctggcctcttcttacattctaccttcacctggtctctgcagtgtttgtggcaacacagcccgcactctgggggaaggcagcggcaggggtccgatctgtgtcatccattcttccagcctgcgggccaaggcttccctcccactcactgacaccccactcaccccgacagcggtagccttgcttggtgacaccccagagctgggaagagaaaggagaaaaggttacccatcctaggagagggagggctgtggattggcagggcagctggggagtggaagtgtggaagctacccaggttttgaaattctcaaggctagagatttaactg

SEQ ID NO: 22599 - DNA, 1406 bp, Homo sapiens
gaaaaagagcgaaactccatctcaaaaaaaaaaaagagaaaaaatgtcgcatgtgactcccctgtccccagctgcagctacggtcttgcttccttccccaactcctggatgtttcctcatgctttatctgtctccctttcttctcacctcaacttatgatctggcttcttgtctcgggagaaaatggaagcagccactgtagaaattgcacctgttcctatcccagaccctgacattttatgtgcagctgactgcacacttttttttttaattcttaaacattttattttttattcaagtaagaaattattgattagcttcagttaatcccacaaagaaaatgatcaaatgcttaaaataatagagtttactagttctacaactgttctcactagcaaactagcaaatgagatgtgttggagatcttagacctattccatggaacagatagacaggttttttttgtttgtttgttttgttttgttttgttttgttttgttttgttttgttttttgagacagggtctcactctgtcgcccaggccgcagtgcagtgatgcaaacacagctcactgcagctttgacctcccaggctcaagtgatccccgcacttcagcctcctgagtagctgggactaacaggcccacgccaacacgcctggctaatttttctatttgtagtagaggttggatttcgccatgttgaccaggctggtcttgaacttctggcctcaagtgatcctcctgcctcgcctcccaaagtgctgggattacaggttgagccaccacgcccggccacaaatctggatttctgcccacctcactggctacaccttcccggcatccatgtgggggattccctcccttttgttggagagaacctataccacagacctaacctttgagcagaaatctgaaggaggtgagggtggtagccatggaggagaattccatacacaggccctgaggtaggcgggtgtctggcgggtttggggagcagcagggaagcccctgtggctggagcagggtgagtgagtagcgagtaggtggaggtgagggcacagaggtgacaggcagattctgtgtggcctaatgggctatggtaggaaaattggccttttctctgagtgagacagaagcaaggggaggtggctgaatacacttagccaatatgtgtctgccccctttctcagggctctggtttctgcctgccaggttcaagcctcacctccaggatttttggaaaatcatgtagctgccctggtctcctcatctctaaaatggatataacttacatcacatggctacacttagaagaatggctatagcatgtggggtcagtgctcaaagtggtagctgctttttttttttttctgaaatggagtatggctctgtcgcccaggctaga

SEQ ID NO: 22600 - DNA, 1050 bp, Homo sapiens
aattagctggacatggtggtgggcgcctgttgtcccagctagtggggaggctgaggtgggagaatcgcttgaacctgggtgggagaggttgcattgagccgagatcacgccattgcactccagcctgggcaacagggtgagaccctgtctctaaataataataaaaatgagaaattggccaggtgtagtagcatattcctgggaggctgaggtgggcagattgcttgagcccaggagttcaaggctgcagtgagctatgatgacaccactgtactccagcctgggcaacagagtaagaccccaaccctaaaacaaaaaaaaacagaaaaccacaatgagataccactgcacacccaccatgatggctataatcagaaagtcagataataagtattgactaggatgggagaaatcagaaccctcacattgctggtcaaagtgtaatgtggtgcagcttcttgggaaaacagtctggcagttcctcaaaatttaaacatgttttgtatttttagtagagacggggtttcaccatgtcacccaggctggtcttgtctcagcctcccaaagtgttggaattacaggcatgagccaccacgcccagccaagttcctcaaatttttaaatataagaggtatcatatgactcagcaattttactcctaggtatatgcccaaggcagttgaaaacatgtccacataaaacttgtacatgaatattcacggtggtgctaatatccaaaagatagaagcaacacaaataatgcccatcagccaatgaattgataaataaaatgtggtatatccatacaatggaatgttattcagacaggaacgaagtactggtacatgctacaacatggctgaaccttgaaaacatgctaaggagaagccaaactcaaagatcatataccatatggttccacttatatgaaatgcccagaataggtaaattgcaagagacgaaagaaaggtaggttagtggttgccaggggctgggggctgggtaggagggaagtggggttggagagtaactgtaccagttttgcggtgg

SEQ ID NO: 22601 - DNA, 1043 bp, Homo sapiens
gcccggccctggctgggggcttcttgacctgactctgctgtctctccctcactggccagcacctcccattctactcagacatcgtggaatgaatgcccaccccgtgtttgtatgtatcatctgtgtctgtgtgacattaagcaagtcactgaacctctccctgcctcagtttcctcatcaaatggagatatatcgcatgtgatcatggggttggaggttttaaagagttgctaatgtgtaaatagtaagaactagcaattagccgttatagcataattacctttaatatgtcatgccccccgcacccccgtgctgaatgtaattttgcgggggggcgggttgagacagggtctggctctgtcaccgaggctggagtgcactaacacaatctcagcttactgcaacctctgcctctcaggcacaagctgtcttcccacctcagcctctcgagtagctgggactacaggcgctcagtaccacgcctggctaatttttgtagtttttgtagagatggggttttgccatgttgcctaggctgatctcaaactcctgtgctaaagcaatcctcccgcctcggcctcctaaagtgctgggattacatggtgtgtgccaccatgcctggctggccagaatgtaaatgataactgttttgcttcctcctgtgtccagtacataatagggctccaagtcagtatttgtgaggcaggtgcatgcctcttagttgcggtcctgagggcatggccactgccacgttctggacagtcagagtcgctgctgcccctggaagatgaccgcgatcatgaagcccaggagagctcgatgctttttgcctttccctcctcccacagagggctggcagctctggttcctcccaaatgaaatagaaaccttgagtttgcatttcttctttggcgtgccggcagggcacctctgccttcctcttcctgccagggggaggaagtttctctcaggggctcttcaccctgctttattcctggccatcacacattgacccttgtccccttcggctctttccctgcatg

SEQ ID NO: 22602 - DNA, 1034 bp, Homo sapiens
gtcacccaggctggagtgcaatggcacgaccttggctcactgcaacctctgcctcccaggttcaagcagttctcctgcctcagcctcccaagtagctgggattacaggcgcgcaccaccacgcccagctaatttttgtattttttttagtagagatggggtttcaccatgttggtcaggctgatcttgaactcctgacctcaggtgatccactcacctcagcctcccaaagtgctgggattacaggtgtgaaccagcgtgcctggcctagaattgttttagaatgtccaactgtttgttaccctttctcactccattaaagatctgagtagttcctaaaagaatatgtttgtttctttttcaattttattttctaatttatgtcccaggcccagtgcacatactggcctagccagactgagccaggtgggcttgtcggccttgcccttgaggcacttagtgagcccagaagcagtcaggctctcagcatggagctcagtgaagacagcggcagtggggcatgtgacagcatggaaagggacctttttggcgggggcatgggagtggaggtttcccctcttagacctgagggaaaagactaagagcaaaggcatgggccaggcatggtggctcacccctgtcatcccaccactttgggaggctaaagtgggattgcttgaagttcaggagctcaagaccagcctgggcagtatactgagacccccttctctataaaaacttaaaataaaaatcagccaggctcggaggtaggcacctgtagtcccaactacttgggagactgaggtggaaggatggcttcagcccgggaggttgctatgatcatgccacttcactccagcctgggtgacaaagcgtgaacctgtctttaaaaagaaaagcacaggcaggaacaggaagtaacaagagaacagtacagtgatgcagggacagggagggagcccacgctcccagagttccaggttgggggttctagcaggaatcgtggagaagttgggctggggagcaggggtaacc

SEQ ID NO: 22603 - DNA, 1148 bp, Homo sapiens
caggaggtggaggttgcagtgagccacgatcgtgtcactgcgctccagcctgggcgacagggcaagactctctctcaaaaaataaaaattaaaataaataaataaataaataaataaataaatattcttgaatattattctgggatggagttaaattactcggaagtagtttgagtctttccagttttgcttttatgatttgttaggtgggtgttgagcagtgccccatctacagttaattattccccactattgaggcaagaccttcctgagtatcccacccgatagcctgtgatgatgtttttccagcctggctggtgggaacactcactattcctggccctgtgtgagtaacgagcacttttctgaaatccttttggatggttttcccatccccacagactcacaggcatggctgatccgtattctccggaatacacaagagaacctcctgcagttccccagcaatctctcctttggcaactctgttttgtactctgtcctgtgactctagccacgctggcctccacagactcttcctccatatccatctcctgacctcagacaacctgatgcgctctgcttggattcccctctctgcaccgtggctttgaaactctctcaagacaataagctgtggcagtcaagtgtggggcccacctcgtgtttcctgtctttcaggggtcactgtgattcattgcacgatgtccagtgtcttcaacactgttgcttcatataccgtatttcgtctgactcttgtttgtttgtttgtttgtttcacgtgggagtgaattctggtccatgttacttcattttgggcagaagtggaaatcccactgaataaacattgattccacgaatttgctgatgaaactctgacctctgacctcccagatagctgacagggggttccagaactgtggtcacaaggcctagcatacagtaggcgccccatgtttgttcaatgaaggaatgcaagaggacttgaactttgccctctcaccccggtctttgtccccagggcactgcacttggctgtgattcatcagcatgaacccttcctggattttcttctaggcttctcggccggcactgagtacatggacctgcagaatgacctaggccaggtgagccacgagggatggtgt

SEQ ID NO: 22604 - DNA, 1026 bp, Homo sapiens
actaccagcctttggtgcttctttaaattgctgcttctttgaacacacatatccatctcttcttgtccatctgtttcttcacataggcaccctccccttgaggcaccctcaggaggtcttttcattctgtgtcttactgccaagacccctccacctccattgtacctcttagaacaccactcaccttcaaccttgtagattttaatgtacttgtccactcaccctcactggactaggaactctgaaagtacgggatgtgtcttgttcttctctgaatcccacaaggtgggatctactctttgtaagttattggaaatcactggagaataagcagctcttccttctgcatttggccagaaatctccaagttcctcagatctcactcctcattcaggtttagtacaccttccctgccccctcctctcctctcacctcccttttttttctccacacagcaccctttgcctttactcctgccctacttgctcctgtcttagggactttctttgtgctgtttcctgattctgagctaccccaagtcctttgcctggtgacctgcctcacccgtcctggttggcttctcttagcagcccctctcagctgctaagtctggagcctccacagagctcttggcattttttcaagggattctgtttctagggcccagaaggggaaacagagaccccagggtaaatattggggcctgccttcagggagctcacaataccagtagggggcttgggcatgtacagagcagaaaatgaggtacaaattatatgctgtagaaattcagcagtgagagggagccttttatttggaaagacttcacagaaaaggtggtatttgggctggatagtgttccatgggagttgggacaatgatggtgcccccaggcagaggaaacagcttaagcaatgggtcaaagacaaagcctcctcatctctcacccatggtatctcttctcttcacccaaaagatagagatgaaagaagacagatttcctccatttgcattgtatttgccagc

SEQ ID NO: 22605 - DNA, 1045 bp, Homo sapiens
ctttgaagaaacatctcttgatgatgatatcatagactccttcctactgggcagatgaggcagaatggggcacaggtgagcccagatctgattgatgagaaggaaccaaccttgtgacggtccggggaagagcatttcaggcagagaggtcagcaggtgcaaaagccctgccatatgttcagggaatcgcaaggaccagtgtggctaaagcctaagtgagggagaggggtgagggttggaaaggctgacagaagccagattacttgcagcctaagggccacagtaaggagtttctattttcatttaaggggattgggaaactattagaagggagtttttaaaagcaagacagcgacatgatctgattaatttttttagaaagctcactttggtttctgggaggaaaacagagggtcaggacagaatcaggaaggaaagttaggagacaatccatttgtccagatgagaaatggtgacatgaatgtggtggtggtggtggtagtgaagatgtagagaagcagatatattttgggtgtacagaaaacaggacttgatgatgggattagagaaagagaggaatctagaataatgataatagccaagtcatttatgcctcacaactctatgagagtaggcactattattattttctgtcttccttctcagtaggtactattattacacccacattacagatgacaaaacaggcatggcaaggtgaaatcacttgcccaaaattacacaggtagtaagtggcaggcttatatttccaacccggcagtctggttctagagccacttaggtttggggaaagataagcaaggcatgtgtagctgacattaagaaaaaagaaatatcaagacctaatgactgggtctttgggaaatggaagaagtcaaagatgactcaaaaaaatgtctcagttgtccacagagaggtgatgattgaatctacaggagttaattacatgcctaagtgagagaaaacaagtgtaaagaagggaaaggaagcagagaataaacttttcggggggaaggggtgtcaa

SEQ ID NO: 22606 - DNA, 1061 bp, Homo sapiens
caaactcctgggctcaagcgatctgcccacctcagtctcccgaagtgctgggattacagatgtgagccaccatgcccagctttcttgcattgttaagagcaagcaagagctctgaagccagactgcctggccttgaaaatctcagcttggtgtacagtcttgggcaaagtgacttaacttctctgtgcctcagttgctccatctgtaaaatgataatatattcatatatgtatgttatatatttttgaaatagagttttggggatcaaatgtgcttatctgtggaaagctgttggcaaagggcctgacaatgtatgatgtatgaagacatgctaagcatcatgcttgctattgaaatgaagtatagaggaggaaaaaagcatcatgcgcggtatttttaaatacattgtttcatttaattcttctaacaagcttcattgaggaagaaacagagttacttgtcatagtcaatacagcaagtaagtataacaggagagccaggatttaagccaggtctgactaactccaccatcctgcttctgaatgaagagagctggactccagaggcactgtttatgggcatatgggccttttctcactgtttggggccagagaagaagcccagagggcagtttgtcctggaacatctcagcatttttttgtttttgtttttgtttttgttttgagacaaagtctccagtcccccaggctggagtgcagtggcgcaatctcagctcactgcaacctccacctcccaggttgaagcgattctgctgcctcagcctcctgagtagctgggattacaggcgcctgccaccacgcccagctgattttttgtatttttagtagagacagggtttcaccgtgttggccaggctggtctcgaactcctgacctcaggtgatccgcccgtctcggccccccaaagtgctgggattacaggcgtgagccaccgtgcccagcctttctccaggtgggagtgcagtggcatgatctcagctcactgaagcctcgacctccagaactcaagtgatcctcccaaagtagctgggactgcaggtg

SEQ ID NO: 22607 - DNA, 1073 bp, Homo sapiens
gcatagtccatctcctcctcctggtcccgctttcgtttcttcaacgtctcttctacaggcaggaaataggccacaaactggttcccttcctcatccatcatgcccctggttgggggaaaaggagtagcaatgaagtgtgaggacaagaggcagcaaggagcaggccaaggtggacagcaggaccacctacctaatcatggcctgagacatcatctccaacgcagctgcaccactcgtgtccttgggggctgggtctgagtcaaagatcacctgagcacatggattgatccacatctagggagatggaggcactggggttagatgggaacaggcacaaataggctgtccctttctacctcccaccttgggcctgaccttaaagtctgggaagacaggcatgacctccaccggtgtgactcggggtttgctgtaatgctgtgagatctggtggaacaaaaacaaggtgaggaggagctctgcagccgcacccttgcctctccccatcccagtccctcaattactgatttctgggcatcctcaaaagtcttctcaatggctgtgatctggctatccctgtctttgtatatttcttcctcggtaaactgctgcttcacagaaaccccaatcctaggaatgaagaaaaaggtccttaggggccactggacacacctaatatctccaccttccctctcttcctgttagtaacttacttgacctcaggcttctcattggagatgccataacggttgaactcagtggagatgtactctgtctttcgcatccatggcaccaccttcgcgtgctgctgggatctggggtgggaaatcaggtatctcaggaccccactgccctcctgcttgtagggcccacctgagccagtctccagtacccatttgctacccactcacctcttggagctggtgggggcctgaatctcctcttccaaaagtttctcatcagctggatctagaagaactagaggagagcggggggcaggaggaccatgagggaggcccaggcctgagcctttgctgacctagagcagaccctccctgtctccccacacaccattg

SEQ ID NO: 22608 - DNA, 1058 bp, Homo sapiens
ccacagggtgtgcgccaccacactcagctaatttttgcatttttgtagaaatggggattcgccgtgttgcccaggctagtctcagactccgagctctagtgatccgcctgccttgggcgcccaaagtgctaggactacaggtgtgagccgggcaggagagtaacttcactttggtttcctcctgccttaaatgggcataccacctggcattaggattaatgtgcgtaaagtacttagaactcagcccaggtgagttctccttaactcagcctagaagagatcatccgcccgagggtgagggggctagagccgccctgtgaattgggaaaggaggccccttttcagccttgccaggtatcctggaccccacccaacccactcactcacccacccaaccccagcaagtggggagagggagagcagtccaggtctccttatctgtctgggctgtttaggagtgagaccacacaaggcaggcagttctcagagaattcccctccaaggcctgctggctctttcttggcactttgctctgcagatttctttccgtaagtgcttatttctcacagtctttctcctttttgtccagtttctttttctttttaatttttttaaatagtattttttgtagacatgggatctcactgttgcccaggctgatcttgaactcctgatctcaggtaatccacctgcctcatcctctgaaagtactgggattggccgggcttggtggctcacacctgtaattccagctctttgggaggcggaggtgggaggatcgcttgagccccggagctggagattagcctgggcaacatagggaaaccccgtctttcaaaaaaaaaaaaaaagaagaagaaaaaggaaagaaaaacacaaaaagtgctgggatcacaggtgtgagccactgcgctcagcccctttctgtttctttttgtgatcctcccaaccctcttctccctctgaatctgtctctgggactgtctctgtctccccgtcttccctcccttcctcaccctgtctatctctctctgtatgtctcttggtgtgtgtgtctc

SEQ ID NO: 22609 - DNA, 1050 bp, Homo sapiens
gtccagaggctcggacccgggcgtccggaatttctgcaccgcatcctgagagaccccgaggtccagaccccggcgcccaggctggaggacttgagccatccaggtgcgcagcgccccctcctggagcagccgggagcccggacgtcaccccgcgagaccctggaggccgagcgccccgtatccccgtttcaagaactcaggatccaggaccgcagactccctccagggctccgatcccaagaccccgcgttggaggaacttgagatccggacttctaagcgccccaaccagtttcgggctgcagcggccatcgcttcaaggggacccaggactttgggacccccctgtgctcccacctggagggagtttcattcctgcccctagaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggtgaggggggaggcgaggggcccaggcggactgggggagggggcggcgccactgctgaacaatgagggggcgtgccggcggggggcgagccgaggcgccggcgggagttgggggctggaggggtgtgggaaggcgctggggaggctgtggctgtggggacggcgatcggggttcggagagaccggccggagggggtgcgagggctcggggccagcgccccagcgcgcagccctcggcgggggagggagccgtctgcaggaccctggcatccggtcccccagcctccgccctcccctgggaccccgcggcctcccgcccacggcttttcccagccctgcccctcgccctccgctccagctggagc

SEQ ID NO: 22610 - DNA, 1053 bp, Homo sapiens
tcaggtgatccaccctccttggcctcccaaagtactgggattacaggcgtgagccactgcaccaagcccattatccaccttttaaacttatttttgttttatttgtttgttgaacaaatcagtgtttgcatctactactgtgttccacttacttctcaggtgtctggtaggaaatctttgcatttttggagttgacatttagtaggtagcaatcacaaaccagtaaacagatgacagggtgattatagatcccttgtttgatgcacagaaacttaaattggctgttaaattagttgccaatgcttgtgagggagatttaacataaagattaagatttctttttctggggaaatggaaggagctggcaccctgggacacagagttgttctgcagagcagccgtttgcttgatgagtggctgccctacttatacagctgggaattttctccagttcccaggatatgttagttgccatttgtcctcttgcttgccttgtggcagagtgaagaaaaggaaaagatttcatgtggctgtgttctggaaaacgtttggtagatggagagtgctgtgtgtttcgggtgacttgtcccagtcacttatgttgcctgcttatcctctgtggacatttgattgccaatctttattgtgacctttggagagtgcctggcttccaggcttgcagtgaagagttggagaaattgggatgctgtggtgggagagtgacagggagggccttttctctaagctgtagcactggattcttggtctctgattcatggcttggagacactgcttggtggttaaagtcaggtggaaatgagaccaagatccccagttccatttcctgtctgggacattctcgtttgcactgttactagtctcacttccccaacactacaccatacttgaccccccacccccgccgctggctcctcttcagttaccaggtgaggcaagagggcactgtgaggcctgtccccactgccagggacaggattggatggccttttcagacagccaaatgatgacatggtccttgaaggacagggttct

SEQ ID NO: 22611 - DNA, 1027 bp, Homo sapiens
ccccgcatcccctgtacaccccaactcccaccgtcctcaccttgcttctttctgtccttcccagagagaccagctccctgctttttccttttaggcccatgagtggggggtggggccctggggtggggatgttgtggggagaggactctgggatcccagggcccagtgaatcccttctggggttgtagggtgggcgagctctgtcccaagataccccccacttcctgggccagtgcccccctttccccgttattttccgttctgtgcgcctcatacatttcggcttctccccaaccacctggtgcctggcctttacttttggttttcaacctttctgtgtccctcccttcccctcccccaacccattggttgattttgctgctataatttggctcatactttgtctgccctcgcccaccaccaccaccaccaccaccaccaccaccaccaccaccacctcctcttcctccaagtagaagagattgaaggtaagaatatgaaaagtgtgattccctgaccttcctcccatatcctgacatttcctccttcctgaggcacctgccctcaccggtagcctccccaccagccccggtctggccctgagggctctgacccatgtaggatccagagtcagggagttctggggccaggtataccccagttgttgacctgggaaagcacggatgtgtctgtctgggactgagcatttgtgggtggtagcgatgtgtggggtggggtgcagtccagggtgtgcctggactttgagatgggaacagctggaagccccccaacttgctgggccccatccccagtctttttgacaagaagcaggatgctgagtaggacagagtaggggatgaggggttgggatttcctctgtgagatgtcatcttcctgccccagggccaaaccctggccctcttagctgcacgctcctattttctccaggcccctgccctccacctgcccttgctcacgccctctgcccattatttttcagcctccaatatcgataatgttgtcctgg

SEQ ID NO: 22612 - DNA, 1787 bp, Homo sapiens
gtggaccagactgaacctctgcactctagatttttttttttttgaagcctctacaaaggataattaaaatttacaccatgactctttgtcctggggtgcactgtctgtaagccggtggagttatttcccaaaatccttggtccttcccagcttgaggaagtctgcaggactgagggaggggacctgtgcttttttttttgtttttttgagatggagtctctgttgcccaggctggagtgcagtggggcgatctcggctcactgcaccctgcacctcctgggttcaagtgattctcctgcctcaggctcccaagtagctgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaatttccttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaagcctgtttggtggtctcttcacacggacgcgcatgaaagccaccacactcagttaatttttgtatttttagtagagacagtttcaccatgttggccaggctggtctcgaactcctgacctgaggcgatctgcccgcctcagacttccaaagtatggggattacaggtgtgagccactgtgcccggcctaatttttgtatttttagtagagatggggtttcaccccgttggtcaggctggtcttgaacttctgacctcatgatccacctgcctcggcctcccaaagtgctgggattacaggcgtgagccaccgcgcctggctttttgttttgttttgagacagtgtctcactcttgctcacactggagtgcagtggcgctgtcaccactcactgcagcctcgacctcctgggccctcgtgatcctcccacctcagcctcccaagtaactgagactacaggcacatgccaacatgccaagctaattttttgcattttttttttttaagagagatgaggtttcaggccgggcacggtggctcacagctgtcatcccagcactttgggaggccaaggtgggcgaatcacgaggccaggagttcaagaccagcctggccaacttggtgaaaccccgcctctactaaaaataccaaagagtggctgggcgtagtggtgggcgcctgtaatcccagtcactcggaggctgaggcaggagaatcgcttgaacccaggaggcggaggttgcagtgagccgagatcgcaacactgcactccagcccaggtgacagagtgagactctgtctcaaaaaaaccaaaaaaccaaagctctgctgtcatgagctgatgttcagtgttctcatggaggagacaaacaatgatcagataacttcctagggtaataaatgcataaagaaaaagtatagcaaggagcagcagtgatctggggactcagaggactggtttagacctgatgggatggtcgggaggcctcttgggaaggcgcatctgagcagagatgggatgaagtgaggagggaagccctgggatagctgagtgtgcctgaggcaca

SEQ ID NO: 22613 - DNA, 1026 bp, Homo sapiens
ttaagttagagagaaaaaggggaccccgtgcagcgatgacagagctgggaaacagcgcgggcaggtgggtccccggctcccggactgcgccctctgatgctcccttccccacaggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgaggtgaggggctgcgccacagacgaacgccttgcgctgctggctgcttttacccatctccgtggtgcagttggcccgattccttgatgcatttccctggtcggtctctcttaccccggtagctggttttgggttcccctttgtgatgggtaggggaaaacaagatctgagaatttaaagagtctgagtttttcttctttctctcctcccacagctcgtccgtagattggaatcgccctgaagatgtagaccctcaagggatttatgtcatatctgctccttccatctacgctcgggaggtagcgacgccccttttccccccgctacacactggg

SEQ ID NO: 22614 - DNA, 1059 bp, Homo sapiens
taacataagatctgtttgaggggcaagttgacataaagagcttgtttaggtggccaaaaggtttccaggatctatttagagggtcttaagatatcaggggtctgttaggggctaagtgacatcagggtgaagtggggaggggaacaaacattagtgaagttgggaagctttcatgagaggactgtcttcttccaatgtgagttatcccctttcgtctaggatgagatcccagcactgtccgtgtcccggccccagaccggcctgtccttcctgggccctgagcctgaggacctggaggacctgtacagccgctacaaggtacattcgacccccaacccagaccttgcacaggacctgacatctcatactcttccccactttccaccactctctggatcagcaagtctggagccatccccttctgtcccctctctgctcgcagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggtgtgctaaggacacctcattcattcatctgtccacttaacaactatttcctaccatgtgctaggcagcagcaaacaaggcagggcagtgcagtgcaatgttcttcagagtattttgactgatcgaaaggtagaaatacatacatatatatatatatacacatatatatatgtatatctatgttttttttgtttgtttgttttttgttttgagacagagttttgctcttgtccaggctggagtgcaatggcatgatctcggctcactgcaacctccacctcccaggttcacacgattctcctgtctcagcctcccaagtagctgggattacaggcatggaccaccaagtctggctaatttttgtattattagtagagacagggtttcaccatgttggccagtctggtcttgaactcctgacctcaggcga

SEQ ID NO: 22615 - DNA, 1053 bp, Homo sapiens
acgtgtgcatgttactggctgtgctgacttcacctccttgggcctctcctagtagttgaagactcatttcacccggtgatagtgagcagttaatgaaataatgcagtgttttcctacaatgggttgtgacctattagtaattatgaatttcaatttgtgggttgcagccagtattttgaaacatgaaatagaacagaaagcgccagagaacatccacatggtatttataccatggtacaagtatatatggtgcaagttcatctgtttcgtgaaacttgtttcatacagatgtgcacactcatgtatacttgtggttcttcaaaaatatatatatatattttaattcttaaatttttttgtagagatagggtctcactctgttgcccaggctggtcttgaactcctgggctcaagggatcctcccacagtgctgggattacaggcgtgagccatgtgcctggccccaaaaatgtatttcttattgtaggtgccagacaaaaatgtctgaaagtcactcactctataacttttttttttttaaagccctaaaatcttaagcatatgttcagatcttaacacatgtgagccagggagcagtaggaggtagtagttaagcagtatgttttctggggctagactgcctggctttgaaatcttactcccccagcaacttcttatgtgatcctgggtaaattaacctctctgtgactcagtttcctcacctgtcagatggaaacaatcatagtacctatttttctagggtgggtgttcagaagagcaaattgatacaaagcatctggaatgggcaataaatgttagctgttgtcattgttactcatttgcttggtactttattgaacttttactctgtaccaagccttgtgctggaatgcaaagatgacaatcagagatgtcccttgccttgactgggaaaaaagaaaaagacacctagaactcagtcattcagtgactgtttattgaacacccactatgtgccaggatgtgttgtagatgctagagacatgggccaggcgcggtggctcacgcctgtaa

SEQ ID NO: 22616 - DNA, 1050 bp, Homo sapiens
ccatctgtcaggaggtaagtggtggtttctctctggatccaggcagcgggtgtgtgaggacccttcttctctgaaccactctgctgcagtcctgtcccctcatggctgccctgggtcgtgggcgccatctctctcttcctctaccatcactaggggtggatagtacaggggtagtgtttttgtgttttgctttgagacagggactcactctgtcgcccaggctggagtgcagtggggcaatcatgactcactgcagtgatcctcccacctcagcctcccaagtagctgggattacaggcgcccaccaccagtctggctaatttttgtattttttgtagagacagggtttcaccatgttgcccaggctggtctcgaactcttgggctcaagtgatctgtatacctcagcctcccaaagtgtcgggattacaggtgtgagccactgtgccctgccacaggaagtagattttaactctcatccttcaacagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccatttaatttcttcttagaagtttaactcctttggagaatgtgggccttgaataggatcctctgggtccctcttaatctgacagatgagcagacgaggtgcatggcctgggttgcagcttgagagaaccaaaatattcaaaccagatgacttccaaaatgtggggaaagggatggaaaatgaacctgagatggagtccttaatcacgggataaagccctgtgcatctccctcatttcctacaggtaaaagacagtaaagaaattcaggtcacaggccttgggagttcataggaaggagatgtccagtgctgtcc

SEQ ID NO: 22617 - DNA, 1013 bp, Homo sapiens
cctccctaagttgttgggattacaggcgtgagccactgtgcctggtcaagaaatggaactcttacacactgctggtgggaatgtgaaatggtaagccacttcggaaaacagtttgacaatttcttatgctaaaaatacacctatcagatgatttagccacttctaggtatttacttaagaaaaaataaggcatacatccatatgaagacttgtaaataaatgttctcattatttttatttgaaatagctaaaactggaaacaacccaaatatccatcagcaagtgaatggataaacaaattgtaatatttgtatgcaatataacaccactcagtaatatgaaaatgaactactgatgtatgcaaaaacgtgaaattcaaaataattatgctgagtgacagaatccagacaacaaataatacataatgtattattctatttacataaagttttagaaaatccaaactaatctaagtaacaaagcataccaatggtatatggggcttggggcaggtgagacggattatagagaaaaaagtaggaggtgatagacatgtttagtttttttgcttgtttgtttttactgtggtaatggtttttcaagtgtgtatgtcaaaacttatcaaattgtacctaatttattgtagttttattgatacctcaataaaattaatagttacatacataaatgtacttgaagttccacctagcacaataaggtaagaaaaaaaattaaggcgtgggactggaaaagaaatgaaactcttcattattcacaaatgtcatgattgcatatatggaaaatctaagtctacacaaaacctattaaaattaaatagtgaatttagcaatgtggctaaacaaaggtcaatataaaatattaaatataagccaggcatggtgacatgcatccacagtcccagctactcaggaggctgaggcaggagaattgcttgagcccgggagttcaagtccagcctgggcaacacagcaagacccactgtctctgaaaaa

SEQ ID NO: 22618 - DNA, 1032 bp, Homo sapiens
cagtgacgcacgctctggtaccatggagccactgagagcactgtcgtgggcagcaggcagacctgagtccaagtgtggctccaccactcactagctgtgtgaccttgggcaagccccttacctctctgagcgtgtacctgctcatcagctaaagcaggggtcataccaaatccttctgccttacagggctgttgtgaggattaccgagtgcctagcacagtgcctggcctgcagtaagtgctttataaatgttaaataatgttaactggtttttagaggtaagtgctgagtgttttggggaaacgtagaggaggggcctctaacctagctttggaggctgtggaatcaaggaaggcttcctgacagagggggcaacctgtgttgagacttgagggacaaatagttacacaagggaagagtgttctccacaaagggaacagcatgtgtgaaggccagaggttagaaagcacagggcctgctcagtattcagtgtggctgcaagatgaagttggggttagaatgggctgagagtgtttggaagtgaggctgcaggggtcatcaaaggccagggccaagaaggatggatttaggtgggatgcagtggctcatgcctgtaatcccagcactttgggaagcccaggcaggaggatcacttgagcccaggagtttgagaccagcctgggcaacatagtgagacctccatctctacaaaaataaaaataagaaagatggatttggccagtaggaacacgggacctgaagattttcaggcaggggagagggaagacaggccgagcaaaggagagacatcagagagccaaacccaccccatctattggagaacaaggccatggaggtcaaagcaagttcttgtgacctcattggccgggggtggctgttggggtgagggcagccctgcatgggaccaagggcagggctgggtataggtgaggattggggtgggctgcgacatcacccctccctctcccctgcctgcagcttcggggtgctgctgtgggagctgctgacggg

SEQ ID NO: 22619 - DNA, 1032 bp, Homo sapiens
ggactctaaacagcctccccatggttggctccatcccccacatcccagcccttgtttgggccaggcccagagctctcaggacaacctgttaggattccttggccctgggattccaccttgatcctgattccactaccagcccctcctcggggtgcaggtcccagggtttctctcccagcgtttcactgagtggaattggccaggagcttggctttgaatcccttcccctcagctccatagcagctgtttgtctgccatccccagaaattctgccttcctctgagcaggctgagtccccagagcatgaccactgacacctccatgccccaccactgtccttcctcctcccaccccagaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggtgaaggcagggggcaaggtgggaaagatggagcaagacccctgagttctgatgccttgggctgctcagagactcctcccctgaaccccagcctttgggtccatgcagggtcaagggagccttttttgcatattaagaaaagacagcctcctgttggtggattaataagaaaaaggcaccctgtactgaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaagaaagaaaaagaaagaaaaagcacccctttctttgagctaacacagttccctgccctggcacccagcttggctagcaaagcatgagtcgggtggtgaaaccagtgtac

SEQ ID NO: 22620 - DNA, 1039 bp, Homo sapiens
ggctaagacgggcagatcacctgaggtcaggagtttgagaccagcctgaccaacatggagaaaccccatctctactaaaactacaaaattagccgggcgtggtggcgcatgcctgtaatcccagctactcaggaggctgaggcaggagaatcgcttgaacctgggaggcagaggttgcagtgagccgagatcgcgccattgtactccagcctgggcgacaagagcaaaactccatctcaaaaaatatatatattttttaatttagcccaatatatccatgcaatcaatacaaaataattgtgagatattttaccttcttttttcacactaaatctttgaaatccagatgtattttatatttatggcacatctaaatttggacagtaaattttcattaaaaatttttttttttctgagatggggtcttgctatattgcccagggtggtcttgaactcctgcgctcaggcagcgctcccactttggcctcccaaagtgctgggattacaggtgtgagctactgtacctgacccatcaaaaatattggatctgtatttagatttcataaaagttagagttgaaaaagtacatatacatacccaagttgctccaaacatgcttaaatgtttccaataaccaaatggagtacctgttttttgttgtttgtttttttgtttttgtttttgttttttttgagatggagcctcgctctgtcacccaggctggagtgcagtggcatgatctcggctcactgcaagctctgcctcccaggttcatgccattctcctgcctcagcctcctgaatagctgggactacaggcacccgccaccacgcctggctctttctttcttttttttttttttttttttttttgtatttttagtagagacagggtttcaccgtgttagccaggatggtctcaatctcctgacctcgtgatccgcctgcctcggcctcccaaagtgctgggattacagacatgagccaccgcgcccagcccccatacctgtttttaaaatttaaactcaaattgcggtaat

SEQ ID NO: 22621 - DNA, 1111 bp, Homo sapiens
tccagctactcaggaggctgaggcgagaggatcacttgagcccaggagttccaggctgcagtgagatgtgttcccaccactgcattccagcctgggcaacaaagcgaggagaccctgtctcaaaaaaaatcaaaaatgaatgcaagaagccccattgtctcactccacaccctgcacttttgcaggctcacgcctccctcaagctgcagggtccctcgcctgatgtgatgaagggagattttgcattgttttgttcatgaattagttcaaccatgtactgccctggaatacaactgagctctgggttcaaattcctagctgatccctataatcccagcactttgggaggctgaggtgggcagatcactcgaggtcaggagttcgagaccagcctggccaatatggtgaaacactgtctttacaaaaaatacaaaaattagccaggtgtggtggcgggcacctgtcatcccacctactcaggaggttgagacatgagaatcacttgaacctggaagatggaggttgctttgagccgagatcctgccactgcactccagtcttggtgacagagtgagacaccatctcaaaaaacaaacaaatttccaactgacaaaccaatgctgtgcaacctaagcaggtaatttccctgagccctgccacctcatctgaaaaacagagatggtaacactgctttgccctaaacttaccatgttattatttttcttttcttttcttttcttttttttttatttgagatggagtcttgctctgtcacccaggctggagtgcagtggtgtgatctcagctcacttcaagctctgcctcccaggttcacaccatcctcctgcctcagcctcccgagtagctgggactacaggtacccgccaccacgcctggctaattttttgtatttttagtagagatggggtttcactgtgttaaccaggatggtctcaatctcctgacctcatgatccgcccgccttggcctcccaaagtgctgggattacaggcgtgagccaccacacctggccctaccatgttattatttttctttctttatttttttgagacagggtcttgctctctcacccaggctggagtgcagtggt

SEQ ID NO: 22622 - DNA, 1049 bp, Homo sapiens
gttcaacagctcttcttgaaatggggacctggggcaggaagatggtaaggacagttggggacatagtaggtgtgggagtctggggacaccttgaaggaggtatctggggggccctggaacctctagagctggagtcaggggaaaggaggaaacaagacagagctttgggttgagaaagagggaattgaagctgtaatgatgggggaaggtccacaggggcctgtccatgtagggctctgtaggacatggtaagaagtttgtcctttgtcctgggggcaatggggagccacagaaggattttgagcaggagtgagacagcttagggtttttaagttccagttcagaagtgtttatcattcatgatgctttttggacctatttaattgtttttcagactgactgacttctctccctaggaggggcacttattttaaagggtccgttgaaataaaagatctaactgctgaaaatgaaaaatcagtttgcaaaaccagtgttctgttccgttttctgtagacaattgatggttcagtccaaagaggtcagaaacaattgatggtttagtccaaagaggtctgtaccatctagtgaaaatcagcaccattaaacatgagaacatttctgttttaaaccatttggaagccccgtgaattttattttattttgttatttttaaaattagagacaggggtctcgctctgttgcccaggctagtctcgaactgctgggctcaagcgatcctcccacttcagcctaccaaagtgctggaattacagatgtgagctactgctcctggccagcctgtggatttgtaaatgtctcctgtggtgtgatctgcctcatgtttcctgtatgtaggcttcagaagcacactctgcattctcagatggcttgaatcagccttgactttttccccaccctctcagcctgaatctcaggttgagatgccattatctgcacccaccctatatgctctgggcttagaactgataccagctggttatcattgtgtataaaagtgtcactaggtatagagagacatctaaaat

SEQ ID NO: 22623 - DNA, 1021 bp, Homo sapiens
ttgttaaaacccagattcctggaccccaccccagcactctgattcagtaggccatgtgcagtgaggcccaggaatttgcatttctaacaagttcccaggtgatgctgttgccgctggatcagggaccttacgttgagaagcactgggttagagcataaattctggaaccagacagcctgggttcgaatcctggctccatttatctgctgtgtgactttaagtaagtcacttaccctctctgagcctcagtttcctcacatgtgaaatggatgtggtgattgaccctcttcttcatggaggctgaggatttggtgagatccacagtacctggcttgtggtgagctgtccgtatgtggggtccgttgtgacgatgaccctggcagggcacatgtcttaactgtcccctcgccctcagagtgcgcccccacccctgtgtccaagtggccgcactccagacctgaaggctctactcaacgtggtggacaatgcccggagtttcatctacgtcgctgtcatgaactacctgcccactctggagttctcccaccctcacaggtactgctgggtgtggagatagggagccgctgcagttggccaggagacgggagagggaatcatggagaccagaaagctggtgggggctccaggcaaggggacagatggaagagaagctgcagggagagacagtcaccaggaggtgaccggaagaaggtatctaggcacttgagacaggagaaagagagattacagaggagacagggatgaggtttcaggacaaggtttgagggaacagagaaaaggatgagagggccgggcgtggtggctcacgcctgtaatcccaacattttgcggggctgaggtgggtggatcacttgaggtcaggagttcaagaccagcctggctaacatggtgaaatcccatctctcctaaaaatacaaaaattagccgggcgtggtggcacgtgcttgtaatcccagctacttgagaggctgaggcaggagaattgcttgaacctgggagg

SEQ ID NO: 22624 - DNA, 1060 bp, Homo sapiens
agatgctctgaatccatccatcattcagtcaacaaatcactacattcactaggctacagctctgggctccaccctttgctgggcagtgtttgggatagggtgtgacagacccaggtcctgcccttaaggagctctcagtccagtgggggagacaggacaaggcaatgacaacacagagtagtcagggctaggatggggaagcagagaagcctgagagggtcgaggaggagcctgctccagccttggggtgtcagggaaggctgcctggaggaggagccacgtgacccggcatctgatgaagtcacaccaaggacagggtaggtagcccgcaccatcctctcttgggcgccccttggcttgtgaccaatcctggatgctccccttctcctggctcaggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgg

SEQ ID NO: 22625 - DNA, 1072 bp, Homo sapiens
ccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaat

SEQ ID NO: 22626 - DNA, 1030 bp, Homo sapiens
actctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaa

SEQ ID NO: 22627 - DNA, 1031 bp, Homo sapiens
ggcgggaacccaaatatcgttttgattggcaacagctgagcccagaaacgagacttgctctgattggtcaagctactgcgtttccgcgcggcgattggctggcagaaaggcagaggcggggccaggagagaaagctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatggtgagttctcgggatagtccggagtccagactgtcccgcacgggctggcccctcttccgtcccctgcacccgcctctctttctaagtgtttgtccagccaaacttcgagttaactccttggcctttacacaaactacttcctgtcttcaacactccattagttcatcttacactctgccctttaacgtggtcactgctgctcatcttacaaggtttgaggtcacaggacccttcctccaggaagccttgccttgtcccttcacgtggctgccgctgacttgccgtacgc

SEQ ID NO: 22628 - DNA, 1066 bp, Homo sapiens
agagattggattggaatccatcttttttccctgtatctttctctccctgtgggtatccctgattttggctccatctggtcagacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagccggtggggagggcagggctggccataggtacaagtccagtgctggctttttggtccttgctttgtcgtatgtcctttactaggttctccttgacctcaagtcactccagcaaggagaatgggtttgtagagactgagagggccttggaggatgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtaggtgggctgggctcccaagggtgatggggagagagagtgagaaggaaagagagagatgtgtgtgtagagtcacttggagacactgagagggcagacaaggcagacagagagagatgagacaccgtagttagcaggtatatatatccaaggagagagggagtactggagagataaagagatggtggaagaaaaagaggtaggggccaggcgcaatggctcatgccggtaatccccgtgctttgggaggccatggtgggaagattgcctgagcccaggagtttgagaccagcctgggcaacatagtgagaccccatctcaaagaaagaaaaagagatagagaaaagtggcttgggggtggggaaagggatggagactgagagacaccgaaacagaaagagaaggggaaacttgagagactcacactcagaaaggaaaagagcaagagagacagagactaagagagttgaagagaatgataagggaggtaaggaggcctggca

SEQ ID NO: 22629 - DNA, 1050 bp, Homo sapiens
aaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctt

SEQ ID NO: 22630 - DNA, 1106 bp, Homo sapiens
accgtgagcgactcagcacaaacgtggggtcaaagggctcgcctgagggtgaagaatggaatgggtcaggaagacgcgatgtgcagcacaccagacctcatgcagcaacaccattaatttgcacaacatccgactcaaccatggcaacgtgtcttacggtgcaaacacgggcacatggtcacaacatgctgcttaacaacaccccaaaagcatctgtcaatgccacagacagcaccgaacccacagcttcctgcagcacatcgacagcaacaacgcccaaccacagaacaggttggcaacacacacacagcacgcgacatagcacaaggcaatcatcaggcatcacggaacacaacaacacagggcaacagaacacccagcaaatacgatcacagtacatgccaacacacgacacgcagtgacctaatagccagcccggaaacatcccaagacacggtaaccacacaccaacacgtaatgccagcataccgctacataatcctgccacacaacacacgctagtacacagcaacccagcagacagcacagaacacacgatgtggcatcacaacacatacagtcaaggcagcagaacaaaggacacactatgcagcaacgcaacaacgttggcagccagcagatgacacaatgcaaaatcacatgcagtgcctgacaactctacaatctcacccagaaatatctcaacacaacacgtagcatctggccgtccaacagctgaacagaccatagtaaatactgaacaacacatttctttctttccttttttcgagatgaaatctcgctccgtcgcccatgctggagtgcggtggcacgatctcagttcactgcaacgtctgcctcccaggttcaagagattctcctgcctcagcctcccaatgagctgagatcacacccggctaatttttttgtatttttagtagagatggggattcaccatgttgtccagactggtctcgaactcctgacctcaagtgatgtgcccaccttggcttcccaaagtgctaagattataggcatgagccaccgcgcctggtctagtttttgtattttttgtagatacagggtttcaccatgtcgcccaggcc

SEQ ID NO: 22631 - DNA, 1106 bp, Homo sapiens; identical to SEQ ID NO: 22630

SEQ ID NO: 22632 - DNA, 1061 bp, Homo sapiens
tcgcccctttattcctttgtgcgaagccccttcatccatcttcaaagcacatcactccagtctctgcttccatcctcacattgtctctctctggctcttcctgcactcctctttttttaaaattaatattgccacattattttaaattatgtacaaagacctaacatgtcactcagggaccatttcacccactgctctatttagccgccagtctcttcagcaatggtgagggtttggtgtacacattatttcatcacccaggtaataagcatagcacccgacaggtagtttttcggtcctcaccctcctcccatcttaccctcaagtaggccctgctgtttgttgttcccttttttgtgtcaatgtgtagtcaatgttcagctcccacctataagtgagaacctgtggtgtctggttttctgtccctgcattagttcacttaggatagtggcttccagctccatctatgttgctgcaaaagacattatcttgttcctttttatggctgtgtagtattccatggtgtatatataccacattttctgtctttctccttccttccttccttccttcattccttctctctctctctctttctttctttcagacagagtcttgctctgttgcccaggctggaatgcagtggtgtgatctcatctcactgcaacttctgcctcctgggttcaagtgacttctcctgcctgagcctcccaagtagctgggaatacaggtgcccgctactatgcctggctaatttttttgtatttttagtagagacggggtttcaccatgttggacaggcttggtctcgaactaccgacctcacgtaatccacccaccttggcctcccaaagtgctgggattacaggcgtgagtcaccacgcccagcccacattttctttatccagtctaccactgatgggcatttaggttgattccacatctttgctattgtgaacagtgctgctgtgaacaaaggtgtgcacgtgtcttcatggtagaacgattgatattcctttgtgtatatactcaataatgagattgctgggtcggatggtagt

SEQ ID NO: 22633 - DNA, 1061 bp, Homo sapiens; identical to SEQ ID NO: 22632

SEQ ID NO: 22634 - DNA, 1033 bp, Homo sapiens
agagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaa

SEQ ID NO: 22635 - DNA, 1050 bp, Homo sapiens
tttgaattgtcttttgtctctgtgtcctccttgacatttatctttgactcactgaatctctctctctctcatctcaattttgttttgtttgctttgttttgtttttgagacagtctcgctcttgttgcccaggctggagtgcagtggtgcgatcttggctcactgcaacctccacctcccgggttcaagcagttctcctgcctcagcctcctgagtagctgggattacaggcgcccgccaccatgactggctaattgtgtgtgtgtgtgtgtgtgtgtgtgtgtgtgtgtgcatgtatttttagtagagacagggtttcaccatgttggccaggctgatctcgaactcttgacctcaggtgatccacctgctttggcctcccaaagtgctgggattacaggtgtgagtcactgtgcctgtcctcatctctattttgatctcactctggttctgtttctatgcacctcgattttgtctcaatcttgatttctgtctccatcacataatacctggcataatctgccatgctctgaatttctctgcctcaagtcctctgcaattatttttcctctttagcttgcttctactttttagttcaagttcctccactcctggcttcctatctggaggtggaatggtgaagggagctgttctaagagtatttgctctctcccttcccgtctgagtaggaaaaccagactcaccatcaccacacacatgccaccaccctgaatgggtgttaaatgctggggtgtgaggatcagaatgggatggggaggtgaaatctaagagagtcaaaggagatgggctgagctgagtctctactccaagaaagacattctagcagcagatccaagagacagaacgtggcactgtgtgtgagtcactcagttttcgtagaatttccactgcttctggacacaggatgcctcagctcagccagccaaaccccattcccaaaacttacagataccttgagggattcagtttccaagtctgagaatacagtcgtgtgaaaaggacattgaattttgataaatagtatatgtg

SEQ ID NO: 22636 - DNA, 1053 bp, Homo sapiens
tactcccttattttcattggaccttacggcagccggcgcgcgagagttacccaatcagcaagcgctccgcctcctgccttttcccgccctccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattgtgagagtgcgcggggcgggggccggggagcccggagcctgggccgaggaaagggctgtgggacgcgggagtccagcgcctgaggtcggggagacgacctgaggatcgggggatcccgctacccgccgccgaaaaggatctggggaccagggccccagcacgaccggagggtggatcctgacactcagtgcaggggggacactgggggaggggcctctgggtttcggaggtgagggacgggggtggcggggaggattccgtaccgtagggatcggagaccggaaactgctttctggagccgaagagagtcggaagaacaagaggttttccgtttggg

SEQ ID NO: 22637 - DNA, 1049 bp, Homo sapiens
taacattccaagtggatgaaatatgtggcgggagacagaggatcctgtgtccagcacaggagtacgtatctggcttagcgaatatggggaggggggaggccgtagggagcaaagagaaagaaacctgttgacttcactggaggcctcagagtggagtgtggggaatgtttctggacctgagcgtctccaggagaaatctcgacggttcccagaagcagttatttgtgtacccagggagtgggggccctcggggagcagcacggaactcttcatcagccaggagctgtgactctgggaatgggttcgggtagacctgcggttgtctgaggagaggaaaacctgatatgggacggcgtgaatcttcagttagaaaaaaagcagctttcgggccgagtgcagtggctcacgcctgttattccagcactttgggaggccgaggcgggcggatcacgaggtcaggagttcaagaccagtctggccagcatagtgaaaccctgtctctactaaaaatacaaatattaaccggatctggtggtgtgcgcctgtagtcccagctactcgggaggctgaggcaggagaatcgcttgaacttgggagggggaggttgcagtcagccgagattacgccattgcactccagcctgggcaacaaaagtgaaactccgtctcaaaaaagaaaaaagcagctttctttctcttttttttaaatacagatggggggtctcgctatgttgcccagggtggtcttgaactcctgggttcaggtgatctcacctcggcctcctgaagtgctgggattacaggcgtgaatcactgcaccaggcctcagggcagctttctagtaggactgggaaatggggggactggaaaggttaaggagtaagtagaagggattctggcgtaagagtttgtggagtttttctgaaaagagggcaccctgggacttggggctaaggggataaggagagaaatgaggtaacagaagagacaggatttggggttggaattggatacttgttcataagagaatttcccggagggaggagtgtg

SEQ ID NO: 22638 - DNA, 1074 bp, Homo sapiens
cacctggtttgtgcccagatgtatttatcctctgagaaggaatccgatcagttagcaagtggcagaatagtctctccttccctttggttctggctcacggctcctggcatagccactggtagggcccttggggccctaactgagagctagcccctggggaggagagcctgtatgctgcccatcctagctttctaaagttctctctgggtttggctgcaaggttcttgagggaatttctggttttagttccacctctgagctttcacacgtgttatcccaaccccagtaacattctccattctcatcactgagtcattacctgtgtatcctttgaatcaaggcttatctgttattttccaggtccctttcttcattcctggtactactttgtagccttcaacacaatcatattaaatttttgtgtgtctttaagatttgtctgtctcactaaactgaaggcttcagtggggcaagcttgtcttcagctgtatcccaggctctggagtatagtatgcatgccatgaatagttaatattattattcttaccactcttagttgagctcctggacctgcagatgccttctggatgctttggtccagggttcttcatgaaccgcccctctaattggccatttttaattttgttttaagatgccatggacaatattaccaggcagaaccaattctacgatacccaagtcatcaaacaagaaaacgagtcaggctacgagaggagaccactggaaatggagcagcagcaggcctatcgtccaggtaggaaaatacacatggttcatctctttggatggaaacaatctacatggagcctttaccccctgcttagagcgggtcttcccagagaaactgtgcatcttttttcttgggcagttcatctaaacattgtcactctggcaagaattgtttaaaggaaagatctcagtcctatttccaagtgttgggagaggggaggttccatggtatctgtaaaaaagtgatgttagtatcagccgggtgtggtggctccctcctgtaatcccagcactttgggaggccgaggcaggtggatcacctga

SEQ ID NO: 22639 - DNA, 1034 bp, Homo sapiens
caagtgattctcctgcctcagcctcctaagtagttgggactacgggcgtgccaccacacccagctaattttttgtgtgtttttagtagatgtggggtttcaccatgttggccaggatggtctcaatctcctgacctcatgatctgcctgcctcggcctcccagagtgctgggattacaggtgtaagccactgcgcctggcctctcctccccattttatagattgaggagttggcttgtccgatggcagagctggggctacaacctagcatacttgctcccaggctagtcctcttggttaataagcagcattccttatcatttgtgccttactatttggaaagcagggtcccactattgagaactgatggagcccggactgacccccagttttgtgctgcttttactgtgttgtggcctcccagtgccttttcttagtgtatctggttgattttgtctaacgccattctggttcatccacaaagttaaatccccagacatttcttgtgggtggctcagaactttactgaatgtaggttaaaccgcagatttgtgtcaggctctgtgagacttgtaggatcattcagccacaggagaatattttctgtgccgttatccacagacattcatcaggagccctgtgtgagcccaacctattgctgggaaccagggaagctctcttcaggatggctgagcaccatcccagccctagagaaccaggagacttttctgagagatgtggtccacatgccgaagctggggagtgatccaaaatggtctggggttgaatgcagaaatgagtagatgtgaatgagcttcagcatcagggattaatgctgtgggagaaatgaaggtagcctacatctgtggtttgctcttggttaggcactgattcctggagtctgcctgagactaggacttacccgtggtccacagcacggtatcccatcctgactttctgttaatggtatgacttaaagaggttattgcacctatgggatggcttaaccggagtgattctggcctcttttggtag

SEQ ID NO: 22640 - DNA, 1051 bp, Homo sapiens
gtcagtcctcatggtctccaggagcaaaatccagccccttcactgatttctaccacaagtagactggactgaatattgggtgtcacaaggaagggttgcatctcagcatacagccattctcctccatcccaactcctgtcttccttcctccctttcttttcaaattctcccctctgtgcagagttattcagttgagctcctactcccagactggacaatgaaacccatcaagccctccaagttctacatcattaagggcttcctttcacccttccccacccctattttaaaaaggcatctgattaataaaactagtaaagaaaatgatttttttcttcaaaaataaaagtatgtggcagccattgaggctgttatgaccatcgcaggtttaacctgcctttgcctatttcttccgtcaggcgaagagcctttctcctatggctatggaggcactgggaagaagtccaccaatagccggtttgaaaactacggagacaagtttgcagagaacgatgtgattggctgctttgcggtgagtgctagcagcctgtgggagttggcagaaccagatgttgggctacagacttctttttcaggatacctctatccattgtctgccccatatccagccactctcgccatacttctttgtctctgcttgacagactggaatgtttactgtcattttgtgggaaattctgtcattccatctcctctggtcttgtgtgcaaagttttcagatgacaccctgaagaggtttggggacttcaggtgtgcatagccttcctccgttcctaggtaccagagtaacattttctaaacaaacctaggaatttcttatctttcattgctaggaaatagcctgtctgctcctgaaggcagtggtattggctcttgccccatgttggcatcatcttatcccaaaacttctccctttcttcatctcacattggttgagccaggcttcctacaatgcactgccttctggaagagtagagatgatgcaaaacagaacagctgttgctgccatacttcagtctttgagaacagt

SEQ ID NO: 22641 - DNA, 1042 bp, Homo sapiens
ttcaccatgttggccaggctagtctcgaactcctgacctcaggtgatccacctgcctcagcctcccaaagtgctgggattacaggtgtcagccactgcgcccggccctcaatatgttttcaataaaacatttttaaaatgaaaactgtgttcatactctacaaattgttcggttttaaaccttgcatttttttcccattgaagagtaaatcttggccatctttccctgtccacacagacaatatatagatctagctcagttaaagttgtttcttaatagttaatcattgtgaattgattttttcaagaatagggtttccaaaaaaaaatcgaggaatgtaaaaggggatacagtgtaaagtcttctttagacaccccccctcccgccccacccatttttcacatataccctccccagcatgtgaacccactggtactcggggtttcatctttttttttttttttttaacttgtatgtcttgggggtctttttatttatttaatttttttgagacagagttttgctcttgttgcccaggctggagtgcaatggcatgatcttggctcaccacaacctccgcctcccagattcaagtgattcttctgcctcagcctcccaagtgctgggattacaggcatgcgccagcatgcccggctaattttgtagttttagtagagacagggtttcaccatgttggtcaggctggtctcgaactcccgacctcaggtgatctgccctccttggcctcccaaagtgctgagattacaagcgtgagccaccatgcccggccttggtggggatctttttatggtactaccaagagagcttctttgtacttttatattgtctgtagtcattgtatgactgtaccataattgatttaacctagcgcctccctttggtggacatgtcgttacttttgcagctttgtatttagtgactgtaatggctgtctagtattctgatgcaggggtttgggtaccctgctttaatttagcccgtcttcctgttagtggctgtgaaagttgtttcctggaacaga

SEQ ID NO: 22642 - DNA, 1049 bp, Homo sapiens
tggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgagggattcatgtgcctggccccgattttggtgctaaaaatgcacgcttaaacaagggtccctggtttaaaatccactagttcatttttaaagtgcttctcttgttctctacctctcacagtctaaaatccctccaggagtttttgagtaaaggacatggaacaggcctctaggtggagggatgggtgggactgatggggcagagaccagggctggtttgtttggcatcatcactgggcatccacagaccacctgcctcaggcctggcctgtgtgcagcacggaggacagttcctgcctgttctgtgtttggggctcatggggattccaggagcttcatgtttcagccagtgtgtgtgagccacctgctgtgttcttcagctgtcctggacagtgctggggacatagtatggccacggcagtcctggaccccgttctcacagagctcccactccagagagaacaaagacctgccagcaccaagtggtcagctgtgagagcctggggtggtgtgcagggagggcttcctggaggagtgagccagggtaaaagactccagattgcatccccatggcccatcttccccttccttagcaaccttatgtcttcgttccctcatacatgctgtgttcctggctccttgtgagagacaatgctgggccacagga

SEQ ID NO: 22643 - DNA, 1049 bp, Homo sapiens
acaggcgtgggccaccgcacctggcctacagtatgcttcatagaaatatgaaaagaatgagagcaaggttgagatagaaagtaacagggcatccctcctgagtaaaacaatcctgccccctcacgctctcgtctaccctcccgtgggtctccctgcttctgtcgtctgccagaaactggctgagccaagtgcacttgcagacgccatctgttctccctgggagtggggccggtgccagcgccagcatctggactcttggcaaggagccctggagccctggagcgagggaactccggccccacaaaggccagggaatcctccagtctggtgagacggagggcttctgggaagggaggcctatacaaggctccatgaaggaggtggaagcttgcaagacgatgatagtcttgtaatcagtccgatggagatggatgtaaataataatattaataaacaccatcaaatgtgttcagagtgctttctttgccaggctttggataaatgttggatatctgttctttttattttttatttttctatttcctaggcagcacctaaaccaaaataggttcagagaggctcccaatgttggacatttgttgttgcagcaactctaagtactctacatatgttatcacataagaggcaaggagcattatccccattttgtaggtgaagaaataggggttcagagaggtgaaggcattgtctagaggccacacactcagtgacttaaagagcctggaaaggggccaggaatggtggctcacacctgtaatcccagcactttgggaggctgaggcgggtgggtcacctgaggtcgggagttcaagaccagcctgactcatatggagaaaccccatctctaccaaaaatacaaaattagccaggtgtgatggcgcattcctgtaatcctaactactcgggaggctgaggcaggagaatcgcttgaacctgggaggcggaggttgcggtgagccgagatcacgccattgccctccagcctgggcaacaagagtgaaactccatctcaaacaaacaaacaaaga

SEQ ID NO: 22644 - DNA, 1048 bp, Homo sapiens
atggcgtgtgcctgtaatcccagctactcgggaagctgaggcaggagaatcatttgaacccgggaggcagtgagccgagactgtgccattgtaccccagcctgggtgacagagcaaaactccgtctcaaacaaacaccgaaagcccatctctgaacacttttttctctttgtatctctggggaagccctaggggcaggtattggcctttgagggctatggagagcagagcaatggggcaggaaaggtggatggagatgcccacctgggcactttcctgtccgtaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaaggtcagtctgtgtgtgggacttggaggggactgggcataaaagagaaaaatgcaccacaaaaacaaagagccatatacctgaggcgggaaggtggaaggtagcccagagaacctgaactcaaatcctgagtctgccactctctgcaagattttttttgagtctcactttgtcgcccaggctggagtgcagtggtacaatctcggctcactgcaatctctgcctcttgggttcaagtgattctcctgccccagcctcctgagtagctgggattagaggcgcgcgctaccatgcctggctaatttttgaatttttaataaagacggggtttcaccacgttggccacgctggtctcgaactcctgacctcaagtgatcctcccatcttggcctcccaaagtgctgggattacaggcgtgagccacggtgcccagctctctgcaagattttgggcaagtcacttaacttccctgtgcctcactttcctcatctgtaaagtgggaataattgctacctctgggtcaatgtgagaatcaaatgagttagaatagtggcatataccattttaatgtttttatttattttttaaaatttattattattattattttttacca

SEQ ID NO: 22645 - DNA, 1950 bp, Homo sapiens
ccgcacggtaagcgggggctccgagctggaccgggcgcgaggtggcagggccggacgccgaagcctcagagcgcgtgcctgagggccccgaggcgcccggcgcgggcccgtcccgccccctagagccgcggccacgtgcgagcggcaggcccggacatgcccggtcagcgccgtccgggaaccgagcgtgggccccggggggcagcggcggggtgcgtggggcgtccggagtcccggggctggggagtggggtcgcgcaggatcctcacacgcaggggccgggctctgttagtgcgatccagagaggccgtgggcgtcggtgagctccttcagacccgcaggagccggagcccggcgttgaaggggccgtgggaagtaacggggggtaccacggtttaggatgcgctggagcgaaaggattggggtggggtccgtgctcttggcagtcgtctctgccaggcctgtgttcacatgcttgactttctccctcagatgcctggagttactgtaaaagacgtgaaccagcaggagttcgtcagagctctggcagccttcctcaaaaagtgagtttggggactgaggttcaaaacgggtggaggctgtcgccttggcctgcccatctgagccccagtgtttgccggtcctggcaggggaggcttgtttggggcctccgtggctcctttcagcgtgaggcctggcttgtgttccggttccagcctctctttgtactctgggcacagcatagttgtgttgaggggagggcatttgggatatggggtagtttgtggagatgactgaatcgtgcttttcccactgttttggtcttaggtccgggaagctgaaagtccccgaatgggtggataccgtcaagctggccaagcacaaagagcttgctccctacgatgagaactggttctacacgcgagctggtgaggaacttaggtctttggctggagagtggggagctgggtgacccctggcacaaaccatacttccctgtctcctctgagctctttcccgccccaagagggagagaaacccttggttgtgtcaccacttgctttgtgtgatgtgacattcgataacttggtactccaagtttttatgacattctaagagctttgtgagaggaggacctgtggctttgagcctcaggggaaaccagagacagatgaatgttcatattttgcttacaggtggtttaatcctttctatatacacggaggcagactccctgggtttggatccatcttttacatctggctgtgtgtcctctggcaagttggttaacctgcctgtgcactctctcatccccaaaatgggactaattattgtaccagtactagagtattgcaaggattgaatgaatttaaagcagagtgtttagaacgtgtctgttgcacagtagttattcaggaaaaagccagttgtctttactattgctcagatcatcaagttagccttctccatatctctaacaggctgtttctaactaaatggttggagatctggccaggtcagtccctgctttaaatcttgacttctgatcttatggacaccctgcaacctcgtgccagccccgtctcttttcgatcttccaataataatttacgtacagtccctgactagtgttagttctcacgtgtcttaatatttcagtactcactaaatcttcactttcaggaagatgtaacagggtgggcggtggcagtgccgtgttatgtcaaggtgacagccttagcaccgaccttcactaactaaggggcctcggcctctccaatcttaaaccttctctctctgtgaagtggggactccatcctgaccacaacttgtctccagataagaagtaggtgggaagcagggtttggaaatcggcaaagctcctccatgaccctgaaaagagttggccttggtacaggttgcttggcccttcagaatatgaagcatttt

SEQ ID NO: 22646 - DNA, 1123 bp, Homo sapiens
gtgggattacaggcgtgagccactgcgcccggcctgatcccatatattttaaatcatctgtagattacttatagattaatacaggccagacatggcacatacttatagtcccagctacttaggaggctgaggcaagaggattgcttaagcccaggagttcgaggctgcagtgagctatgatcacaccacagcactccagcctgggtgacagaatgaggccctttttttgtgttttaagaaaaaagaaaaagcactaatacggtgtaaataattgttacactgttttgaattgtagtttttttcccctaaatatttttgatccacccttggttgagtctgtggatatgaagggctggctgtatctggacctgatctcagggcaggagtgggctgggaacaagcggtgtgtaagaactgtttctgggcagaagcagcccaccccacacagactactgcctggcacttggcagttatggaagaacccccaattcccccacttgatctttagaactagaggaaagaaatcactagagcagactcagaccaacttgctgatctctgggtcccaggaacaaaccagactctgctctgagctccagagctaggcaggaccatgtgatggctgaaatctgggtgcttcctgcatgtgggccccggtgccatcacagtggcaggacagggcagttcctccagagctgtgtgacacggagccagtgagtaccctctggcacctcagtttcactctttaaaggagagtagcacttgacacacctgttgagtcctcagagtaacccggccctcaggtgaagcagggtggagagatcgaaaagcatttggcacagggcctggcagatgtgtgctccagttaatagaagcgtgcaagcgtttctggggaggctggtgtgtcgactggattttacggagctttttttgcaggcaaggaggctggctggggtggaccagggacttgcccaagccagccttccctgtgtctgcagaggggctggtacacattccaagcagggggcacccactgcacagagtgtctgccctgcccttgttatcctgagctctccagactgaggtggcccggagagtggcaataggtcccttcactcctgct

SEQ ID NO: 22647 - DNA, 1129 bp, Homo sapiens
cgttaacttttcccaattgatttttcggggcttttgatctaaatgcttgcacaaacaacaccccgtcagctcccaggggggctcccactactgcccccagctcgttagaatgcacctgactagggccctcagtgggacttggctggcggcaggtggcttcttgagaagcctggctcacagccaggagggaaggggctgagaacaggacctgtgctcactggggcctgcatgacccttccctccccacagcggccgcaaactgacacctcagggacaaagagatctggacagaatcgccggacaggtaaggcctgcgtttggggtggggctgggtcccttagtcgctgcccaagcatttccaaagcccatacttcgtcaggtagacttatttccttctctggagggcacagcccagggtgctggtggggtcagaggagggctgcccagagacaggagaaaggacagtcctgtctgacttttcctgttggtgctgcttagaaatttggaggcaggctggctgtggtgtctcacccctgtaatcccagcactttgggatgccgaggcaggcgaattatctgaggtcaggagttcaagaccattctgaccaacatggagaaaccctgtctctactaaaaatacaaaattagccgggtgtggtggcacattcctgtaatctcagctactggggaggctgaggcacaaaaatcacttgaacccgggaggtggaggctgcggtgagccaagatcatgccattgcaccccagcctgggcaacaagagtgaaactccatctcaaaaaaaaaaaaattggagggaactccagcccaggtgccactgggcatctatccacagagcacatagctgtacccgtagatgactccccctccccaggtcagcctgcgatgtttccccttagtcctcatgcgtactgagcatcacatgggctgcttgggagaggtggagataagggaggggggctggttcagaacccaggtctccattcagatcctggctggccaacaccctggggcagagtggccacacccctggtgccacagtctcctgtcttggcctccctgtggccaaaatctacccttggccacctcaagcatggtagtgaggagtcagtg

SEQ ID NO: 22648 - DNA, 1034 bp, Homo sapiens
gccgctgctttggggaccctttggtgggtgcggggaggtgggtcaggttccatctgggcccacctctgaccctgtgcccctctctccccagaaggtggaagaggtgggtgcctgggccctgggtgggggaagggctagcccctcccccatttctcccagcccctcccctctccccatggccactccctccccttcactccctgtgaggggtgggtggggacatcaccctcccagttgaagagctaagtatggaaatcctccccaccccataacaccccctctgttgccatccccctgcctcagggaagggagggggtcagtcctatgctccatcctgggttccccatcccttcccccatcaaatttcagtatcccccctcccccaagaccccccactaccccagtgcccctaaaatcccaccactcctctgactctctcctctcttctgttgcatgtttgatccctgtcctggtcacccttgccccggtcctggtctctccctgtctctgtccctgtcctggtctctccccgtctctgtccctgtcctcgtctctccccaatttctgtccctgccctggcctctccccacctctgtccctgccctggtctctccccgtctctgtccctgtcctggtttctcttcgtctctgttcttgtcttggtctctccttgtctctgtccccggcatctgcctgactctgtccttggcctcggggtccaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacgtatgtcaaccctctcccttcccccatccactaaggcagcctggagaatcagggagggattgttgtcagagtcacagaggaatgggcgttggagaccgaggtcattgaggccaactgtggtcacagaccttggaggaggagggg

SEQ ID NO: 22649 - DNA, 1034 bp, Homo sapiens
aaaaacaaaaacatagaatacaagacaacgaatgagccagaggctgcagggtgggaggagccagcaggtgtagggctctgtgattttgagctgtatcctgagggcaatacaggggtgaaagagaagttgaaaggcagtacctgcagaagcccaggaaggcctcacagagtagtggatgtaaaagctggcctccagacaggggaggtcctgggcaaaggccagaggtgtgacagagcctggatcatgcagggcctcccttgggaggctgtggagctttgtctttgtctgggggctctggggagctatggaagggttttgagcagggagaggacatgatctgatttatgttttagaagatctctctggctgctgtgtggggtatggatgaaggcctgtttctcagtgatagcatgtctacctgttcccagcttgggggccattcctgtcaagctagtgggatgagaacagaataggaagtgtgtgtgtgtgtgtgtgtgtggcgaaggggtctgtgtgctggatataaatcactctctggccttaaagagtcccagactggttaggccaggtgcggtggctcacgcctgtaatcccagcactttgggagaccaagtggggcggatcacctgacgtcaggctttagagaccagcctggccgacatgaagaaaccccctctctactaaaactacaaaaattagccctgcgtggtggcgcacatctgtggttccagcctgggtgacagagcgagactctacctcaaaaaaaaagaaaaaacgtctcagactggttgggaatggtggggctggacacagatattcagcccccagtgtgttcactgagacagtgctcagggctaagaaggaaagtggaggggtggggtggatgtacctagggaggaaagaggactgtgctgcagataacagagcaggagccactaaaatagggttctgaagcatgcataggagtttattgagtgggaaaagggagcaaacagcctctatgaagacgtgagggtggctggagtgtctcagga

SEQ ID NO: 22650 - DNA, 1031 bp, Homo sapiens
cagtgctgctttgaacatacacgttagaacaatttatattccttggggtatatacccgataatgggattgctgggtcaaatggtaattctgttttaagttatttgagaaatcttcaaactgctttccacaatgcctgaactaatttacattcccatctgcaacctcactcgcatgtgttattttttgactttttgataatagccattctgactggtgtgagatggtatctcattgtggttttgatttgcatttctctcatgattagtgatattgagcattttttcatatgcttattggccacgtgtatgtcttcttttgaaaaatgtctgttcatgtcctttgtctactttttaatggggttgttttttgcttgttagtttatttaagttccttataggttctggatgttagatctttgttggatgcatagtttgcaaatattttctcacattctgtacattgtttactctgttgatagtatctttagcagtaactttttcaagatcacagtagataagtgacagagccagcatggctatccccaaacaacaatctgtataaaactatcacttaaggccgggtgcagtggctcacacctgtaatcccagcactttaggacgccatggcgggcagatcatgaggtcaggggtttgagaccatcctggttaacatggtaaaaccccatctctactaaaaatacaaaaaattagctagtcatggtggcatgcgcctgtagtcccagctactcaggagactgaggcaggagaattgcttgaacctgggaggcagagcttgcagtgagctgagttcgcaccactgcactcccacctgggcaacagagtgagattccgtccccaaaaaaacaaaaacaaaaactattacttaatctctgtgcctcagtttgctcatctgtgaaatgaaaattataacacgtaatgccattggatagctgtaagagtaaattgagatgatccttcaagaatgatgcccagtgaagtgctccacacatttcctttcttttttaaaattt

SEQ ID NO: 22651 - DNA, 1032 bp, Homo sapiens
ctagaggtccctgggcctgggggaggaatggatgggcatgctgagcactcagggtcctctgggatagctaaagcaagcggggacttgggaggccggcccaggtctgagaggcctcctcctccgtccccttgcctccccctctgtccccttgcctccctgcagtaccacttggactactgctccatgtacacagaccacagcgtctgctcccgggacccggaatgcagttggtgccaaggagcctgccaagctgcaccccctcctgggacccccttgggggctgtgagtgacagccctagaccctctgttccctagcatagagacctgccctcagtgtctccctctgcctaaccagatggacaagaactttccctcaactgggagacttgttttcatgccggagatcctccttcctgattcctgactgcggagccctgaacctttgcctatcccacccagcccgacccttttgagcccgtgaccccatccccgcatcccccgtcctctggatctcccacattccaagtcaactccccgttcttcagttttttcgccctttccatcgcaggaccctgtatccacagcccttccttcccagatctcttgagctccagttgacagtgagccctttcccctctcctcctcgcagtgtccagccgccagctgcctgggcctgggccgcctcctgggtgactgccaggcctgcctggccttcagcagccccacagcccctccacggggacctggcaccctgggctggtgcgtgcacaatgagagctgcctccctaggcctggtgagtgtccgcagcagtgggccggcaggagggggccagagcactccacactgacccaccggcccccaccccctgtcttctcagagcaggcccgctgccgaggggagcagatctcaggcactgtgggctggtgggggcctgcgcctgtcttcgtcacgtccctggaggcctgcgtcacccagagcttcctgcctggcctgcacttgctcacctttcagcagccgcccaatacctccca

SEQ ID NO: 22652 - DNA, 1067 bp, Homo sapiens
aaatggctagaggccaggggtaaaggtgggctctgggaccctgtcgtctattgtctgaatttaggtcttgcctcttttcccagagtgacctttgacaagccacctaacccctgtccctctgcctcagtctctcatttggtaaaatggggaagaaggttgggttgaccagtcttttctggctctgatgtggcctgtgagtccagaaagggactcacacatacacccatccctggtggcacaggtctcaattgtccgcagcacgaccatcaccctaacacccagcgcagagacagatgtgtccctggtctaccgtggcttcatctacccaatgctgcctggagggccaggtggaccaggggctgaggacgtggccgtgtggacgcgggcccagcgcctacacgtcctggcccggatggcccgtggccctgacacggagaacatggtgaggccgcctgggacattcagggggttgtttatggtaaatagggagttaggggtgtggtatagagcatctgtggtgatttgaaggttctggggaagggctggggagaaattagaggcaggagatggattttttgtgtgtgtgtaagacagagtctcactctgttgtccaggctggagtgcagtggcgcgatctcggctcactgctaccttcacctcccaggttcaagcaattcttctgcctcagcctcccacgtagctgggattacagatgtgcatcagcactcctggctaatttttttgcattttaagtaaagatgggttttcaccatgttggccaggctggtttggaactcctgacctcagatgatccgccaccttggcctcccaaagtgctgggattacaggcgtaagccactgcgcctggctgggaatggatctttcgtagaggagggagggtgctgaggttttcaattgtgagcagaatttgagggaaactttgaagcaggtgaggaaggtctgagtcagacttgaaaggcccctgaaggctgggcatggaggtgtacacctgtaatcccagccctttgggaggtaggggcaggtggattgcctgaacccagaagttt

SEQ ID NO: 22653 - DNA, 1089 bp, Homo sapiens
aaaaaaagcccctgaggaggagggtccctgggggtctcacctctgaggttctcaggatctaaggagctctgaggccctcttcttaggagggggtggggtacagggtgggtttggaggtatcaggggtctgaggaaggaatgggaagggttctgaggcccctgcctatcactcacacctaccccaggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgtgagtacccaggacctacctccaaccctagccgcaggccccagcctcagatcacctgggctttctgaaccccaggccacaaactctgaaatccctagattctggcctcggactccttaactcttggcctctgaactctggacctcctcttgaaccctgtggcccctgacctctgcctatagaccctaacctgatcccatattttgacccccatcttctgactcctcacccttgaccctgctgaccctgacctctgccctccatactttgacctataataatctccagattcctccagaccttggacctctttactgatttcctaaatcctgacttcctatgtgcctgagttctcaacctgggctccaaacccttactttcagttagcgccagactctgacccctgccccagaccttgactgctgccttcctgtgaccccttccccaggagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggtgcctgtggggccacca

SEQ ID NO: 22654 - DNA, 1031 bp, Homo sapiens
cggccttctacctccctgggccactcaggaccctttgcctggtaggcggggcccacagcccaactcgggcagcgataggctttcggagacgccagtctctgccaggcccagtcagtcggccaatagacccggaacctgagggatcggaatcctggtccactccgcagaggcccgagcgggctcgcgagggaacgggttctccgagtctggccgggtaagccctttccagcacgcctagtattaggattctgcacatagctcgggtggaaaaccgtgaggcttagtgaggcttgaggcggaggggggaggagctcagtcccggcgaacccatcttgctttcttggagaaactgagaccgggatactggatctgttattcatccatccgttcctcccaccctaagcctgattctcgtctgctcctgccttcctgttccttcatccgttctgcccttcctgccctcaattctctcactcacggattccctcgtctagccactcactcacacactctcccacctattagttagacaaacatttcctgaggcttctggtgtgccaagcctcgtgctgggcgatgctggtgaccaagatgagtcaggcctgggccgtgccctcaaggagcccgggtcagatgggaggatggacgttgatgggcatgggtgtgcggagacggtgggagcccaggagagacttttttgagtttggcgtggtcgggaaagggtttccaggggaggggccattggagctggatcttggaggagcagaaggtgccaggcaaagtggagatgccaggcaaaatgggtgtggggagggtgtttcagcgtgaccaaagacagggaggcatgcaggagcagtactgcgtgcaggtgcctaagcggaaggccagtcaagtctgtatggccagcaggggaactgtaaggctggaggaggccgaagagatgagcagaggccaggctgaggagcttggactttgtcctgagggtgagggggtagtggagagccatggaagggttgagagtagtggaggac

SEQ ID NO: 22655 - DNA, 1046 bp, Homo sapiens
cgctcaccacgatgtgcacaggtggcaggctcttgagcatgctgtcgggtgccagcagcggcgacatgaaggggttcttgactatgggtgaggagtagaggggcatctgtgtggcaccctggctggagcgtcgggggtggaaaccctcggggaaggcggcacggacgcccaggcctctgtccatggggctcagctcatttttggcctcagcctcttcccctgcatcctcaggtggtaataagaagttgacatcggagggtgtggaggggctaagtgtctcagctgacagcgacatctcgggggtgtccgacgacgtctcggagtttcccctcaggctcaagtccctcagggtcaggttcttgagggaatccgtgcccagtgggccctggggctgggccagtgctgcttcagacacactgcggcgcatcggctctgagagagggagagcagataggcctggctccgttagtttggttgtgtgtgtggctggcagggaatgccatgggaagggcagtcgcctgtggagcgctgtgaaaggctgtgtttccccagactcttgcctaggggatgggtggagttccagatgccccaggtggtcatggtgggggtcttggcagtggggcagtgtgttctagtgaaggatgtgtgtgtgtgtgtgtgtgtgtgtgtgtgtgtgtgtgtgtgtgtgtgtgtgactgggaagattaggtgcagtttacctctaggaacctattttttcttctagatcaaggaaatgaaaatagtccttggttcataggtggcaggactcagtgggataagatgtgggattaggtaccgctacccactggggatcataatatatcgttttttgtttttttttttttgagacaaagtctcgctctgtcacccaggctggagtgcagtggcaagaacatggctcactgcaacctccacctcccaggttcaagtgattctcgtgcctcagcttcctgagtagctgggactataggcatgtgccaccatgcccggctaatttttgtgttttttttttagcagagatgggg

SEQ ID NO: 22656 - DNA, 1043 bp, Homo sapiens
tactattgtgagtgggggcaccaccaaccatgtccacgtaagagggcgaactttaccgattaatgctgtgtgtgttctgactgctccactgaccagccatttcccccatctctcttctcgagcctccatattccctaagacatacaatattgaggccgggcacggtggctaatgcctgtaatcccagcactttgggaggctgaggcaggtggatcacttgaggtcaggaggttgagaccagcctggccaacatgctgaaaccccatctctactaaaaatacaaaaattagctgggcatggtggtgtgtgcctgtaatcccagctactcgggaggctgaggcaggagaatcgcttgaacccgggaggtggaggttgtagtgagccaagatcacaccattgtactccagcctggaaaatagagcgagagtctgtctcaaataaatgaaatgagatgaaaaatagaataaaataaaatagaaatcaggccaattaacaaccctacaatgacctcaaagtgttcaagtgaaagaagagtcttatgtctctcattttaaatcaaaagccagaagtgattaagcttagtgaggaaggcatgtccagtgctgaaacgggctaaaaactaggcctcttctgccagttagctaagttgtgaatgcaaaggaaaaattcatgaaagtaattaaaagtgctactccagtgaacacatgaatgataagaaagtgaaccagtcttagctgggcatggtggctcatgcctgtaatcccagcactttgggaggccgaggcgggcggatcacgaagtcaggagatcgggaccatcctggctaacacggtgaaaccccagctctactaaaaatacaaaaaatcagccgggcgtggtggtgggtgcctgtagtcccagctactagggaggctgaggcaggagaatggcgtgaacctgggaagcggagcttgtagtgagccgagatcgcgccactgcactccagcctgggtgacagagtgagactccgtctggaaaaaaaaaaaaaaagtgaactaggctta

SEQ ID NO: 22657 - DNA, 1079 bp, Homo sapiens
gttagccagcatggtctcgatctcctgacctcgtgatccgcccgcctcggccacccaaagtgctgggattacaggcgtgagccaccgcgcccagcctctctggtgttttaaaacaagcttacactaaactcagatgttcaaagtctgatgccctgccactttcttacttcagtgcatgtttctttttcgagacggagtctcgctctgtcgcccaggctggagtgcagtggttctatctcggctcctgcaacctccgcctcctgggttccagcgattttcctgcctcagcctcctgagtagctgggattacaggtgggtgccaccacacccagctaatttttgtatttttagtagagatggggtttcaccatgttagccagggtggtctcgaactcaggtgatccacctgtctccacctcccaaagttctgggattataggcgtgagccactgcgcccggcctcagtgcacgtttcttataattccttttaaaatctgaccattgtcatgggcatgcatcaagtctgtgaatgcagacctctgggatatgcccagtgggaatactggggactcagggaatagttatcacccaaggtaggatggcatgaggcagtatcaagggacacctgcaggggggtgggggttgtgtcccacagatggtgggagccacagatggtttcatcaggacagaggcacaataaccgcatcttgatggtctcagggcttagactcacctgttgcgtccagaaccaggcattgaccagggttcaaattagtgctccacctgcagagccctgggcagagatggacaacagcctccccctgcaggacagtcagtgcagggctgggtcacctcagcactccacaggcctttgcctgcagtgttctcctggccagggaggaggccaggcccatccctgtcacatcatctaaggggctgtctgccctgagggtctgcagaagagttgaacagagtaaggggcataggaagcagtagagccgtgtctcttcttgagctgtgttaacttttgtcttcttagtccctgaggtcactcccaaatgtgggcatctagacctgag

SEQ ID NO: 22658 - DNA, 1034 bp, Homo sapiens
caatgtgtggatacacctcatttttctatccacttatctttcaataaacttttcagttgtttccaccattttggctattgtgagtaatgctgttgtgaatggcagtgcataaatatctaatcagatttctttccattgttttgggtgtatgtccagaagtgggattgctggatcaaatggtaattctttgtttaattttttgggaaatagccataccattttccacagcagctatagcatttcccatttccatcagcaatgcactacagctccaatttttccacttacttgaagatactttttgctttgtgctgttgttgtttttatcaaagctatcctaaagtgtgtgaggtggagtatacttgtggttttgatttgcatatctctaagtattagtgatgtcgagcatctctacatgtgcttattggttatttgtatatcttccttggagaaatctctattttagtcctttattcattttttaattttttttttggatttgtgctgttgttgatttgtaatagttcttcatatattctggaaattaatcccttatcagatatataatttgcaaatatttttcccatttcataggttgccttttcacttttctcaataatgttttttgaaattcgaaagttttggccgggtgcggtggctcacgcctgtaatcccagcactttgggaggccgaggtgggtggatcacgaggtcaggagatcaagaccatcctggctaacacggtgaaaccccgtctctactaaaaatacaaaaaaaattagccgggctttggtggagggcgcctgtagtcccagctacttgggaggctgaggcaggagaatggcatgaacccaggaggcggagcttgcagtgagcggagatcgcaccattgcactccaacctggcgacagagcgagactctgtctcggaaaaaaaaaaaagaaatttgaaagattttagcttttatgaagtacaatttatgcattttcttttgttgcctatgtttctgttgttataaccaatatatcattgtga

SEQ ID NO: 22659 - DNA, 1089 bp, Homo sapiens
ccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatctggcggaggaacagatcagtcacagtgaacagcaaatgcaaagaccctgttgttggaaaggaactttaccagaactctagagtagagttattaaaggaacatgtactaagaaattaggccagggagataggaaggggccagataatacattgttttgttgttcttgtttgtggaatttggattgtttagtctctttcagtctgaaacagttcacatgtctttccttgacttgcgtatatgtctgtgatgcttttgaagattacaggccagctattttgtatagtgttcctgaatgtgggtttgtctgctatttcttcatgattagatttagaatatggatctttggcaggattatcacagaattgatgctgcgttcttctccctgcattttgttgggtggtatgattaatttatcattactcatgttattcactctgagtacttgattaaggtagcgtctgctggcttcctccttgtgcagttgccctttttcccttccacaactattttgtggggaggaactttgaaactattaaatattgtggaactgggcacagtggtggctcacacctgtaatcccagcactttgggaagctgagacggttggatcacttgaggccaggagttcgagaccagcatgggcagcatggcaaaaccccatctctacaaaaaatacaaaaatatttgctgggctgtggtggtgcgctcctttagtcccagcaactggggaggctgaggtggctggattgcttgaacctaagaggttgaggctgcagtgagctgagattgtgtcaccacactccagcctgggtgacac

SEQ ID NO: 22660 - DNA, 1058 bp, Homo sapiens
catcccttcatgctaaaagctctctgtaaactaggtactgaaggaacatacctcaaaataataagagccatagatttcaaacccacagccaatatcatactgagtgggcaaaagttgtaatcattccccttgaaaactggcacaagacaaggaccagccccccgccctttccccactcctgttcaacacagtattggaagttctggccagtcaagtcagacaagtgaaagaaataaagcatattcaaatagagaggaagtcacagtatctttgtttgcagatgacatgatcctatatctagaaaaccccatcatctcagcccaaaagctttttaagctgataagcaacttcagcaatgtctcaggatacaaaatcaatgtgcaaaaccgctagcattcctataaaccaacgacaggcaagcagagagccgaatcatgaatgaactcccattcacaattgctacagaaagaataagttatctaggaatacagctaacaagggaagcgaaggaccccttcaaggagaactacaaaccactgctcaaagaaatcagagaggacacaaatggaaaaacatttcatgctcatggataggaagaatcaatattgtgaaatggccatactgcccaaagtaatttatagattcaatgctattcccattaaactaccgttgacattcttcacagaattagaaaaaaaaacctattttaaaattcatttggaaccaaagaatagcccaaatagccaagacaattctaagcaaaaaagaacaaagctggaggcattatgcaacccaacttcaaactatactccaaggctacagtaacgaaaacagcatagtactggaacaaaaacagacacatagacaaatggaacagaatagagaactcagaaataagaccacacacctacaaccatctgatattcaacaaacctgacaaaaacaagcagtggggaaatgattccctatataataaacggtgctgggagaactggctagccatgcacagaaaattgaaactggaccccttccttacaaacattatacaaaaattaaga

SEQ ID NO: 22661 - DNA, 1117 bp, Homo sapiens
caggcaggcggattcgggggattctgggaagtgtagtccagacgcctgtggcatcatcgacacttccggtctccgagcaggacactgctacttaacaaggtggtttgagccaagtatgtgtcttgcgggtctttgcgaaagtgaaccagttattaggggcgcctaacgacctggggggtcaactaagggggtaagaagccctggagaagacctgaggtttggagatgcgaggggtgggagggaagtttcgttgccgtcgatggagccttctggcgttgggggctgtactcaggtccaccggaggagtcgtcgggggttcggggggggcggggaagaactctgtctagtcttgtgtgcctgtttagagggttttccaggtgtttgacctcgttcagtccgcctccctccactcttaagtgtgcgacctctttctcgcgatataacgtggggtgttacttaatctccctgtacctcccattgccgttttttaaatgaggatttcaggaccatcctgatagaattgttttaggagttgaaagttgtggtataaaacaaagacttaacagctcctgtcacttggtgtcctgttaatttcccgcgaagtggtcaggtgcccgggtggggtcagagctccagctgctccggcccttctcttggagcccggcagggctctggatgatcccggacgcctctgacctctttttaggaaggcgtgggttgcatccacgtttcacgaagggagaggagcatttaacttgtatccgggacggcgacgcagagtgtttgacagctttctccttccccagcctgacttttctaaaagagctgcagggagggacttggctactgaggacaaagctgtctacacgagtggtctttggcttttctctttttaaaaaaaagttatttattttgttagtctgtttttattattgttattatttgagaatgaggtttgctctgtctcccaggctggagtgcagcagtggcgcgatcttggctcactgcaacctccgcctcctgggttcaagcgattctctgtcctcagctccggagtagctgggattacaggcatgcgtcaccatgcccggctaatttttgtatttttagtagagac

SEQ ID NO: 22662 - DNA, 1030 bp, Homo sapiens
ttggaaaacacaaactgtaccttccttgtattcagtaaagtttcaggccatgtcctaagtgaaatcctgaaaacactgaacaaaggtttcacttacccacatctcttaattctgtgtccttataggaggcaagatccaaactgagttggagtctgttccagaaacaggaccacatgaagagtggtcttgccagcaaatctgggaacaaactgcaagtgagttaactagacctcaagactccataagtagctctcagttctccacacaaggtgatgtcccctcccaggttgacgcaggactatctataattcacataggagagacaccttctgagcatgggaagtgtaaaaaattcttcagtgatgtctccatccttgatcttcatcaacaattacactcaggaaagatatcccatacatgtaatgagtacaggaagagattctgttatagctcagctctttgtcttcatcagaaagttcacatgggagagaaacgctataagtgtgatgtgtgtagtaaggcatttagtcagaactcacaactgcaaactcatcagagaatccacactggagagaaaccattcaaatgtgagcagtgtgggaaaagtttcagccgtagatcaggaatgtatgttcattgcaaattacacacaggagaaaaacctcatatttgtgaggaatgtgggaaggccttcattcacaattcccagcttcgggaacatcaaagaatccatactggggagaagccattcaaatgttatatatgtggtaagagcttccatagtagatcaaatcttaataggcattccatggtccacatgcaagagaaatcatttagatgtgatacctgtagtaatagctttggtcagagatcagcacttaatagtcattgcatggaccacacaaaagagaaactatacaaatgtgaagaatgtggaaggagcttcacttgtaggcaagatctttgtaagcatcagatggaccatacaggagacaaaccatataattgtaatgtatgtgggaagggcttc

SEQ ID NO: 22663 - DNA, 1987 bp, Homo sapiens
tcacagtctaattttatgcattgcctttaattgtcacatttccataatctttaatcttgaggattctacaccctttgtctttctatgcttgatatttttgaagagtataggcaagttattttggagaaaggcattcatttggagttgtgtctgatgtaattcatgtgcgggttcacattatgcattgttggtagggataccacagaagtggtgaattgcgggttcagattatgcattgttggtagggataccacagaagtgctgaaatgtccttttcattgcaacataacagggtccaagtgatgtcagtttgtctcttcattggtgatctcaaccttgtccacttggccgagacgctgtctttcagatttctccactataaagttacttaaaaaaaattgaaaagaataaagtttcttaggaatagataacattattagtgggcattcagctgtaaaatgaccttctccatttattctttgttcaactacaaatattctatcaatatggccttagaattgactcttaagttagataacgtgtacattaacaattattttttccaacctattgtatcatataacttacttatatcaggtgtacatccagtgatcattagacagtttgctgaatggagtaaccatcaccacaattcggtgatcatttcatgctcatattgatttcctcctgcctacttatggttagacttcattctcactcagatctgaagcaatcactaatcagttttctctatgcattttcctacccagacattttatagaaatggaatcctgcaatatgtggtcttttttaactggcttctttcatttagcaataatgtttcaaaggttcatgtatgttgtagcatgagtcagtacttcatttctttaaatttccaagtaagattccattgtatggatagaccatgatttgtctattcatttacccacaggagggcattttggttgtgccgttttgggtttttatgattaatgctgctgtgaacagtcatgtgccaattcacaatacacatccctgttggtgggtggcatccctggccaccttttcatgtctctttttctgcctttcctggcactttgcaggcacaattctgctttcccaggaactgcatcactcaggactctgcaagtttccagaagtaagagggaaaatgaccacgttcaaggtgggtaggacttgcttctattactcttaaaattccctctcagtacttaaattgtcacaagttttcctctgtcttgggaagactcaaggagaaaaacagacatttgaggatctcttgtgtaccatgtacttcctttgttacttttgagtggattttgcatttgtttttactacttgttttcttctatcatttattctatggagtagacaagattgtaggaatggataattatttcattatactacttctctgctcacacattagctatttttatcctgtgatactcttcctcatgtgcattcataactgtatttgtattggtgatgttaatctaatttaaattgcactctttgtatttaatattatataatgttcatttttaatggttgcaccatattcccatttaatcgatgttcctttttaattactttatacttccagacaccaggaactcagttttgaaaggctacttttgatgtgtgccacgttggctgttttgtagatagagtatccatatgtggcacatcatggcaggctgtaactgtggcttcacacaaggattgctggaagtttccacacaggaagagctagattctctttcccccatgcctgagtcatgccttctatgtcttttacttactggcctttctttactcctttatatactaaggaatttgaccaaagtaatatgtaagctaatttttttttttttgagatggagtttcactcttgttgcccaggctggagtgcaatggtgcgatctcggctcactgcagcctctgcctcccaggttcgagggat

SEQ ID NO: 22664 - DNA, 1050 bp, Homo sapiens
tcatctttctgttctttaggcctgaagtctgacacgtctcaccggacaattatcaagctgtctgtaggtgtttgtttctttctggatgctcttgaggagaagcctttattttggtttaccagtctctaggcattccttggctcttgtttcccttcctccatcttcaaaggcagctactttgcatttctgacccttcttccatagtcatgctcactctgccactcttcttatgcctctctctcctgcctttcaggttccttgtaattgtgttggttacccctggatgattcacaatgacctctctttcttgttagctgattagtgaccttaattgcatctgcaatcccagtcccccttgctgtgtaatataacatgttcataggtcttgggtactggatgtggacatcttttatgaatcattgttctgtctactactgaagcttctgcctcagagcccttacttgcttttctgtctgatcagaatactctttcacctcaaaactttctggcttctcctttaagcatattcaagtctctgttcagttttagagaggccatttccaaccaccctatttaaaatactattctaggccaggcgcggtagctcacgcctgtaatcccactactttcggagaccaaggtgggtggatcactgagatcaggagtttgagaccagcctggccaacatggtgaaatcccatctctactaaaaatacaaaatttgccaggcgtggtagtgtgtgcctgtagtctcagttactcgggaggctgaggcaggagaatcacttgaacccaggaagcggaggttgcagtgagccgagatggcgccaccgcactccagccttggtgacaaagtaagactctgtctcaaaaaaacaaacaaaacactgttctatttttttcttcttgtgctgtcttgcactgtgtcttatatatttctgtttacctgtcacttttacccccaggaatgtgatgtctaagaggatgaattttagctgttttgctcatggctgtctattcacaggctagaaggtattgttctggtacatg

SEQ ID NO: 22665 - DNA, 1098 bp, Homo sapiens
tagacaggagaatcgcttgaacccaagaggcaggttgcagtgagccaagatcgcaccgctacactccagcctgggcaacagagcgacactccatcttaaaaaaaaaaaaaatactctgaatggcttcttatttttcttaaagttgaagtctcttaaaggagcttatagagtcctgcgtggtctgctgttcatcctcctctgcgtctctgactacatctcctgtattctacctcttgctccatcttttccagccacatcatcctccctgctatttcccagacctggtaaggacattgctcgctctgtcgcccaggctggagtatagtggtgcaatctcagctcactgccacctccgcctcccaggttcaagcgattcttctgcctcagcctcccaagtagctgggattacaggtgcctgtaaccacgtccggcggatttttgtattttttatagagacagggtttcaccatgttggccaggctggtctcctgacctcaagtgacccgcctgcctcagcctcccaaagtgctgggattacaggcatgagccactgtgcccgacctggacactgcatttcttactgctgctgtaacatattaccccaaactgagtggattaaatgataaaaatgtattgtctttcagttctttgtttgaagtccaacatgggtctcactacgctgaaatcaagctgtcagcccgtccctgtttcttcccggaggctctagggaaggagaatctgtatcgttcccttatcagtgtgtaggggctgccaaatttcatagcttgtggccctcttcacagccagcaacagtgcttctctgatcattcttctatagttgcatttcccttttattctctcttcatcctttttccactttataaggaccctctaattgcactgggcccacttggataatgtagaattgccttctatttttagttcagctgatttgcaaccttaattccctctgcaaccttaattaccctttgtcataacctgacatattcttaggatgagaattagaacgtggattctttgggggttgattattctgccaactacagatacttctgcctcaaagcccttatttgccct

SEQ ID NO: 22666 - DNA, 1049 bp, Homo sapiens
ctggccaggctggtctcaaactcctgacctcatgtgatccacccacctcggcctcccaaagtgctgggattacaggcatgagccaccgcccctggcctccatctagactttgaaatgattgccttctaattacagtagcattctcttatttaaaatatttgttttatttaagtcagtgtttaagcaatagctcagcatatcccagtggtccagtgaccacacagctgagaacccttgttaagtggtacagtaaagcattctgtcaaaactttgacatttatgacatgttacctaggaaataggacttagaaaatgagtttgacctgggctttaaaaaagtatactgatgaaggtgccagaattgatgtccattagactgtaagctccatgggggcaggaactttgctaccgaatctatacaaccttaacattgactagtgcttgtaggtgtgctcaatacttgtttgttaactgaatcaaaaggagtaaatgcacaatatttgaacattgtatccaaaggaagaaacctgcgaaataaaattatttgcagaaatgaacatttgttgaaatgcagaaaaccactggatactgcagcctacaatattaatatgatattactcttttacagttgacacctgtcctctctgtagtctcttctctcaaatttggttcttattgagagcctgtctagtttcccaaaggttttataaaacataagttgaagtacctttatttttaattttatttttgagacaggacctcgctctgtcaccgaggctggagtgcagtggcataatcatggctcactgcagcctcgtcctcccaggctccatccatctgcccatctctccctctgagtagctgggaccacgggcacgtgccaccacacccagctaatttttgtatgtttggtagagaaagggtttcaccacattgcccaggctggtcttgaacacctgagctcaagcaatccaacctccttggcctcccagtgttaaattacaggcgtaagccaccacacccggccaagttgaagtatattttgtgat

SEQ ID NO: 22667 - DNA, 1064 bp, Homo sapiens
tttttgtctttttgctgaagtatttgagagcaagctagagatagtgatgaaaatgaaattagttacattgataacttactgttatctaacccacagtttgtatttaaacttactccattttcccattaaagactttgaaagtaatttcttcccccagatgagtttccagtctaattgtatgcattgcacttagttttggtttcattagtcacctttagtctagaatgattcctcagactttatttcttttttgctctcgatatctttctagagtattgagaaattatttgtaaaatgttcttatttttttgtttccttaatatttattcatgattaaattcaagctatgcattgtcagcagagatgccataaaagtagggaggcatccttctcagtgcatcataggagtcaaatgttggtttgtgggtttgtcccactagtggtctcaactttgtttttttggataaaatgtctgccaggttacctttttccttttgcacttaatactttgagactatgtagccatcttattcctcaccaaactcaccagtttttagcagctattgatgatgttctagttatctttcattctacctttattagtttatgtgttctactataggagctttcttttgtcacccatttatttattacacattcttttgtttataacaatatagactcaggttcctcccttttccttttttttttttttttttttttttttttgagacagagtctcactcagtcgccgaggctggagtgcagtggggcaatctcagctgactgcaacctccgcctcctgggttcaaacaattcttgtgcctcagcttcccaagtagctgggattacaggtgcctgccaccatgtccagctaatttttgtcttttagtaaagacagggtttcatcttgttggccaggcttgtcttcaactcctgactgtaagtgatctgcttgtcttggtttcccaaagtgctagtaggattacaggcatgagccactgtgcctggccaggttcctgcatttttaatttaagttaggtatggattgtcaaacggtgttt

SEQ ID NO: 22668 - DNA, 1062 bp, Homo sapiens
tgtgtagaaattttcttgagactggcaggtgcctcagtggtaatcttccttgtctgtgactattttatccttacatgggagacgttttctttggagactggagtccgtcatagatggcagtgacgttcctagtggcatttattattattcttattttgttgttactgttgttgtttagatacaaggtctcactctgttgcccaggctggagtgcagtggtacaatcacagctcactacagcgttgaactcctgggcaaagtgatcctgttatcgcagcctcctgagtagctggggagacacgcgtgcatcaccacatctggctaatttctaaagaaatatttttagagacagggtcttgttatgttgcccaggctggtttggaagtcctggtttcatgtatttctctcatctcagcctcccagctggctgggattacaggcacaagccaccatgcctggtcctagtggctttaattgtccactaaaatcagtttatttaccaaagatttacctaagtcatgtgaactttaaaaaaatgtgagttaactactatttttctgataaattacttaagtgcttaatttttttctttaagtcagttaaatagagctctttcatacattttggtagaaaatattacatacatatatagacacaagaacatacagacaacacaaaaagatattttcccttttccctttaaaattttagtcatgatacattaaaacagtaatatactgtgccatttagaatgtttatttttgctctttgaaagtgttcagaaacaagcagggaaaacaaaagagccaaattatttacagttgcatgtaaccaaattgacatgaaaccaaatgaagcgtgctcacaaaaattttaagccaggcttgcagagcaaacaaaatataaaaccgtgtttgcagaaaaaccaaagcaaattcagtagaaaatacatgcctcacagaacgtaagttctgtgggaaccagagtactctccaaaagaacacttggccttataccagaagaggctttccagaaaagacaaaaagtcttttgtagtcccac

SEQ ID NO: 22669 - DNA, 1068 bp, Homo sapiens
ccaggtacctgctcttgaacgcactttgttgttccattttctgtcctttcagttaatcaagtttccgtcactcagtaagttactactgaaaaatgatgaaatatttgttgaataaatgtgagagtgggtaggaaaactacttggaaatgagtattaccaataacatcttaccactttgattttaaggcattcgtctgtggaccatagctattgatgaagtaggtcttgttattttgttatgaggaaattaggcagagtttatgttattaaatactttcccgaagttattcaactgatagtaagaggtggatttgggattgaacccaagcattccttttcagactgtgtgatcttttttgtttgtttttgtttctttggtttttgttgttgtttattttctattcctttttctgagtctgtggtcttaatctcaatgatacagtcgtcttcagttatcttaaatagtaatccatatggctaccggtgagtcgttggaaatcagccttgggaatgtaggtatggattttactgtggaagacctcaaaaactgcactgatgaattttgaattttttagaaaaatcctgcaacatctcacttacttaatttcattccatgtcaaaatatgtcatattctagttatagaagtaatgaatgctcattatagagatgcactatccaatccagtagctataagccatgtgtgccctaggagcacttgaaatgtgtctagtccaaattgagatgtgctgtaagtgttaaatacacactggatttcaaaaactttgtacaaaaaatgtaagatggctcattgataattttttgtattatatgtcaaaatggtaatattttggatacattggcttaaattatgttgttgaaattaacttcacctatttttgtttttgtttttttgccttttttatatgttactgctagaaaatttaaaattatttatgtgtctcagtatatttctattggacagtgatgttatattcagaaaacttaaattacttataataaaactgctaacactttaatgtgtttccctttagtatatgctatggatg

SEQ ID NO: 22670 - DNA, 1033 bp, Homo sapiens
ttaaataatatatactattttatttattttatttcactaggtttttgggaaacaggtggtgtttggttaatgagattttgaatatatactctttacttatacaactgtacactcccaattccttccttcaaacttttgtccaattgtcaagcatttgtcgttggcatatgctataaagccacagtacattgctattatttttgctttaggagtcaagtgtctttcagagcaattaaaagttaaattcttaactgcttctggaaatcgtcattactttgcaagtttaccaaattttatatagcatcctttctgtttgaagaactttctttaatgtttcttgtactgctggttggctgctactgaattttttcagtttttgtcttaaaaagttttcattatatcttcattttcgagggatgtatttgctgggtatggaattatgtgttgttgtttttttctttctatactctttgtattctggtttgcatagtttctaatgagacatgtcctgtaattctcatctttgattctttgtatgtattgtgtctcctcacccatcccctgcctttggccgccttcaaaattttctctttattttgaatttactgcagtttcaatatgatgtgtctaggtgtgattgtttttatttttattttaaaaatacagatactaccattgaaaatccacagaaatatattcattcacctagaaactcttgtttcttactacattcttcatgtaataaaccaaaggatggaagggtgtatattttagtacattagaaaaagctcatttgcatatacttcttgaatttttcatgtgcacaaagacccactgaaagtatacacgaaaaactaacactggtcgggcgtgatgacttatgcttgtaatcccaacactttgagaggacgaggcagacagatcacttgaggtcaggagttcgagaccagcctgggcaacatggtgaaactccatctctactaaaaatacaaaaatcagccaggcgtggcggtacacatatgtaatcccagct

SEQ ID NO: 22671 - DNA, 1050 bp, Homo sapiens
atttcaacttgtaattgtttttttaaaattattcttgagatctttcccatttattttgtcctagtaaagcctttgaaatctggtgtgtatttcggcctggctatatttcgagtgctcagtagtcacatgtggccagtaggtgccatattggacagcacagatctagactaagctcccacatcatctacactggctcatccaaatactgtctacacacatacacagagcctgtcttaatttcgtcagctcccggggacacactgtatatgtgggggtgatctcacccccaccaccacattttcaacactggcccgacaatatagcatctgctgtaatattccaacaccctgtctacactgaacccatcagtaatatccacacaagctcttctagacatcattcatactgttcctcccaccattgtctatactgcttactccccgccaggcaattggtacacagattccctcaggtactgtctatactggagtccctcaacactgtcactgggtctgagcgaggaggagatctacactgactcctacccctcgcccccgaataaaaccctgtcccattggcctgcccccaaggacattgaaaggtcttcgctgtcaatcacgtatgggatggctgagcagcagcctagagcagggttatctgggactctttcctgcaggacttgtcagaaccttgaatacactgctgtgtgttgtgagtggtcattgcctatgagtgagaaaaggaggaggcattttcctgcaggacacccaagacatgcctggtccaggctacccaggaaagctagtggagaaaagcagctcctcagaagccttctccatgtccccactgaccaaggactcctaggcttctgctctctgtggcaccccatctacctagactcctcctaggcctctccagctcccgctgttttccaaatatccccgggccttttcctgcagtgtcgtgaatcccgcgtaccccaggccccccaaagcctcccagtctctgaacctctgtatccatttcctgcagaccccccagaggtatcca

SEQ ID NO: 22672 - DNA, 1182 bp, Homo sapiens
cactatgttgcccaggctggtcttgaactcctgtactcaagcagtcatctcacctgggcctcccaaagggcagggaagggattccaacatatgtggatgtcatcagttatttaaccagtccctagtagaggacacagatgtcattttccattttcaactctgcaaatgccatggtggtgtccatccccactggtcacttgtcagcagttgtccgtggaaggaattgccggtcaaaggttttcaactggtgtgatggtgcctttactgtcctgcctcaaagcaccgcaattcaggctcttgagccagatagctgcgtttgcatcccagctctgcggagcacccaaagcctgatgcttccatctcctccacctctgttcattaaaccagtgttccttgactacttactgtgtgccgggtgcaattaaccaacatacgttggtcgataaaacagaccaaatttcctccccatatagagcttccattctagtggtgaaagaaacaagaagcaagataaagtgtgtagtgtgtgtgcaatggtgataaataccatggagaagacaaagcagagaagggaatgggactgggcgccatgactcatacctgtaatcccagcactttgggaggcagagatgggaggatcacttgaggctaggagttcaagaccagcctggccaacatggcgaaaccccatctctaccaaaaaagatacaaaaattggccgggtgtggtggcatgcacctgtagtcccagctactcaggaggctgaggtgggaagattccatgcacccaggaggtggaggttgcagtgagtcaagatggtgccactgcactccagcctgggtgacagagtgagacgctgtctcaaaaaaataataattaaataaattaaagagaaggggatgggaagggtgatcatcacagttgaaatagggtggccaagtgaggtgttactaaggtgacatcccagcagaggcctgaaggagatgagggtgagctctgcgggtgcctagggggaaagcattccagcagagggaacagcatgggcaaacccatttctatccatcagtccctgcataagcaaacaccctggacacctaactggagagtttgaggaccaacaaagaggccactgtggatgcagaggcgggagcaaaggggagagtaatggaaaacgtgggcaga

SEQ ID NO: 22673 - DNA, 1912 bp, Homo sapiens
aggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatagctcattgcagcctctaactccggggctcaagcaatcctcccacctcagcctac

SEQ ID NO: 22674 - DNA, 1029 bp, Homo sapiens
attatttaattcacacagcaatcctaggggtgggtactttcattatccccattttacaaaacaagaaacagctacagagttgcaaaaccacttatcccaagccaggccgctgataagcagcagagctgggattggaaccccggcagttagggcctaaccaccctgctcctctgctgagtgtttgttgaatgactgccggtgaggagtgacgcaccccctctcctcctctccccagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctgtgagtgtatcgggggtgacccctcccccatcaaaactgcctacactggcttctctaaagcactgtctacattgtctctgaatgttgtctacgtgggttccctgaagccaaattctgcactaccttcctgccattgtctacactggctcccatgggcaaatctacatacttccccctcattgtctacattggctttactgggttcctgcatgctgtgcctagtctgtggtaacctgggatgggcttgcaagagccagtttgatacatttctttccaattccacatccaatgaagtcttctcggtagcttgaaatcaaccttggggaatatttacaccaaggaaattggcaaaccctagaaatgggggcttcttttattccccagagagttggtttaccagcaaagagctgcccccaacagtgtcttttctggctcccatggaccccggttgacactgcccctggaccgttagatcaatcatgctgggccatgtccac

SEQ ID NO: 22675 - DNA, 1309 bp, Homo sapiens
agggccagagacccctcctgtcagagccacagctggcaggatccacagccacagacactccctgtgctgagaaattctgttgcagagatgcatcagaatccagacactcacctggatggtaaccctgcacgctcaaacccattgtcaccaagacacacacccaggaggacagtggcaccagccaagatagactgaacgaagccagatgacacctggaaagggacattctttttttttttttttgagatggagtctcgctctgtcgcccaggctgaagtgtagtggcgcaatctcagctcaccgcaacctccgcctcccgggttcaagcaattatcctgcctcagcctcctgagtagctgggactatatgcgctcaccaccaaacccggctaagttttgtatttttagtagagacagggtttcaccatattggtcaggctggtctcgaactgctgacctcaggtgatccacccgcctcggcctcacgaagtgctgggattatatgcatgagccactgcgcctggccagaaaaagacattcttagaaacacgccagggcgacggtccatgcagcacacctgtgcaaacacgcaatgtgcaggccccccagaaacatgactgaaggtgtagggacaaactcccagacaggggctgtccctgtcatgcagacagactagccacggagggacagaagcagacccccttactgagtcataatcttagaatgcacacacacttgcagggacacccgagggaaaacagacacctcttcaggaatccagatacagccagggagataggacacccctacgggaaacactgtcacagacagcaaacccagagagacagctgtcccgctctgggctcgcctggcgcgtgaggatgcacataagtccccggaggaagacgtcacacagacacgctgggggcaaaactaatccaggacagcaacggctgcacacggaggaatgtcatccctcactcacagaccctcagacggaaaatcaaagacatcctgggaggagcttcttcccaggaaccctcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggaaatacacccctaacctctaccccagatacacctgacaagctgatcccctgcccacacacccagcaggt

SEQ ID NO: 22676 - DNA, 1040 bp, Homo sapiens
aaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcgtgagtaactggccttttgtctggggtgagggaccctgggttggggggcacagctggtcatcctggtaaaatctgggcttggaagtatgtcaagacaagaggctcatttcctcaggagtatattcattaatcttttcttgaggataatcattggtgggatcccaagggcttctgtttgttgtagcatactgtgtcgtttggtgtggcctcccagtgccgatccggtgttagcaagaaaaagggaagtctctgtaaccctcagagcagtcctgacgttagactggccacctccagaatgtctgtttcgcttattgctgtgttccccattcccagaagagctcagccactcttgagatttggcttggcacacaataggagtgagtattaagttggcctggcacagtggctcacgcctgtaatcccaagtggatcacctgaggtcacgagttcgagaccagcctggccaaaagggtgaaaccccatctctactaaagatacaaaaattagccaggcttagtggtgtgtgcatgtagtcccagctacttgggaggctgacgcacgagaattgcttgagcccgggaggaggaggctgtagtgcatggagattgtgccactgaactcca

SEQ ID NO: 22677 - DNA, 1036 bp, Homo sapiens
gtctctactacaaatacaaaaaattagctgggcgtggtggtgggcacctgtactcccagctactcgggaggctgaggcaggagaatggcatgaacccgggagacagagcttgcagtgagccgagatagtgccactgcactccagcctgggcgacagagcgagactccgtcccaaaaaaaaaaaaaaaaaaaaaaattttttccattcatacgtatatgcacatacccagctctgtgagactggggactaattatatttgggtcacgtttgtaccctagggttgggtccatcaaatatggtttgaaagaatagatgaataaaacaatattaacaatagtaattaaccatttaattgatccttcgcaggcacccccaggccatgtgagagatgcaggattttttttgaatccccacagtcacctgtgagacagagaccgctcttacttccactcagcagagaagaggaagctctgagagctccttgcttacctctgccacccaggaaggaaccacggggctaaagggagaactcatctccgatagtgtcagaaagatgtgatcatcaaggcaaggcctgggtctctgttggtcatagttgaggccccagaagtggcctaggaacacagcactcaggaatgaatagctaccttttttttttttgagatggagtctggctctgtcgcccaggctggagtgcagtggcacgatctcggctcagtgcaacctccgcctcccgggttcaagcaattctcctgccttagcctcccaagcagctgagactataggtgcccaccaccacgcccggctaatttttgtatttttagtagagacagggtttcaccatattggccaggctggtctcaaactcctgactgcaagtgatccgcctgccttggcttcccaaagcgctgggattataggcgtgagccaccacacccagcctagctgccatttattaagggcccatggtgcgccagacccagtgctcaccagcttggcatagtagtcctctgaacaggcctgcgaggtaggtatt

SEQ ID NO: 22678 - DNA, 1400 bp, Homo sapiens
gatgttttcccgtaacatttccactcctcccctgctgaccaggaagtagtcttatgaacagccgtgaggaaggctaagaggtgtagactttattttgggtcgccctgaccagatatatttggagttctgttactgttgtagcaaagggaatagatgttggttgccaattaatggtttgccactaacagtggagacaagagcatgtccttcgatgttgttggagtgttggacacatggaccactgagagcagcctggccagcgtcgctatcgctcagtaaatattagctcttgttattgacattactgttgctgatagaactggagtttggatccaggtggagggatggtgcagaggaaggaaggctggagctgagactccaggccccctccctgttagcagggaagcttgctgcattgtattccccctcaggacagtggtgacgaccaacccctctcactggataatggggaagagctcaaagaaccaatgtctatgggtgctttgtggtgcaggcctgtacaagcggcctttgtccctgtatgtgaacgtgacctgcattccgatctgggctgccaagctgtggagtatggctgggccgtggctgatggctgctttgaggaggggactctcatctcagccttgggccgagagcagaggctgtggagcgagtgtcagtgaagctgcggtagattgtggcaggctgaatgagtatgtccagatgcagttggtttctgtcttcctgatttgtcgttggtgcctgctttctctccctgtcttcagtcccaagcagactccggttctgtcattgcttctgtccttgtcaactttcctttttaatcagtggtttggataaagaaacagaatcctctgttgatacggaaataagaagtaaacaggtcgcagctcaggcgtcgcctcctccaggaagctccagactgacccccaagtctgggtcaggtgttccccctgtgggcccccatctcagcgctgtccactctaggttgtccttgtatggggacaagtctgtgtcccacactggactgtgagcccatgagggcagggccagggctatctcagttactgccataccctagcacaaggtctgcttaacagttgaatgaatgaatgaatgaatgagtaacttcatgaactcctctgacacaatctgatcctagagacaggataatccagtggttaagagttggttttgggccgggcgcggtagctcacgcctgtaatcccaacactttgggaggctgaggtgagcagatcacctgaggtcaggagtttgagaccagcctgaccaacatggagaaacgtcatctctactaaaaatacaaaattagctgggcgttgtggcacatgcctgcagttccagctacctgggaggctgaggca

SEQ ID NO: 22679 - DNA, 1027 bp, Homo sapiens
gggaagaaatcagagagggacaggccagcacctgtgagggctgagtggttgggagtggggtggggggtggggtgcggcccaacatgtgtcagcaaatctcctggaggcagagcccagcctggaccagactgcatccacacattgaaagatgaccaacatcattagccatcagggaaatgccagtcagaaccacaagataccacttcacccacactaggctggctgacatggaaaggacagactataacaagtagtaggccaggcatagtggctcatgcctgtaatcccagcactttgggaggccaaggcaggcggatcacctgaggtcgagagttcaagaccagccagaccaacatggagaaaccccatctctactaaaaatacaaaattagctgggcatggtggcgcatgcctgtaatcccagctactcaggaggctgaggcaggagaatcgcttgaacctgggaggtggaggttgcagtgagctgatatcgcaccattgcactccagttgaagatcctgatttctctatattcttgtcactacttgtgttttgttttgttttgttttgttttttgtttttggagatggagtctcgctcttgtcccccaggctggagtgcactggtgggatctctgcttattgcaacctacctccacctcctgggttcaagcgattctcttgcctcagcctcccaaatagctgggattacaggcgcctgccaccatggctggctaatttttttgtatttttagtagagacagggtttcaccatgttggccaggctggtctcgaactcctgacctcaggtgatccgcctgcctcggcctcccaaagtgctgggattaccggcgtgagccactatgcccgacccactgcttgttacagtctgtcctttccatgtcagccagcctagtgtgggtgaagtggtatcttgtggttctgattggcatttccctgatggctaatgatgttggtcatcttcccatgtgcggatgcagtctggtccaggctgaagtgtccacacc

SEQ ID NO: 22680 - DNA, 1070 bp, Homo sapiens
tcgagccatggcccgcaagatccgcatgaagtaagaccttgcccctccctgtcccatggccacacctcctggcctgcctggccttcccaccatgggctgctggctcaagccctgcccagctccctgtgggtggatgaaaggcagagatccctgcctggccctcggggctgtgcccagctgcctctcttgctcctctccctgaatttcctcccaccatttcgacctgcctcccgccaccgcgacctcctcccagctcttccagcctccaagtgccagtcacctttgctgtttttttggcctggcaagctgttcctgataccccttccccactcacccaccgccatgggtctttctcctgtcccagcctcagtttgcttatctcctaaatggagatacagtcactgtcccacctcacaggctgttgggaggatttgacaagatcaaggccaggcacggaggaggcacccagtagacgtagccattgggttgccaagcctggccactgtgacggagaccatttcaacactcactgtgtgcaggtgccccagtgcggcaggaaatgatgggactatcctgcctccctctgttccccaggctttcctaggaaggggctgggattccagtcagccccgccagctggggtccctctgaacctggggctccctttccaagcggggattggtggcagtaccggcccccttggtttactgtcttcctcggagtagggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtgagtgtccccaccaggctgcagggctctggggctttaaagaaaagtgtcaagcagggttaccaaaaaaaccatagtacagccgggcgcggtggctcacgcctgtaatcccagcactttgggaggctgaggtgggtggatcaatcacctgaggtcaggagttcgagaccagcctgaccaacat

SEQ ID NO: 22681 - DNA, 1025 bp, Homo sapiens
cccaggctggagtgcagtggcgtggtctcggctcactgcaagctccgcctcccgggttcacgccattctcctgcctcagcctcccgagtagctgggactacaggcgactgccaccacgcccggctaattttttgtatttttaatagagatggggtttcaccttgttagccaggatggtctcgatctcctgacctcgtgatccgcctgccttggcctcccaaagtgctggtattacaggcgtgagccaccacgcccggccacacaagaatctcttgaacctgggaggcggaggttgcagtgagccgaggtggcaccactgcactccggcctgggtgacagagtgagactctgtctccaaaaaaggaaaaaaaagaaacaggacaatttcaatcacctcccttctgtgcctggccccagggtcttgggtacccaacacttgtcactcagctcagttagtcctcactaggtttagagaggagaggaccaagccacagggagtggtgcagctgctaaaacctaggtcctcctctctcaggtctgcacccacaaggccagcatttccctatacacattcaacatcatagcatagcgcttcatatgtcccagacatgtgccaaacatggtaggttagttaggtaatttagtccccatgcccgccctgtgagttagggctctgttttacagatggggaaacagaggcacagattagtcaagccatttaccccaggtcacacagcaatactaacaataagagcagttcactattatggagaacctagaatgtgccaggccctgtctggcaggagcctgttgaatcctgataacagcataggcagcaattggggctatttttccatacaatggaagagaaaactgtctcttactgatgtcacacagctaaaccggcctgggatctccactcttcattcattttgttttttgtttgtttgtttttttcgagatgagtcttgctctgtcgcccaggctggagtgcagtggcgagatctccgcttactgcaacccct

SEQ ID NO: 22682 - DNA, 1035 bp, Homo sapiens
ctagagtgctgtggtgcgatctctgctcactgcagcctccgccttttgggttcaaatgattctcctgccttaacctcccgagtagctgggactacaggcgcatgacaccacacccggctaatttttgtatttttggtagaggcggggtttcgccatgttgaccaggctggtctcgaattcctgacctcaagtgattcgcccaccttggcctcccaaagtgttgggattacaggtgtgagccaccgcacccggccctatccacacatttttgcatctattccttttatatttatttacttgccagtctacagtaaggattatattttccttctcttccttatttattcatttatttattattggtatggattctggatttctgttttatccagtgggttataatctgtaactatcattattgtattgttcaaataattccagatttggccactgggagccctttcaagctagctcatgtgtgagtgggaatctatctagaagatagaatttcctgatggattgggtgggttgtgtgtgagagaaagctggggtttattcttttttttagagacagtgtctcactctgtcacccaagctggagtgcagttgcacaattacagctcactgcagcctccatctcctgggctcaactaatccttctccctcagcctcctgagtagcccagctaatgtaaaatatatatatatatttttagaaatggggtctcgctatattgcccaggctggtctcaaactcccagcttcaaagtgatcctcctgccttggcctcccaaagggctgggattacaggcatgagccaccatgcctggccaggttcatcttttggcaaatatttattgcctataagttgagataaaaacattataaaagcagacaaaggtccttgccttcacggggctcatgtttttgtgcatgtgacacttttgtttctgatccaagccattgggggacgatggcacagattttaggagggtggatcagtctggggcaggtgcagtggagctgcctggtagac

SEQ ID NO: 22683 - DNA, 1012 bp, Homo sapiens
tattatttttaattgagacagagtcttactctgtcacccaggctggagtgcagtggtgcaatctcggctcaccacaacttctgcctcccgggttcaagcaattctccagccacagcctcctgagtagctgggattacaagtgcgcaccaccacacccagctaacttttgtatttttttagtagagacaaggttttgccttgttggccaggctggtctcgaatcccgacctcaggtgatccgcctgcctcgatctcccaaagtactgggattacaggcatgggccaccttgcccagcccatttatcttcttggcatatggaatatgtatgtaatgtacatgtaagttgttgaagtgtaatatgttgaagacctgtgagcctccctcctaatttcagagtgagaacattgccattaactcacctctgcctgtgggtgggtggagggagcccactgtcctgactgttgtcattgtcattctgtgttttttattttttgcggggggcgggggtggatgggtgagggacaggtgtgtcaggttcaataaaaagggaaagggtcatcaggtggcctttttaaaagttttatcaaccatgtctgcatgctgaaaagcatggtgtttcgttctgcctgtttttgagtttcataaacatggtattgtgaggaaattcctgggtcttggtttttcttttctttctttttttttttcttttgagacagtctcgctctgtcgtccaggctggagtgcagtggcataatcttggctcactacaacctctgcatcctgaattcaggcgattctcctgcctcagcctcccaaatcccagctgggattacaggctcctgccaccacacctggctaacttttttgtatttttagtagagacagggtttcaccatgtctgtcaggctggtcttggaactcctgacctcaagtgatccgcccgcctctgcctcccaaagtgttgggattacaggcatggattccttctgatacatttcacctggagtgctg

SEQ ID NO: 22684 - DNA, 1023 bp, Homo sapiens
cctatttcaggccccaggaggccttgtgtggttctgtccctcccctgccccccaactgaggccgtggcattgtgggagcagaggacggaactggacacctagtgaaggtgcgtagaaggcatttgccccaggctggctctgggctgagcacacccattggtgacctcatcacgtgcacaccttcgctgcctgagtgcagggcacccaaaagcctgccatagacaagaagggaccttccctgagttcacccagctggccctgtctgagttggggactcacacctgtgctgactccagagacccaccccagccccaccttcctgttccttcagtcaacacatatttattgagcacttactgtgtgcccagtaaagacccttctggggatatttcagtgaacaaaaggggtaagagttctcccctcattatagcataaatgcacagatcagtacgcttcctgctgggtcatgagaagtgccacctagagaaggaagcagggattcatagtgataaaggggctgactttttggagggtggccagggaaggcctttgaggaggtgacttgggagtgaagacctgcaggcagggagggaaggagccgttggggtgtgaggaagaggggtgctctgggcagggggtaacaggtgcaaagaccctgaggcactgtgtccagatggctctgccactggcaaggatcaggacctcaatgactgtagcagcccctccccagcacccccaagtgaggtctggccatgcagctctcccatgtgcatgctttgcctcccgtgctccataagcaggaccttgacccctccagcctccttgctgacccctctcgtctcacactccaggtcccgatctgtgcagctcactgccagatgcatcaggcagcctcctgcacctgcactttcttcacaaagttccctctgccagagacgccttttgcatctttgtcatctctgagacttttccagatgcctcccgctgcagctgatcccagcctggccatcctccccgcctcca

SEQ ID NO: 22685 - DNA, 1057 bp, Homo sapiens
tttaatgaaatgtccagaaaaggcaaatctgtgtagatagaaagcccagccctcccttccgcatggtggcggctgtggccctccagggaccggggctgcagctgttgggtttgggctacgtcccttcattcatgctgggagccactgcctgttagcctgggaacacccgggaccaggcctgtctcttccaactgcttctgtgtcctgcgtcaaggggccgggccctgaatagcgtacggcgatgtttagctgttgagagtgttttgggagtggggatcctgagaggcacgtggcattgtagttgagagctgagttcaaagcccggctcgcatatataccaggtgtgtgatcttgggcaaggttgtttctctgagcttggtttcctcatagggttgaagtgaggattcattctttcacccaaaaatacaaaaatacaaaaaaaaaaaaaacaaaccaaggaccaagtacagtggctcatacctgtaatcccagcactttgggaggctgaggcagaaggattgctgaagcccaggagttcgagaccagcctgggcaacatagtgacaccccatctccaccagaaataaaaatgatctgggcgtgacagtgcaagcgtttggtctctgctgctcgggaggatgcttgagcctgggaggtcaaggctgcagtgagccatgttctcaccactttacttcagcctgagcaacagagtgagaccctgtctcaaaaacaaacaaaacaccgagacagtgttggagacatggtggtgaccaagacagccccagtcctgtcctcctgggctcccgggctagtaggggaggtggctgatgtgtagaaagattgtgtgctgttcattgtgtatttgtgtgaaggtgcttggagcggaggtgaggcgtggagggcagtggtgacttggggtgggggtgcccaagggcactttacctcgggcagtggccagcggggggcctgaaagggaggacagagctcaggcagcctgttgttgggggagggctgaagagggcagtatgggcagaggccttagggcgggagtgggtgga

SEQ ID NO: 22686 - DNA, 1092 bp, Homo sapiens
ctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcacagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttcactttgcccaacgtctgcttcgtgcggatcctggaggtggttgctgggggtgggctgggtggaggccatcacagctcctggttacagagcatctgccagggcactggtcaggcattactgcgtcttcccccacagtcccgtctattctgcatccatgctctggtgtctcgtacggtcacctcccagccaggcgagtttacacccatcctttctgcagggagagacaggccccagatacctcctggcttcaggtctagggtctcaggatgctggatatggagtggctctgcccagtcgcccatcgctcaacaggaacagatcccagcctgtccctggcagccccaggtgttgtgcaggtgggagtatgccccgggcccagccagcactgcaggagcctggtgggcggcttgttcccctttgccagcaggggcctggggggccatgggggtgctgttgcggatttctgagaggtctgtttttccctttaggaaaggggggagcaggccgggcatggtggcccacacctgtaatcccagc

SEQ ID NO: 22687 - DNA, 1024 bp, Homo sapiens
cctggctcagcactcaggaggaatcagcaggccggggttcgcatcccagcactctgctccatctgccctgtgaccttgggggagggactccccctgcctgagcctgggtgtccccgtctgaagactgcagatcataattggacccacattggaggccagggtgagggcacggcaggcagtggcggacgcgtggttagagccctggccgtggtggttggaactgcccagctgtggggaggttgtctttctgcccctgtgaatggactgtgtgaccttcacatggcaccttccctctccaaggctcagtttctctgctggaacatggagtcattccctgggctactgcaggaattaagtgtaggcgagttacctgtttacacaggacttggtccatagcatgagctgctttgtagaaatggttcatgacccagcgtggtagctcacacctataatcccagaactttgggagacccaggcaggaggatggcttgagcctgggagctgaagactagcccggacaacatagcaagactccatctctacaaaaaaatttaaaaatcagctgtgtgtggtggtgcactcctgtggtcccagctactcaggagcctgagatgggaggatttgcttgaacccaggcagttgaggctccagtgagccttgattacaccactgcacttcagcctgggtaacagagcaaggccctgtctcaaaaaaaaaaaaaaggttcaggtgtgagaggcagtgtggtattgtgacagagaagagcatcaagtctggtggaaactatcgggcacggtggctcatgcctgtaatcccagcactttgggaggccgaggtgggcagatcacctgaggtcaggagttcaagaccagcctggccaacatggtgaaaccccctctttactaaaaatacaaaaattagacggttgtggtggcgggcgtctgtaatcccagccactcgggaggctgaggcaggagaattgcttgaacccaggaggtggaggttgcagtgagttgagatcgtg

SEQ ID NO: 22688 - DNA, 1031 bp, Homo sapiens
ggaggccgaggcgggtggatgacctgaggttgggagttggagatcagcatgaccaacatggagaaaccccgtatctattaaaaatacaaaattagccggatatggtggcgcatgcttgtaatcccagctactcgggaggctgaggcaggagaatcgcttgaacctgggagggtgagcagagatcgcgccattgcactccagcctgggcaacaagagcaaaactccatctcaaaaaaaaaaaacgaaagtggaaagggtggtagagggggctgaggagtttggaaaatcttgctgtcagtagggagccattgagtgttgagttggggtgggggtgttatggttggcacatttgcatagttactgaggacaggttaggaggggccctttctccctaatgccctacactgttcccaaccattatagtgaagctctttgaggtgattgagactgagaagacgctgtacctggtgatggagtacgcaagtgctggtgagccgcccaccctctccgccctgcccctgtgccacctccccctgccgctgcacctgaccctgaccccgctcggcctctgccctgcaggagaagtgtttgactacctcgtgtcgcatggccgcatgaaggagaaggaagctcgagccaagttccgacaggttggggcagggctgagggtggggctgactgggtgcctgggtccctgggagggcgtctgagagctgggcatggtctgggctgtccagcgacctgggggcggggcttaagtctgggcaggggtgaaggtgcagagctgggtgtgctgggcatatagttgcccagatgtgagggcatccggatgtaggtttgcaggtgccccgttgggtgggtgagaggatgtttgggcatgaaggcgccccggtgggcaggtgttgcatgtgtagggcatgtgggtgtgcccagcgcgtaggtgtgtgggtgatgggggcacgaaggtgccagggtgccaggtgtgagtgtgccggagtgtgattcaaaagatgtgtgggcagtagctatgt

SEQ ID NO: 22689 - DNA, 1031 bp, Homo sapiens
caggagttcgagaccagcctggccaacatggtgaaaccctgtctttactaaaaatacaaaaattaaccgggtgtggtggcaggcacctgtaatcccagctactggagaggctgaggcaggagaatcgcttgaacctgggaggcagaggttgcagtgagtcaagattgtgccactgcactccagcctgggcgacagagcgagactctgtctcaaaaaataaataaataaaattgaatgtagtaatgattgtgcaactccgtgcatatactaaaagccatcgaattgtgcacttcgcttcaaacaaaacagttcctgtcttcccagactaacattcctactggggccaggcagctaacaaaacaataagcaaactagatatgatatcagatgctggcctgtgctatgctggggggaatactgtaaggggatgggaggtgtgggctgagttgttgcttgctttttttttttccccctttgaactttttattttgaacgattgccaatctacggaaaagttgcaacagtagagcaaataacacatggtatgtttcaggagcttcacaatcgctggcctgtgtccacatttgctctatctgtctgtatttgcacatgatctttgctgccctcatcggcattgatggcgcatttgacagttagttgcagacgctgtgtccttttatccctaaaggcgagagcgggttatctcctgagaccaggggcgttttcctgttgacggtgacatacaggaaatacagcagtggtataatcctggcctctacgccatggcccatactcagatttcatccatcatcccaggaatatctttggcagctatttttttttcccagtcggggatccactcgggtccctgcgttgcatttagctgcgccatctcttgtgtctcctttcatccggaacagttctcagcctctcttttgtctttcatgacattgacattatcgattagttcaggccagttaattttgcagaacgtccctcaatttgggttgcctggtgtttcctctcgattg

SEQ ID NO: 22690 - DNA, 1029 bp, Homo sapiens
gagccatgatcaccccactgcactccagcctaggcatcagaacaagaccccatctcaaaaaaagtagaagggaggaggcattaaagagaataaatcagtgaaggagaaagaagaggtacaataaagcaacaaaacctaaagttggttttttgaaaagattaataaaatcagtctgggcgtggtggctcatgcctgtaatcccagcactttgggaggctgaggcgggtggatcacttgaggtcaggagtttgagaccagcctggccagcatggtgaaaccccatctctaccaaaaatacaaaaaattagctggatgtggtggtccacacctgtaatcccagctactcgggagactaaggcaggttcacttgaatctgggaggtggaggttgcagtgagctgagatcatgccattgcactccagcctgggcaaaatgagtgaaactctgtccaaaaaaataaataaataaataaaatccaatggacccctggtaaaaatcaattaaggaaaaaagacagcaaacatgaatcaccagtatccacaatgaaaaggggaactttgttctaacattaaaagatagtaagatgatattaggaactactttgtgccaataaatttaacagcttagatgaaatggacacattactttaaaaacacactgtatcaaaactgacacaagaagaaatagaaaacctgaacagtcttatattcttgttaaagaaattgaattcgtaactgaaaaccttccctataaagaaaatttttggcttggatgactcccaccagtggaattcttccaaacacttaaagaagaaataacactaaccttagacaaacttccagagaatagaaaaagagggctctcttcctaacatgtttatgaggcagcataatcctgatattccctgtgttcccagagctcacagcccagtatgggatggggacatatatgagaacagacattgacagcacagtgattgaagctgcagtggggagcccaggggcctgtgggaacccaaaggaggaggca

SEQ ID NO: 22691 - DNA, 1047 bp, Homo sapiens
actggcccatgaggctgcacccctgcccgccgggcggccccgccccaccaccaacctcttcaccaagctgacctccaaactgacccgaaggtgagctccgcggggatggcaggggcagggcggggcggggggccgatgggacctaacctgtcttccactctgctctgtctcctgtaccccaacatttcctcttcctcctcctcctcctcctcgtttcctcctcctcctcctcctttcctcctcccctgtcacccctcacctccctcctcacactgcagggttaccctcgatccctctaaacggcagaactctaaccgctgtgtttcgggcgcctctctgccccagggatccaagatcagtaagtcccgtccatgccctgttctcgctggctctgcctccctgcctgcatgtctgacctgtgtgtgcgggcattgggagggggctctgtggatgtgagggtctgtgcgtggggtctggttgttcatttactcacagaagcacagcctatggagccagactcgggggttcaaatggcagctctgccaagtgaccttgagcaagtcactcaaggtctctgggcctggttttcctcttctgtaaaatgggtatagtaataacaatacctgtctcctagggttattgtgaggactaaatgaagtgacgtatggactgagcgtagaacattgccttggaaagtgctttacatgtgtattagttattaattgctattattcattgagcccctactgtgtgcctggcactgtcctaggccctgtagtagagggtgagcaaaatgtacaaaactcctgccctggcagacccaacattctactaagggatctagacaaaaaacaaagaaataagtaaaatatacttactatatagactgctaggtagtgcgaagtaactaagaagaaaaatagagtaggagccaaatttggtggcttatgcttgtaatcacagcactttgggaggctgaggcgaggggatcacttgagcccagaagttcaagaccagcctggacaacgtagcaagatcctatctcta

SEQ ID NO: 22692 - DNA, 1030 bp, Homo sapiens
ctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagcatctcacaggttctgcataccttaatgtttagaatctctcctaaccttccttgtagtaatctccctgggaacttttggggacatccctaggcctcaatttcccctctgtaaaacagagggcagattgaactacaagggcccttaatctctgtgactcttgaggtttgaaaaagcaccttaggttcctgagggctttgtcggttcttccatttactcccacctcacttttttttttccctaaaacgtttgtcttttggggcccaccgactgtgtccttgttaacgtagacattggcctgtttgactgggtggaggtgattgacgtgcccaacacccaatgcatgttcagctactgcttgacttctattaactcttctccctccaccaattgctctaccacacctctttcctgttccttcctgggactgagttctccaaaaggcctatccctaaagacttcatggggatgctcagactcacagattggagagggaaacagcttggtcaaagacattgaggtgggaattggagggtgtcaggtgtgaaagaatcagaggagtaatggggaaagaactggaaaggtgagcctccagcaaatggtatgcatttcagtgtggccttgagttgcaaaataacagaaaagctttctaggagaaatggggagccatggcaggttcttgagaaagtaagggactggcagcagctacagagggatgaagtcagacgggacagaaggaggccactgagaagcagaatataggtagatgtgacgagct

SEQ ID NO: 22693 - DNA, 1049 bp, Homo sapiens
ctatgtgtgctagaaaaccctttgggcttggagagtgggagctcggatgggcgtttcaagttctccaccaggctgtgggaactcagatgggcgtttcaagtaccccactagggggtactgaaaaccttcaagtttttcagttccccatagaaaaggggtctaggctgacggtttctaccccctcctctccaaggcggtccccgggttcccaggagtctgtaggtccagacttcggtgacactgacacttccgcccagcgtagctctagggcaaccgcccgctcagcaaacaccccccccttccacctttgctgccccaacaacagtcaggggaggccggggaatcacttaaggggccccgcccaccaccggagttccacccactccgcgtgcctctccctccccccagatcatcacgcctgggagttgcgggagcgggtgcgctgcctcggagtcccgcgtgtatacggctccccagccgtctgcccctgtgtgtgaatccctgaggcggggtgacgctggggttggagtaggagggcagaggtgctgaccttgccctgggaccctccaggcctgatcgcccctgcacgaaccagacccttcgccgccctcacgatgactacctctccgatcctgcagctgctgctgcggctctcactgtgcgggctgctgctccagagggcggaggtgaggaagcgaggagccagaggagctccaggcttggagggaggtatggggacggttttagggcttccgtcgtcagggcgctgtcgctcacgcctgtaatcccagcactttgggaggccgaagcgggtggatcacttgaggccaggagttcgagaccagcctggccaacatggtgaaactccctctctactaaaaaaaatacaaaaattagccgggcgtggtggcggccgcctgtaatcccagctactcggaaggctgaggcaggagaatcgcttgagcccgggaggcagaggttgcggtgagccgagatcgcgccactgcactctaacttgggtgacagagtgagactctgtctcggggtgg

SEQ ID NO: 22694 - DNA, 1040 bp, Homo sapiens
ggtagcccctgagcttctcactctgactccaacagggtgagcttgctatccttgtggcacagggccttttgcattgtggatgatggagcggctcgtatagtccataagttttgtgcgtagctgtgtaccctgtccctgtgagctggttctgcccggcacctcggtgacctcgaggaaagaagctgaggtaagacctggcctgcctggctcctcgacttccttcctcagccctcaaattctggctcccacctcactctctaaatttatttttattttaaatttcattttagagacagagtcttgctttgtcacccaggctggagggcagtggcaccatcatagctcactgcagactcgaactcctgggctcaagggatcctcctgcctcggcctccaaaaatggtgagattatggacatgagacactgcactgggcctattgtgtatcttgttggcctaaaattgaaacatgccttgtgagcgtttactgcaacttcaatgagtgattattatgttgcctttaatcctgagagactgtattacttgtgcactttttttttttttggatagggggaaattagatttattccctatatgttttagaaaattgaagttttaaatatcagactcactagctgccctgatttaatctgttacaattaagtcagttaaaaaactcctccttggccgggcatggtggctcacacctgtaatcccagcactttggaaggccaaggtgggcaaatcacttgagatcaggagttcgagatcagcctggccaacatgatgaaaccctgtctcccctaaaaatacaaaaattagccaggcgtggtggcgggcgcctgtaatcccagctacttgggaggctgaggcaggagaatcgcttgagcccgggaggcagaggttgtagtgagctgagattgcgctactgcactccagcctgggcaacagagccagaccctgtctaaaacaaaacaaaacaaaacaacaacaaaacccccaggacttcctgtacccacattctagtggggaagacaggaa

SEQ ID NO: 22695 - DNA, 1050 bp, Homo sapiens
agctgcagccacccaagccatggctgcagacccaggcatctctgcactcttaggggcctgggaaggcactccctgccctcacaggcttagaagtgcctcctcctgctgcctggcttctccctgctgtcagcacccactgcaatcttagagcaaagttggggccgagcctaggcactgtcacagcctggctgggtgtgcacatacccggggcagtgctgacacaccagccccctgccacagccccctccagactttgggcaccgatgagcataggaggaaagctgagggggtgctgagggcagcttggtactggcctgcaggtgccctttggcataagcagcctgggcaccatggatggcagcaggaggcagacagcctcctgggcagaagggggcaggtcctggtgaggccccaccttgaggtcagggagggcctgaaggctgggggctgggctgccagtcccaggaccagaggatgaacctgtggtgcctttttggggcctattcatggccatctgtggagcaatcagcatgcacttcctcccctctgtggcccataaaagccccaggctcaaccagcacagggcagatgatgggacaaccagctgcagagcggagctatactttctgctgagagctggagcagatgatgggatgaccagctccagggaggagctaccctctctgttgagagctggacacttgttgggatgatctgcatgcagaaaggagctgcctgctgcaggagactgagctggtctattgctcagtaaagctcctcttcatcttgctcacccttcgcttgtctatgtacctcattcttcctggtcacaggacaagaacttgggacccactaaatggcggggctaaaagagctgtaacacaaacagggctgaaacatgccccttgcttaccacgctgcaggcaaagagaaggagacaagagctgtggcccttcagggagcccagacttgggagctccctgagccagggctatgactccctcttggggccctgcagctcctggtgtctccaggcatctggatgctacc

SEQ ID NO: 22696 - DNA, 1080 bp, Homo sapiens
taggttttaggtcaggtgagagttgaagaggttttaagttcttaagaacacaggctaagggagaagaaggaggaatggagggtggaaggttgcccatagtgaaggaggcaagcccagagaaaagagagggtagagacatggaggaggagggagtggtacttgccacccaggggaggtggtgcttgccacccaggggaggtggtacttgccaccaaggtgaaggatcaaggcaggcatccccgcagtgatcagacatccctgaaatgtgggtgaataatcaggcaggcatccccacagtgattaaacaccaacggaagactgtctggagtgaccagcgctggagttttgagtttatggataaaacacgtctcttctgtctctaccagaaagggaaaggaaccaaaattaaggaagggagagattgaagggtggagcaacagcaagagaggttggagaagagagtgaaaagaccgcttacctgatttgaaattggtgagatgttccttgggctggttggtctgaggacccaagatggtaggtggatctcctcatggagtgagggtgaggacaggggactggtctcccgaaggagtccccctcccccgggtctttggcaccaaatgtcacgtgtgtctgtatgaagagaccaccaaacaggctttgtgtgagcaataaagctttttaatcacctgggtacaggtgggctgagcccaaaaagagagtcagcaaagggtggtgggattatcattagttcttataggtttggaataggcaatggagttaggagcaatgttttgtgggcagggggtggatcttaccaagtacattctcaaggatggggagaatattacaaagtacttttttttttttttgacggagtcttgctccgttgcccaggctggagtgcagtggcgcaatcttggctcactgcaagctccacctcccaggttgacgccattcttctgcctcagcctcccgagtagctgggactacaggtgcccgccaccacacccagctaattttttttgtatttttagtagagatggggtttcaccatgttagccaggatggtctcaatct

SEQ ID NO: 22697 - DNA, 1066 bp, Homo sapiens
gtcattggtgatcaacttaaccttcagcccttctcccctcccggaggttggagggtggggctgaaacattccaaccttacaggcccactttggtcattccagtgaccagcccccatcctgaagctacataggggtggctagccattagtcaacacatgagcatgcaaaaagacacatcactttggagattccaaagattttaggagttatgtgccagaaaacagtacatgatgaatatcaaacctgtatttcatagtaccactggccacccgtggtcttcaaacacagttccctcatatccaaagaatatacaactcaaaaggtattactggccagtttgttactagaactccattaggtcattaataattagttcatcatattatatgattatgtctcccagggtgagaccagtcaggtttgcaggtttctattcagtcttgccaatttccaaaagcaggcgtgatctcagcaaatatatggctcccccctttcaggcattaggtataattgagataagagacaatgtcacccttgttctgagcctctttcaaagtgttaatgtaatactggagatttcttaattcataactcatttattcattcgtttaccctcgtaaatgttcctccgtttcttcatttatacctgttgtcctaaaggaagaaactgaggcaaaattaatataagtagagattttatttgggccaaggttgaggaccagcctgggagcctcaggttatctcgggaagtgctccagagaacagataagctcaagcgtttaaagacaaaaggataaatcggggaggagtgattacaaagggtgtctttcaggaattctcattggtttaaaaaataacattgatcagtaattggctctgcgttattaaattacagggtgtaagtgatggcatccgtgtatggcattgtgaggttgatgtgtagctgtctctggactcttactcttgagtccacagggtcagtggcttcgggggatgagtttttctcaagatggggagtgggacatgactgctccctcattccagttcctctctaggctcaatcatt

SEQ ID NO: 22698 - DNA, 1066 bp, Homo sapiens
ccagtcccccagttttaccaaagacactaataatagcaagaccaatttattctcaaaataagttttagtgttatactttatttgcataaagtacagcaagattagtgactgaccatatagactccttttaagttggctttcccggaaaatgaggaatttcggattagactttttttttttttttttttgaggcggagttttcctcttgttgcccaggcaggagtgcaatggcgcaaactcggctcactgcaacttctgcctcctgggttcaagtgattctcctgcttcagcctcctgagtagctgggattacaggcacctgccacacacctggctaatttttgtatttttactagagacggggtttcaccacgttggccaggctggtcttgaactcctgacctcaggtgatccacctgcctcggcctcacagagtgctgggattacaggcctgagccactgcacccggcctgtaagatactttttgagaagaattaaagtaaaacaataattgcctgtgtatgacagaggacttagaacagccatggttaaagactcaattgaccaggaaatttggctatttctgcagcatataatttaacataataatcataattaataactgataacatatacgaggacatagtttcttttttagaaatctgtacaattttggaacatatattaatgagacccatacaaatataacaaaaaagatcagcaccatttcctacgtgacaatacttcccatatggtttttaacatcccagataagcctaatatgtctctcttggtcttccggggtccctgacatccagaagttagttcgaggtcaaaaagacttaattttagaatttgaaattagatttttctttgaaattagatttttctttttttttttttcttttttggagacaaagtctcactgtgttgcccaggctggagtgcattggcacaatcttggctcactgcaaccacggcctcctgggctcaattgattcttgtgcctcagcctcccaagtagctgggattacaggcatgtgccaccacaccccgctaattttttt

SEQ ID NO: 22699 - DNA, 1034 bp, Homo sapiens
gtttatcttctgggaccacacttgtatatgtgggccactgctgactaaacatcattatacagctcatgactgtgtgtatgtctctctcttttttttttgagatgggtcttgctctgtcgcccatgctggagtgcagtggcgggatctcggctcactgcaagctccgcctcccgggttcataccattctcctgcttcagcctctctagtacctgggactacaggtgcccgccactgcgtccagctaattttttatatttttagtagagatggggtttcactatgttagccaggatggtcttgatctcctgacctcatgatccgcccacctcggcctcccaaagtgctgggattacaggcgtgagccaccacgtccagcctgtgtgtgtgtgtctctctcattagttctgtctctctggagaaccctgactctcatgatggatgtccctcacggggtccttttccggaagacaccacctatgttctttcctgtctatgcttggaacttgggtgcaaacctaggccggatctgggggactccctctgtgctccctggcccttcctgggatctcctgatttttgttctgtggctttgggttccttacatcagagtccagcacagtcagttagaaatgcgtgttgccttgcaagcggatactagtgcctgtacacctacagcatggatctgtgaaagtaacaggaatagtcacaaccactatttcatccagcgctcgccagggcccagggtgtgaccttcatgcagtaatataactcatttcatcttcacggctaccctgcgcagtggagactctctttgtccctggtttataggtgaggaaaccaaggcccagagggtagctcactccactgaggttgcacagccaggaggtggcagctttgtcccagagtcaggccataagcagggcaggcgcagcgggtccgagtttctcggcacagcactcacccttagctcaggcagtgcaccttggtggtctctctgacttattatacagagaatgctgggtatgacttgcca

SEQ ID NO: 22700 - DNA, 1033 bp, Homo sapiens
atgaaatgaatagtgctaagtgccataaaactgaatagagtaaaggggggtgggtgaaggaagacagggaggtcaggaagaggcctctgggccagacctgacccaggaggggactcttcactcactctgtcccgctctcgacctgtgtgtccacacccaagttttccccatccctgggagcgagacccccttctccctcatagtggctgtggtcactgactctcgtgtcccgttgttcacaccctagccattgaggatgagtacagcggacccaagcttgaagacggcaaagtgacaatcagtttcatgaaggagctcatgcagtggtacaaggaccagaagaaactgcaccggaaatgtgcctaccaggtaatgcatctgtcaggtactgggcacccgggaaccctgggatggcatcacagcactgccagccgcgggcactgagcaaaacgacaggagaagggcggccatgacagccaacaccaaacaggagtcgtgtgccggacactgtgccgagggcttaccacatgatctcatctcgtcccacagcagtttggggaggtggcaggcagtgccatttgacagatgcagggacaaagggccagagaggtcaggtgactggcccagggtgaaaggtgaggaagcagtagagtctgttgctttgagttctcatcccaggctcttgggcgtctgtggctgctggttgttgcaggttgtttgggacctgctggttgctcctagtcctgagaccaccccctccccgacctaggagggcagctggccacagggtgttaactggttgagtgagactcaggctctggtatcccatctggacaaggccccctgccctgacctctcagggctacagggaccttaccatagttttggggaactgctgagatccaccacctcctgggttggttatgaggatgcgggacttcttgtgagtcaggttgacaggcaggtgactcttacaggagtgtgcaggcaatatgggaagccgccatttgataggtcctagagagccaagtgg

SEQ ID NO: 22701 - DNA, 1055 bp, Homo sapiens
catttcaatgtcatatgggcttacagcgtttagtgtctcttctttcatgtggcacaatgtgtgtgggattcatacatggatgttgtgtatatcggtagctcaagtcctccattgtctgaacagcccatgacttgtttatgcagtcttcttttgagagacatttgggttatttctactttgtagcttttataagtataagctgctatgaacttcttggacaagtctttttgtgaacatgttttcattgttcatgttgaatttctctattgattgtcttttgtttcattgatttttcattcattattctctatgcatgcttgaggtttaatttgctttcttctggcttctgaagatggacattaatgctgttaattttacatcttttcttccacacaaagcatttaaaactaaatttccttccaggcagtaagttagctgcgtcccgtgaattttaatacgtcgtattttcattatcattgagttagaattgttttctaattttctttatggtttctgattttatccatagattattgagaagggtattgtttaactcccaaatatttggggacttctagatgttactgttactgatttctaatttggtcagacaacacactctggatgattccattggggctatttttagatctgtcttggcaaacatgcagtatgtactggaaaatagtgtgtattttgcagtcgttagtcatagggctctataaatgtcaattagttcaagatggttgagactgctgttaaaaatcttttatagcctattttttctaattgctcaatcatttattgagggggctgttaaaagctccgactatacttgtagatttgcctatttctccctataattctcagttttttgcttcctgtattttgaaatttttattaggcacacatttaggattgttatgctttcttgatgaattgactcattataatgaagtgacttcagtactttttggcttgaaatccctgttttctattaaaatagttaaaccagatttttacagttaatatttgcatgctataacttttctacc

SEQ ID NO: 22702 - DNA, 1028 bp, Homo sapiens
aaattagccaggcatggtggcacacacttctaatcccagctgctcgagaggctgaggcagaagaatcacttgaacccaggaggtggaggttgcagtgagccaaggtcgtgccactgcactccagcctgggcaacagagcgagactccatctcaaaagaaaaaaaaaaaaagaatcttacaatattgtgattgcttttattttctcccagcctttgtgctcttgtcatgcttatgcatctgctataaatacattgttgtcatttccttaaatagacactagtcttctaaagaaatacacgtatgaatacacagaaaatgtcttttatatttaccctttctcttactccttgtttcttcttccatatgtgagtttctatctggtatcatgccccttctgcctgagtacttttagcatttcttacagtgcacgtctgctgtagactaattctctcagctttggtctgcctgaaaatgtttttattttgtcttcatttttaggggtgtctttgctggatgtagagttctaggttgacattgtttctttcaaggctttaaatgtgtttttttcccattgccttttgacctccattgtttctgtgagaactcagcaatcattcatatctttgttctatatagtctgcttttttcttcactggttttaagatgttgcctttgggttttagtagtttgactatgatgggctttgatgtgctttttttgagtctgtgggttaatatctttcattagttttggaaagttcttagccattatttcttatatttcttcccatttctgctctcctctccgtctggaaagctaataacatgctctttgatactatttgatactattccttagatcttaatgacctgaatttttttaattcttttcacgatttttcctctatgtatttcagttcagataatttcagttgtccttatgttcactgattctttgtaactgctgtcaagcccaacaaatgaattatttatttcttacattgtattttttattggtagcattttcat

SEQ ID NO: 22703 - DNA, 1024 bp, Homo sapiens
agttactgagaggacaggttaagaacagggcctggcccacacctgatgctatctaagtatttccccgtgttatggtatctgctcgatgaacggccacttgtagggccactaggcctatgcattgttgagtgggagggcccgtgtcccatctcccccatggctccaggcctctctgaggagagctgaaggaggtggactgactagtccccgcacctccccgccactggctttccgggagacaggaggcagggtcctcagtgccatactactgaggctcagcggccaagctctggctggagccacggtgaggaaaggattagaaacccagatcccttgagccctgccaagtcctcactccctgggaggtgctgacaggaggcttgaggccaggcaggagcagcccatctggcccatcttctgccaccacccccaaccccaccgcaccgcacccttcccctccacgcttgccatgttttcctcagcaggacagatatttaatggtgactttgtggaccgaggctccttctctgtagaagtgatcctcacccttttcggcttcaagctcctgtacccagatcactttcacctccttcgaggtgagctgggaagtgacaaggtttgggttcattgtggggtcctgagtggggcactcactctgcaaggataatagttgcagctgtatttattttgtggactcggagatcatgcacagggcgaccttttaagattgagtatgtagtgcactgcacaaaagcatcacaccaaaggacgcgtttacatcatagatagtgtagaaatggatgtttactctgaccatttttcagcagatggcaaacaagggtgtgaggatgggccccttattctaatttgcacaagggcatgaaacaggctcctgggtggccctaaatctggcactaaagctgagtgactgagtgaacagaccagggctcgagggtgggagtaaggagactgttgacgaggcagttgtgccccctcagattcaggcttggtgtcagatttgggt

SEQ ID NO: 22704 - DNA, 1031 bp, Homo sapiens
atcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgc

SEQ ID NO: 22705 - DNA, 1029 bp, Homo sapiens
ttaccaagttagagttggagcttaggactaagctcctgttgctactctttgattcctctctcacctgccaatccccaactgcctgtcatcaagtcccgtaacccagagtctgtgtagggggctctttccctgggagatgcagtaaaatgaactggattacctttgttgtatactttttcagatataaaataaacactgcctgtttttcaaccattcacatggagattactttataatttagggggatggggttatccagattatattagctacataactaaaaccatatacctcttttaaaaacgatatggaatttttcaagctgagtcattgttgacctaggctctcaaacagcaatggtctgaacagcacttgtattgctggcattaagaaatgcaaacaaataattcgtgttcatcttcccaaaacttttgatccagtgctttatcaggcttcatctataaagaattcttgaagataacttttggcatctgtcaatctaattttcatttatttgcttctctgatactgagaaatgccattaagttgatatattagcagagaaccagatactttcagccatgaagtatcattacaggaaagtaatatttattttagttgaaaatagccagacttgcctatctctctcatcttcctttattgaaacgaacattttctttttatgtactttgcagcagttgtgactgttgtattatagatctgcaggtatttcctgcctcttttgctctcctgatatctctgcattcttacttggatgatgccctcgtcctggccactgtagtaaactggtaattgcatttggacaattgagaggcggcttcctatgatgtaaagaacattgaagaaacctgggtcctagccctagccctgtcatttactagctttgtgactagccaaatcattttcatttctctggactacagttccttcatttgaaaaatgaagggattatactagttggttcccattctgccttattttgtggctaataatacttgattgtcatct

SEQ ID NO: 22706 - DNA, 1039 bp, Homo sapiens
catggtggatagatagagctgaacccttagttctctttgaacaaggttcccttctaacccctaaagtgtgcttgttttaagagaaaggagccggctgggcatggtggctcacacttgtaatcctagcactttggtgggccgaggtgggcggataatttgaggtcaggagttcgaaactaccctagccaacattggtgaaaccccatctctactaaaaatacaaaaaaaaaattagcccaggcttggtggcgggcacctgtaatcctgctacttgggaggctgcggcaggagaattgctagaacccaggaggtggaggttgcagtgagctgagatcgcgccactgcaccccacctggctgacagagcgagactctttctcaaaaaaaaaaaaaagccgtcggtcaaagtcaggaatggctataaaattagtgatgtgttcccttttatgggccaaaaacatcattttaatgagatttaaatttatttaagctttttttttttcttttttgagacggagttttgcccttgttgcccaggctggcgtgcagtggcacgatctcggctcactgcaacttccgcctccggggtacacgccattctctggcctcagcctcccaagtagctgggattacaggcatgcgccaccaccctgggctaattttgtatttttagtagagacggggtttccccatgttagtgaggctggtctcaaactcctgacctcaggtgatctgcccgcttcagcctcccaaatgctgggattacaggcgtgagccacctcgcctggctaagctattaattaaattttttttcccaaagtcctgttttgaagtcctgtctataattaattttatttaaataatttagcaaaagtttgttaagcagaagagggaacaaactagttctttgtagttccagaggatagaggtagaggtctaggtatctacaaggtttagagtgcacaaaacatgcctcttcctctctgggagaatttttatgccgtttataaaacaaaagcaattcttcccttacaggtaac

SEQ ID NO: 22707 - DNA, 1032 bp, Homo sapiens
agaagtatgactaatactggtaaaagtgtctttataatgattgttgcgatatgattgaatttctatcctaatgcttaagaatccttagtgaaaatgtgggaaagaggatgaatcactgttttctcccttcccaaatcccagatgattttgctagaattttaaggatggattgagtgttcaggtgattttgtcttgacttcttgggttggttgggatctttaaagagagagagattaaaaaggatttactactagcaaaactgaaaaagcagaaacatgtctgcttgaattttgagtttcttttctctttgatagtggaagcagcatcttaggccaggttcattttgtaactggtgtgggtgtatgtatgcatgtgtacatccgtctcatgtttgttaaattttcttgactccctaacagttgtttgtactccacatcatcagttttggtaccttctactcgttactgaaaggatatatttaccttctcagtgggttggtgaagatggggggtgggggagcatatatggaaactgatgaaaatgataaaaccgtggtgctccaaagtaaagaaaggaatttttaaaagcctttgaattaactggaatgtgggatcttggattggatcctggtacagaaaaggcaataaatagaaaaactggtaaaatctgaaagtctgtagtttagttttttgtgctaatttcttagttttgacaaatacaccatggttatgtgaacattaggggaagctgggtgaagggtatgtgaggactctgtaacatctgcagcttttttgtatatctaaaattattccagagtaagaaattgaaatagaagctgtgactagcaagagcttccaagggctgtgacttcaccaagggagtgtgttcataagtagggcttctctctaagggcctctagaagttctgcttatctgcccacttccctccttcaactcagtgctctaaccatgtggaatgactaactctccccaaaatccatgcttctgggccgtttcatacacttctcatcgg

SEQ ID NO: 22708 - DNA, 1022 bp, Homo sapiens
gttccattttgtgattaggctgagtatttttaagcacaactctctcccttgtccttagaattatctccagtatcctcaaaacaaagagcaaatgatgcaattaggatgcaatcccttgcctgtggatttcaaggaaaattattttccacactacttggaagctcatggacaaagtcaagctttctttagatctggtgaacttagaaaaaataacttgatgaagtgagattcttaccttgaggttagtttttgagagtggatcaatgatgtgaaatttctaagatattcttgatttataaatatcactttatgactcattccttggagcagtttttattttttcctttgaaaaactttagatgtaattgactttggtttacactctatcctgttttttggtttttttttttttttttttggagacggagtcgctctgttgcccaggctggagtgcagtggcacgatctctgctcactgtaacctctgcctcctgggttcaagcgattctcctgcctcagcctctcgagtagctgggactacaggtatgtgccaccacacccagctaatttttgtatttttattggagatgggatttcaccatgttgaccaggctggtctagaactcctgacctcaggtgatctgcccgcctcagcctcccaaaatgctgggattacaggtgcaagccaccacgcccggccatacttttagtgaaaggaaagccatgtatctttttctgctgtctcctatgtcatgtcttactctgccgttttgtaatggtccttgagattgagataatagagagagattttctagattttcacctactcactgatttttactacaggcattttaattcctttaaatttgagactgattttcttcccatagtatttaacttatcatcatccttataggagggccagacccttaggatttatgtgaatactgctagttggtaggaaaggtacttttcctgaagccttgaaagagtatttccagaatagtgagcttcatatttttt

SEQ ID NO: 22709 - DNA, 1054 bp, Homo sapiens
atgcttttgataatttggaccaagagacatggtattctgaatagcagccaaatatatgaggtcaaggtgacttcctctagcaattaggacagctgtcatggaagagtaggccagacctgatttccttcttaagtccgagggctaaaccagtgataagagatgactcgttgatcttcctgatattactggccaagcactttctaaggaatgacgattgataaggaagaacaaactactattttggtctcttatctaaaggaaaatcatgaagctagcactttatagaaaatgcacttattcagttccttgtatgatcacaaatgttttcttagttatttttgggctccccaacaggatatgttacttatagtttgaaattcgcctttttttttttctctgaaatatatcttgaagtgttgagtggtggctaggtgccatatagaacatacaagcagaattttatagaagtatacatttagtgaggggtggagattattgctttaataaatgggactggctggatgtcattcttttttgtccccttcccagtcactttgactctagggtcttgattaatgtgatcatctctgcagagtgtggagagacagcactgggatgggggtgggaagtgggcgcaaagcctttcttagggcacagacagctctgacagcagtttctgggactgccttcccctctccccttcagcttccgcatctgtgacgtgagggagctggctgccagcattcccagcttggcctgccttccagtggctttcattcagagacagcagatcatgttcatctggaagttttcttagttgttcatctcaagaagaatcttaggaattttttttcaaatcagccagttttcctcagattttgcttcttctttatctgccctgttcctttggctaatcttctgtcagcgagacacagggtcatcagtttaagtatgggaaggaaattatggccttgagcacaggcagaaagcatctggctcccaggcgcttcctgtgagccaccatgaaattacaaagactgggcctgacaaggcc

SEQ ID NO: 22710 - DNA, 1028 bp, Homo sapiens
ttgccctgagtgtttcatagaggtgttaaaaaagaaaacaccctccttctaccttccagttgcggcactctggtggggaccttgtgtcttggttaaacaaatcacaaacaactctagatgcttggtgacagtctgaagaaggcacgtagatatttgcattatgttttattacagcatgtatttgtgactgagaaaccaaaatacttctgaagtattttcctctctgaagtagttgactcttggcataaaatgggaaactttgaagtcctgtgtttctgtttttctaatgaaatatctctgtacagctcaaagataaaagtaattaccatttttaaaggatccttctttcccctctgttttaactcttccatttaaaaaggattagcactggaaaattattagaatggacattcagattctgttgtgtatcttagttgcctgctaagaacactggttcccatcacatttaaactctaaagacattgtgaagtctggatatgcccggtctcctactttctctttctttgtggccttcagatcattaaatttagtgactcagctaattttttttacccacctcttagaactaagttgaatgtatttgtgaccaagcacttaaagttatttcctctaaaccaagtgtttgagatgtttttagatttataacagtctttgtttaccgtgtaattcagtccaattgaggaactagtaaaactgcattatctagacatcaaagctaagaagagtatacttacaccaagaaacttattaggtttctaacaagtggaaagttaccaggtgtcccaaaattaaccacttccatgccagctgattttcactttttgtagctattttaatgatcagcagcattctgggtttaaaaataacagtcgtggctgggcacagtggctcgtgcctatgatcccagcactttgggaggctgaggtgtgagtgggaggattgcttgaggccaggagtttgagaccagcctgggcaacatagcaagaccccatttctaaataataata

SEQ ID NO: 22711 - DNA, 1014 bp, Homo sapiens
atgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctg

SEQ ID NO: 22712 - DNA, 1034 bp, Homo sapiens
tcaaaaaaccaactagaaaaccgagttccgatgcctggttccccaccaccccacctgcttccagtccagttaaatcaaaatcactagggctggtgtccaggcactttgaaaaaaaaaaaaaaagacaaaaaaaggcagtgaatccaacaggctgggttctgttttttatttcctttattagatgtgttaccaagcatttaaaaggtttaaacggctatactagatggtacaactctagtgaacatattttctgactctaaaatctagataagtaactttacatttataaggttgtttatggagaccaaaagagaatatttgaagttgacagcgtagggtcagtaagtagccctccctgctgttcccacagaagatagaatattcttacctttttccattgttgcatagctggtacttgctcatgtggtacctagatgagctttgtttattgtggatatgtcttctgttaccaaatagattggaagttcattgagggcgggagacgactttggtcctagtattagctctgctgccagtttgttatgtggccttggggtgattcataaattcattaaaaaaaaacaaaccaagactcttgccttctaggaacttagcctagtagaatatttgttgtatgtgtacgtaaataactgtacctcattcagtacctacagagggaattaggacttcatctggcggtttttaaaaggcttatgatatagtactgccaaagtatgaacaaggccttctgagcctcacctcctcacacactagtgtgagcagcacagtgtaaggagaaatgagaatctctaccacagagatagtctgcgtctcagctcaatttgagaaaatagaaaggaacattggcccagtacattattggaaactgtttttgttcagcaaatacattgagtgcccactgcacgtcaggccctggaacccaaccatcttcccagctgatagaaggcccttcttttggctcttacctatcccctggcttccattctactctttttcttgccccagtggacttg

SEQ ID NO: 22713 - DNA, 1060 bp, Homo sapiens
gctcacttgcagcctcacctttctggcctcaagcctcttgagtaactgggactacaggcatgtgccaccatgtctggctaatttttgtattttttgtggagacaaagtctcactatgttgcccaggcaggtctcaaacacctggccttaagccatcctcccaccttggcctcccaaagtgctgggattataagcatgtgccactggacccagccagagaccctgtctctttaaaaaaaaaaaaaaaaaaaaaaaagatagattgaatgagtggttttcaatctggaacaccttaattccattttcgtctttcttcaagaaaaaaatgaccatatatttccccttgttggcattagtttgtacttttatggaatttcagaagaaaaattaaacctggtatctgtgagcttagtgtgcattggagggatgtctttgtgtacccttatttcctaagaaaactttttctcccttttataaaattaaagcaagttcattgtagaaattggacaaatggcaagaactgtgaagaggaactcaaagattcgtgatctgctacttagtgaaaaccaccgttaatgatttgagatgtttcttgtagtcttatttctctgcatatacacatatatttattttcacataattcagagtatgaggtaagctagctttcaacatttttttaacatagccctcttagatgaggcagaagaggccgggtgcagtggctcacacctgtaatcccagcactttgggaggccgaggtgggtgatcacttgatgtcaggagttccagaccagcctgaccaacatggcaaaaccccatccatctctactaaaaatacaaaaattagctgggcttggtggtacatgcctgtaatcccagctattcgggaggctgaggtgggagaattacttgaacccacgaggcggaggttgcagtgagccgagatcgcaccactgcactccagcctgggcgacaaagtaagactctgtctccaaataaataaataaataaagcatgcatgcatgccaggcatagtggtgtgcacctgtgatcccagctat

SEQ ID NO: 22714 - DNA, 1035 bp, Homo sapiens
acttttgtgggtggtggaagtattccatattttaattgtgatcatttcactcatgtattacatatttcaaaattatcgggccaggcgcggtggctcacgcctgtaatcccaaaactttgggaggccgaggcaggtggatcacaaggtcaggagatcaagaccatcctggctaacacagtgaaaccccgtccttactaaaaatacaaaaaattagccaggagtggtggcgggcgcttgtagtcccagctactcgggaggctgaggtagaagaatggcgtgaacccgggaggcggagcttgtagccagccaagatcgtgccactgcactccagcctgggcaacagagcaagactgcgtctcaaaaaaaaaaaaaaaattatcagatggtatactttaaatggatacagtttactgtatataaattatacctcaataaagttgatttttaaaaacaaaacaaaaaagaagtcattggggaacagttttgaagaaacttgctgtttatataatttcaaaatatcatctagcgcattaactactagttacaaagggggaccacacctttataatttaaagatctgggtattaccaccttaccaaagtagttacactcagcatctctactggatgaacccgacattgtgttgtgcctcctggccaaaaatatttcacctgaattttatcagggagaagcaatcagacaaacccagaatatgatacatttataaaacaagtggcctgaactcaacaaaaaaggggtctcatgtgacttctccatttgtaccgtgaactcgttttccactagcctagtcagatgtgaaacccatgaaacttggagtcacagctgacaccccacctttgccaggcaggagtagctggccaaccataggcaagacacctaaactttctaagcctcatttttctgttccttcaaattgggaattaaaataacaactctttcaaagggagtttttgacaattaaatcctgtttgtaatgttcttggagtagtgcctggcacatagtgatcattcggt

SEQ ID NO: 22715 - DNA, 1051 bp, Homo sapiens
ccttagcaccttcacacggtgtcgtgcctctgcgtcgttgttaaacactgttcctgctgcctaatatgttgtttcctctcccatctaacacattcccatcctttccgaagccttcacactctagacatgcctcgattatagtagctgtccccttgtgttagggatactgtttctgtctgtcactccttagaagaagagacaggagggagcttgctctcctccctctgccatgtgaggacacgagaaggcagctgtctgtatgtaagccagcaggagggccctgccagaaaccaaataggctggcccctcgatcttggacttcccagccctcagaaccatgagaaaaagagagctattgttgaagccacccagtctgtggtattttgttatggcaacccaagcagctaagacagatggcaaggtgaccaactcaggcatcagaacacctgagagccttaaggcaggggccccttctttcctgattcatgtgtccccatgggacctggctctccagagtcctccatcagggatctttgtgtccacatgaccagaacacagcaattgggtcagcagaaatgggaattgaggcaactgaaagtcagaagggctgagacaggtggacgaagacgtggacaaatgccacttgagagccgtggtctgaagagatgagctcacgcctttgtgtagtgcccggctcccaggtggtttactgtttgaaatgtaagctgactgggtatcagacaactgaatcccactttttcaaacaaagatggtgcaaggccttgtgatttcaccccagtttgcgttctttcactcttggctggcatcctttggctatttaaattcgtagcctcccaacagtttttaaaaaacaaacaaactcacacaatttatcttttcatgtaagctgcaatttggttgaaacaagacctttctagtacatagtccaaagctcctgataactgaaactacaatcagtgtttctgttctgtgatctgttttttgttttaaaagccacaacagaaaaccttttcttctgttacggctgtca

SEQ ID NO: 22716 - DNA, 1030 bp, Homo sapiens
cctgtggatggtgcagagtctatacccttcatcaggagatcagagtgaggggcgtctcctcccctgaaaaagttagagatcactgttcattcacagcgtttgtggaaactataccactgatcgagagcaagccaggacgatgatgcagccttgttctcaagggatttataatctagtaagggtgaagatttcaccctaaaccatgtagagcctacaaaaggaggtcagggaggccagggagggctgggaggtagagttgttgggacttaaaggatgactcgaagtggaatgattgagcctagatcaaatcattttctcttcacagctctccgtgacaggagactgcatagcttccctgtgagtccatgggccccaaagtgattataactgacctctagcttgactgtgcccatcccctgccattggatcctctccaaaacagacagtcattgtcacgtatactcacacgacacacagggaaaatagcaaccaacaaactgtttccatgtgttagagtggtagaacctggctccatttccagtgtctcacctccatgtgtatgaactaaaaataggcaaacttggctgggcgcggtgactgacgcctataatgccagcactttgggaggccgaggcaggcagatcacgaggtcaggagttcaagaccagcctggccaatatggtgaaaccccatctctactaaaaatacaaaaattagccgggcgtggtggcgtgcgtctgtagtcccagctactcgggaggtggaggcaggagaatcgcttgaacccgggaggcagaggttgcagtgaactgagctcacgccgctgtactccagcccgggcgacagagccagactccatctcacacacacacaaaaaaaatagacaaacttctggggggtatcagggtgtaatgactcccttggttttttgggttttttttgttttgtttctcttttttggggtttttttttttgagacggagtcttgctctgtcacccaggctggagtgcaatggtgtgatctcggctc

SEQ ID NO: 22717 - DNA, 1044 bp, Homo sapiens
tgcactctggcctgggcaacaagagtgaaactcttgtcatctcaaaaataataataatatttacagcatcttgacagactcattaatgatgtcattaccccattttggatgaggattccaagcccctgagaggagaggcgatttactctcagacacccagcctagctataagacagaaccaggatcagaaccaaggtcattttggtgtcaaagccatgcatgttttaaaatgtttttctacaaactgtcttgttttggccacgctctcagaataggtcatgcctacaggcaggtgccattgttgaggcttgttaagagtgtagagaaaaaagaatactggcaggcattgtgcagtggactgtgcatagacgatctcatttattccattgtacggtcagattagctgaggtcaggggcaggattcgaacccatgtctccctgacagcagaactcaggtgctcatccacttgccaaccagctttccacttagatcattaggataatagctactctctcagcactaagtgctaagatctcattaaatacataccaccaggggatgaggtgagaactgttatctctgttacacatagaaggaaatggagacatgattgctttgattttgacctaaatgctctcctgccccctcaccctttgatcttccattgaggtgagattgggggagtgccgcagtgtggtcctcagaagacacaccatagatacactgttagcattggatgaaaaagaagggcttcatacctttccacagaggtcggtcctcttcaagaccatttgaatttaatgctcaaagagtttccttctctccctgagtgctcagcacccctccggccttgcagtttagcctgccttagacttagtcttgcatgtgtaaaagaaaaagggaatggtttattagatgcttccagactccagaaaagtcgacaaaagttgttagttaagtcctgcctggcatggggtgttttagagtactagcagtgccaattaaatttttttaaaggactaagtgctgagtttctatatcta

SEQ ID NO: 22718 - DNA, 1050 bp, Homo sapiens
cttagcagctatgatctggggcaaggacttcacctttctgaatcttagtttcctcatgtgtgtattctctacctacccaatagctcttcccatgaggtgtgggagattaaatggcatcatcgtttatttaataaacaagcaaatggtggatggggacaaagcacctagctcagtgcacagcgtgtgaccactctgatatggaaagtgccagcactctcccaggcgagtacagcagtggcagctcctttgtaactaggcgttgcttggtaggatgtccctggggttggtccattaacctccttttctctcggggaaagggccttggtgcaattaacagcttttaagccagagaattgatgcctcttgctccagtgttcttgaagcctcaagaagtctgggacccccagaaaacaggcaggccagttgcttttatcttgcctgatggctgtctctccagaggtagcagtgacaataacaaccaacacgtggctctcggaagcctgactgactccagggcccggtgctctctactgtcggcactgtttctgttgtccaggggcagcacccacagtgcttcctctgtgcaccttcagcaagacagagtcgctcaaagccagtcttcagaagggacccagggttgctttagccatgagaccccatgtcagttttcacagtgacttcactgtcctttcgacaaagtccttgagatcttgatggctcacagtggacttcgttcccaggacagggtgagtggactcagtagacagcttggaatccactctaagctgaacagtgctcctctgcccacggtaggatggggagggagtgggagcccatccttcccttgatattttattctaacttacgtatttaattgacttttactactttttttcttgtatcacactatacaccaaataagttccagaatgatcacagaatgaaatgatttttttaactgataaaaagaactagaaggaaaaaaaacaatagctgatacaggaataggaaaaacctattctaagcataaaaaccaaggaagacatcata

SEQ ID NO: 22719 - DNA, 1024 bp, Homo sapiens
aaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagct

SEQ ID NO: 22720 - DNA, 1027 bp, Homo sapiens
ggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagtttt

SEQ ID NO: 22721 - DNA, 1026 bp, Homo sapiens
tttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggtt

SEQ ID NO: 22722 - DNA, 1070 bp, Homo sapiens
gagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggat

SEQ ID NO: 22723 - DNA, 1655 bp, Homo sapiens
gctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgatt

SEQ ID NO: 22724 - DNA, 1030 bp, Homo sapiens
actttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgacc

SEQ ID NO: 22725 - DNA, 1217 bp, Homo sapiens
cacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctccctttttttttt

SEQ ID NO: 22726 - DNA, 1052 bp, Homo sapiens
cctaaaagttgtggctggactgtgggcggggccatagtgttgcttgttcagctgtgtggcggggctcggacgccgggcggaagctctgtgggcggggccagaaagttttgccttactggaagtgggtccagattcttggccgggacgttgggggcggacccagaggctgacgcaatggcgggggcggggccacaatgtagtgggggagccagggggcggggccagggtgctggcggggaatgctgggggtggagccagaaagtttcgtctgagccacgggcgcggccagagcgttggccgggaggcggggaagcggggagttgagccagaaccctggggaagccatgggcggggccagatgctgacgcaacgaggtgtgggagggagtcagggggcgtgtccaggaggttggccaggccaatcggaggcggggccagagggttgactgggcaggccgggggcggggctggaataataataagagatggtaggggcgggtgtaggctgttgcctgcgagccaggaggcggggaaagagcgtggctgggaaagtcgggagcggggccacattaatggcccatgggtgggggcggggccagaagtctggcgggaaaggcggggccagaaagttttttcccgagccgtgggcggggccagagcggtttccaggatgtcggggacgtggccctggcattcccagccggattgaggctggagctttgcacagaaaatctggggcgggcctgggtagttttgtccttgttggggcgggtggagtattcagtggggcaaaacgccagttccaggaagcctcgccagtgagttctgggcctgtgtacagaatcctttcgggggaggcgggaggctgtcgaccttccgtagggcgctggagacgggactaggacgtccctgaggaaggcgcgggcttggaatgttctctgagagcttgggcagccaataagagtggggttcggactttctttgagcgtgggattgggaatgtttctgaaccttacctggtggagctagaatattcgcctggatatgagaggc

SEQ ID NO: 22727 - DNA, 1052 bp, Homo sapiens
agagagggtggcaggggagctggtttccacagggtgctcagggaaggcctcacgagaaggcagcattggagcagagacctacaggaggtgaggggttggagggtctctgggaaaagtgttcctggcagagggatccgctggcgcaaagcccctgaggcaggtttcagcctggtatgttgtgggaatagcaaggaagccggagtgatcgtggggagagggtgagagatgaggtcggggaggtaccaaggccagaccccacgggtcccacaggctgtggggaaggctgttactcagaggggcaccacaggaacgttctgagtggggctgcaacgtgctgaggtttgagggatatgagcggccttcttgttcagagtccaggagagaggcctgggctggggccagacttaggaggagttcaggggtctgggagtccgtctggcagacagggcacctgatgcttccctaccccggctgtctgctcctaggagattgaggaagaccgtaagaaagctgaacttgagggagtcgcagtcacagctccccgaaagggccgctcagtggagaaggagaacgtggcagtggagtcggtgagctcgtcactggggtgtgggaccctgaggatggggaggggcagagggttgaggcctgggacccaggagcccccagctgtcctgcaccagtgggtggcctccatcctggccgcatgcctccctgccccagtgactgtattttccccatctcccctcttccaggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggtaggagctaggcagcgcctggagccctggctgaggttctctgttgtc

SEQ ID NO: 22728 - DNA, 1070 bp, Homo sapiens
attttttgtttgtttgtttaatagaaatggggtttcacactatgttagccaggctggtcttgaactcctgggcttaagtgattttcctaccttggcttcccaaagccctggaattataggcatgagccactgtgcctggccctgcctctgtggttctgtagaatgaagatgctaatggtacttcttcatagacttgctctgaggaataaataaactggtgatctcaagccctgagaacgatgtcacatgttctctctctccaccacctctgtccctcagggtttaaaagccccagctgggatcctctggggatagcaagtcagtccaaagccctggccaccagcaaatggtgagtttgagggaggggcctctccatttcggttcccactggcccccctctctttggttttcatctctcttctcccagccccattttttcctactctttcgtttccttgttgctgtgtgtcctggctcttttctctttctgtgtttgtctctctgcgtctcagtctttctgtgtcctgtttatctctctggtgtctcttggtattgtttctctctcccactctgtatgtctctgactcattctgctcattctgtgtcctccctattgctctctgtccccagctcgttcttttttttttttttttttttttagatggagtcttgctctattacccaggctggagtgcagtggcggtgggattacaggcgcccaccaccatgcccgtataatttttgtatttttaatagagagagggtttcaccagagtggccaggctagtcttgaactcctgacctcaagtgagcttcccgcctcggcctcccaaagtgctgggattacaggcgtgagacactgtgcccagccccagctgattctctttcttctctcctccacacttatcttaccccaacactttcttccaccttgctccccttcccctgcccccgcaccccacagcttccaggtccctagtctcagtgtcccctgtctccttccctttatctcttccttttctcctcctatttctcttggtttctcttttggtctccattgtttaatcttc

SEQ ID NO: 22729 - DNA, 1044 bp, Homo sapiens
ctagaggtcgcctgtctactttgagcagaggaaactaatctatatttttacatttagttgctgggagtttgcagacacttccagagatgtgggaggtaggagtgtggggatgagaggtggagacgtgtgtgtgtgtgtgtgtgtgtgtgtgtgcgcgtgtgtgtagtttagctattgcctttactcacctcagctgtacatagagcagcgatcctcaaacttactagtctcaagactctttcattctttcttttttagacagggtcttgccctgttgcccaggctggagtgcagtggcctgctcatggctcactgcagccttgaactcctgggctcaagcgatcctcccatttcagcctcccaagtagctgggaccacaggcatgcaccactatgtctagctaatttttaaaatatttagaagagatggggggtcttgctatgttgccaggctggtcttgaactcctagactgaagccatccacctgtatcggcctcccaaagtgctgggattgcaggtgtgagccaccacacctgggtgagatgaatactattataaaagagcaagttcagcccccttttgcctctttgcctttctgctctctgctatgtaaagataaagcattcctgctctgtggagcaggaattcaaggaggtatcttggcttcagaatcacccaacctgccagtaccttgacattggacttcccagcctctagaaccatgagctaataaatttctctttataaattcaaggaggtatcttggcttcagaatcacccaacctgccagtaccttgacattggacttcccagcctctagaaccatgagctaataaatttctctttataaattacccaggctgtggtgttattttattttttatttttatttatttatttatttatttttgagacagagtctcactcttgttgcccaggctggagtgcagtggcgcaatctcagctcattgcagcctgagcctcccgggttcaagcgattctcctgcctcagcctcccgagaagctgggattgtaggcacccgc

SEQ ID NO: 22730 - DNA, 1080 bp, Homo sapiens
gagaaagggcgtggtgactcactcctgtcatccacagcactttgggaggctgcggtgggaggatcacttgagcttgggaggtcgaggctgctgtacgccgtgattgtgccactgcacttcaggctgggtgacagagtgagaccctgtttcaaaaaaacaaaaatgaattttttttttttttttttgagatggagtttcgctcttgttgcccaggctggagtgcagtggtgcgatcttggctcactgcaacctctgcctcctgggttcaagcgagtctcctgcctcagcctccagagtagctgggattacaggcaggtgccaccaccctggctaattttgtatttttagtagagacgggatttttccatgttcgtcaggctggtctcgcactcccgacctcaggtgatctgcctgcctcagcctcccaaagtgctgggattataggcgtgagccaccatgcccggcctgaaaaagcattttttttttaatgagaaagatggagaaagtcaaatggagaactgaagagagatggagaaaggaagagttggattacagagaaaaatcagactacagaatgactcataagtgaagagagatgcgagctgactaggacagggaagagagatgagggtgatgatgaacaagacggactgaaaaagagacagaggcctgaagatggagtggagagagatggaggggacagagggggaaacaaacccactgaaggccatgagcccagggcaaataggccaagagaccaaaagatggtcagagacacagttatacagaaactagaagatgcagacaatctagaagccaaaaaagatagataccttgagaggagcgggatgctgtcagtggggcccagcatgcataagcagtttctagcctcagaagaatgctctcattttctttttctttttttttttttttttttttttttgagacagagtctcgctctgttgcccaggctggagtgcagtggctcagtcttggcttcctgcaagctctgcctccagggttcgagtgattctcctgcctcagcctcccgagtcgctgggactacccgagtagccaggt

SEQ ID NO: 22731 - DNA, 1048 bp, Homo sapiens
ccatcccagccaccccccatcttcctggcctctttggcagctccaccctgtccccccaccccacaaaggggggctacgcagtcactgacttcctcacctacaactgcctcacggtaagcatgaaccctccttccctgaaggtgggatttcaggaagaccccaccaccccgtttcaccttagtccagggacatagttcccaagtggggcccgtggccctgagggcttctgggaagggtcccgggggggcacttgggtggtgggtggcacttggcgggggcccagccctgacagctggcctgccacagaatgacacagacctgtacagcgactgtctccgaaccttctggacctgcccccactgtggcctgcatgcgcccctcacgcccctggagcgcatcgcccatgagaacacctgcccccaggccccacaggatgggcccccaggtaagcacaggactgtggggacccggccacctctgcccagccgtctgcccatcccatgatggtctcctgtgcgtgtgagcacttgctagagcttcgaggactgacgacctccacccgctggccctggctggtgccacacacaggccttgtcctgaagatcaggagcccaaggcagggagagcctggagcgccacctctttctgtctgcctgtcccctgtggtgtctctgtgttgctgtctttgtctctgtttctgtctctctgtggctatgtctcttgttatttttctctgtcctgcagctatctctgccttggtcacctccaccctgttgtcacccagggatgccacacactggggttcagtgggggagatagcactggggccacatgcctccatccccggctggctgtgtctgcctctcagtctccatgtctctccttgtgtctttctctctgtctctctcactggcagggatgcggagtaaagacagacctgtgtatttttattaatctgggagggcttcctggaggaggcaaaactgggttctccaaaggccaggagagaacctgagccccacaggtgcctggcatttgggtgcaggta

SEQ ID NO: 22732 - DNA, 1050 bp, Homo sapiens
actgagctcctattgtattgtatacctggcagttttgggagtggggatgtgacatgaacaagtcaaagatccctggctgggcacaatggctcacgcctgtcatcccagcacattgggaggctgaggcaggcagatcacttgaggacaggagttcgagaccggcctggccaatgtggcaaaaatctctctactaaaaatagaaaaatcagccaggcatgatggtgtgtgcctgtaatcccagctactcgggaggctgaggcaggagaatcacttgaacctgggaggcggaggttgcagtgagccgagatcatgccactgcactccagtctgggagacagagtgagactgtctcaaaagaaaaaaaaaaaaaaaaaatccctgcctctggggagctgacctgccagtggaggatactcaaagttgggctcatcagactgtactgagtgctgtggaagaaaacagagggaatgggggcagagagggctggcggtgtgggtggtcattgtaaccggcccttgctgaaaaggtgacatttgaacaaagacctgaaggaggcgagggagcaagccccatcagtgtgaagccctgtcagggttcctagctgcaagaacagcaggtgcaaaggtcctgaggcagggatttgaaaacacttacccagtggcacagccagtaagtggtggagctggggtttgaactgggtagtctggagtcagagtcagattttttttttttttttttttttgagacagagtctcactctgtcacccaggctggagtgcagtgacatgatcttggctcactgcaacatccgcctcccgggttcaagcgattctcctacctcagcctcctgagtaagctgggactacaggcacccaccaccaccatgcctggctaatttttttttttttttttttttttgtatttttagtacagaccgggtttcactgtgttagccaggatggtctcggtctcctgaccttgtgatctgcctgcctcggcctcccaaagttctgggattacagacatcagccaccgcacctggccagtttt

SEQ ID NO: 22733 - DNA, 1025 bp, Homo sapiens
tccttgcaatattaagtattccaatccatgaacatgggatatctttccatttatttgtgtcttctgtaatttcttgcatccatgtatcatagttgtcagtgttcagatctttcacttccttggttaaatttaatttaatctttttgatggtattgtaaatgcgattgtttcttaagtccttttttggttaggttcgttgttagtgtgtagaaacaccactgatttttccatgttgattttgcaactttctgcaatttcaatttgtctgttctagagtttgacataaatagaatcacacagcatgtactcttttgtatcaggcttctgttgctcagcatagtgattttgaaattcatctatgttatgtgtaccagtagttcattccttcttttgctggcaatatgccattatgcagatataattttttcatccattcacctgctgatggacctttgggttatttccagtgtttggctgccatagatgatgctgcttgaacatgcctgtacgagtctttgtgtggacctatgctatcatttctcttgggcaaatacctagaagtggattagtagggtcagatgataagggtatgtttaattttgttagaaactgcccacctgggcgcagtggctcacacctgtagtcccagcactttgggagactgaggcgagaggactgcttgtgcccaggagtttgagatcagcctgggaacatggcaaaacccagtctctaccaaaaatacaaaaaaattagccaagcatggtggcacgcgcctgtagtcccagctactcgggaagctgaggcaggaggacctcttgagccctggaggtggaggttgcagtgagccaagatcatgctactgcactccagcctgggtgacaaagtgagaccctgtctcaaaaagaaaagaaaaaagaaaaagaaaaaagaaagaaagtgccaaatatttttcaaagcagttgtttaccaccagcaatggataagcattccagttgccccacatcttccccaccacttaccattat

SEQ ID NO: 22734 - DNA, 1047 bp, Homo sapiens
ttatagcctttcccagtcattcctgcatccctcccttgaagcggccacacgtctgatatttttcccccactataaatcagttctggatattgtagatttgtttggttttttttttaagatggagtcttgctctgtcgcccaggctggagtgcagtgtggcgatctcggctcactgcaacctccacctcccgggttcaagaaattctcctgcctcagcctcccgagtagctgggactacaggtgcccaccaccacgcccagctaattttttgtatttttagtagagacagggtttcactgtgttagccaggatggtctcgatctcccaacctagtgatctgcctgccttggcctcccaaagtgctgggattacaggcgtgagccactgcgccgggcccatgttctagatctttacacaaatggactcacacagtgtgtagacttttgtgccaggcttcctttgctcagcatgatccatttaagacccatttgtattgttgctgtagaagtccttcattcccttttactgccaaactgtattctgtcgtgtggatgtaacagtgtattcatttacctgttgatggctttctgtgccatttacagttaggggcttttatgaataaggctgctgtgaaatttttttttttttttgagacggagtcttgctctgtcgcccaggctggagtgcagtggcatgatttcggctcactgcaagctccgcctcacaggttcatggcattctcctgcctcagcctcccaagtagctgggactacaggtacccaccaccactcccggctaatattttgtatttttagtaaagacggagtttcactgtgttagccaggatggtctcgatctcctgaccttgtgatccgcccacctcggcctcccaaagtgctgggattacaggcatgagccaccatgcccggctgctgtgaaaatttttgtacaggtgcttttgtggacatacttttcacctcccttgagtaaataccttggcgtgacattgttgggtcatagagttggtatatatttaactttacttaa

SEQ ID NO: 22735 - DNA, 1031 bp, Homo sapiens
atatgggaggtgggatggataaaacttggatgagtcagatgtggggtcaaacttggttcctaagtccccagagagagctgtatcagtgagctgtcactacataacacacagccctggctgggcacagtggctcatgtctgtaatcccagcactttgggaggtcaagatgggaggatcgcttgagcccaggcatttgagacctgcctgggcaacatagtgggaccccgtctctgcaaagaattaaccaggtgtggtggcgtgcgcctatagtcccagctcttcaggaaactaaggtgggaggatccctggagcccaggaagtcaaggctgcagtgagctgtgattacaccactgcagtccatcctggccaacagagcgagaccctgtctcagaaaatcaaaataataataaacagaaaaaagaaaaccatgatcccaacggttagaatttggactgggcgtagctaggtgcttctggcctgggctgggtgtctgtagtcagctgttggacagctggtgactgcgtctagggcttggctggctgttagctggggtgatggggtgatgggcacgtggctctcatcctcttgcaggccagcctgggcttcttcacctggcagctgggcaaagactggaagtgtgccaggctcagaatcacacaccatcggccaggctccttggctcatgcctgtaatcccagcactttgggaggccgaggcgggcagatcacgaggtcagttcaagaccagcctgaccaacatggtgaaaccccgtctctactaaaaatacaaaaattagccgggtgtggtggcacgcacctgtaatcccagctactcaggaggctgaggcaggagaatcgcttgaacccgggaggtggaggttgcagtgagccgagatcatgccactgcactccagcctgggcaacaagagcaagactccatctcaaaaaaagaatcacacaccatcactttcaccacattctgttggccaaagcaagtcaagaagccagcccagggtcaagggctgaagtcat

SEQ ID NO: 22736 - DNA, 1038 bp, Homo sapiens
ttcaagcaattctcctgcctcagtctcctgagtagctgggattaccggtgtgcaacaccatgtctggctggttgttttgtttttttttaatcttcatgtgtgtcttgaaaggcttcccctgccttctgggttgagagcagcaagacacctagctggcctggtgagggtgcacacagtgcaggtgccgcagcgcccccaaaactgctgttttccattgcgtttatctcatctggaaaatgggggtaataccagggtgtttggaaggattcaaagaaccctggtacctggctgaagcaggagatctgttaacccttccagatacacacacaggccatgtgcggcaaacagcaccaaagtggggccggggacttctgtccagcctcactgggctgtggcccaaaagctctgggagtcgccccattagatagcatcaacagtggcaattaaaatgatcacaactagcgtacacactgcttacaaagtactttagggcatggattagaggtgttcctatgtaacagtcccatggaggacgtagtgttatcctccccaaacggaggcacagaggggataagtaacttgtcttagggtacacggctgggaacgggaagtggcagcccagggatgggagcctcagaatcagtcaaggtgcacttgattcctgctgtgagcatgcacaggcagtaaccccagcccctcgcccaatttctttttttctttttctttttcttctttttttttttgagctctgtcatccaggctggagtgcagtggcgcaatctcagctcactgcagcctctgcctcctgggttcaagcaattctcctgcctcagcctgcggagtaactgggattacaggcatgtgccaccacacccagctgttttgtattttagtagagacaaggtttcatcatgttgaccaggctggtcttgaactcctgacctcagttgatcctcccaccccgccctcccaaagtgctggcattacaggtgtgagccaccacgcccggccttcttttctttttgaaatggagtctca

SEQ ID NO: 22737 - DNA, 1022 bp, Homo sapiens
tgaattgcgttcctcttgagttgtagcaaattgtgccagttgagacccctaagggcagtatatacaagcatctttactagacataggctttattcctaatgcgacgggtggtaaatggtaccctagggtgaaaaatagtgccctggggtgcgttttgctgtgcatttctcttattacaagtgaggttgagtagctctgaaaatacttaagccttttgtctttccttttctgtgcactgtctgatcatatcctttgcccctttttcaccagttgtaattcttagtgatttctagagtctctctatatatgagagagatgaactttgtatttggagttgcaactgttttccccagtaagtcatttggcatgtgacttaatttgtggattgtgtgtgtgtgtgtgtgtgtgcgcacttttgatgagaatgaaattaaatttttttaattttttggtatctttaagctttttatgtttaaatgacttcaaacacataaaaagtttcagaattagtacagagagctcataggagttctttactcctcaactagatgtattagttatctattgctatgcaggaaattaccctcaaaacttagcagcttcaaacagcaagtattcacgtgtctcacactgtttctaaacattaggaatctgaaagcagcttagctaggaggttctagctctggatctcccatgaagttgtggtcatctgaaggtcccactgatctggagaacctgctcccacgctcacttgtgtggctattagcaggaggcctcaattgcttcctcagtgggcctctccaaagggcagcacatgacacacagcggttggcttcccgcaaagtgagtgacccaatagaaacagacagaatgctcaggatgggagccgcaggctttttataactaatcttggaagtgtcatataatcacttctgccaaattctattggccacaaagaccagcatatgggaggggactgaacacaaggaggtgaggattgttggtggctgcctcccacgtct

SEQ ID NO: 22738 - DNA, 1038 bp, Homo sapiens
actccagcctgggcgacagagcgagactccgtctcaaaaaaaaagaaaggcaatgagctacctcaatgctgtcttctgatttacccccagtgggtttggggaagcactgtgtgatcaaacacactagtatttctggagtgaaatcgatgggtatccagagtagttgagataaatcatgaccataaataacctcatgtagccgggtgtggtggctcacacctgtaatcccagcactttgggaggctgaggcgggcgatcacctgtggtcaggagtgtgagaccagactgggcaacgtggcgaaaccctgtctctactaaaaatacaataattagccaggtgtggtgtctggcacctataatcccagctacttgggaggctgaggcaggagactcgcttgaacccaggaggcggaggttgcagtgaggtgagatggcgctactgcactccagcctgggcaacagattgagactgtctcaaaaaaacaaacaaacaaacaaacaaaaaacctcatgtcatttcggaccagattttgaaattagatacctccttagccccatttttaaaaagttatgtatataattagagcagtgctgtccaatagaacttcatattttatttattgtttttttgtttgtttgtttgtagagacaggggtctcactactgtggccaggcaggtctcaaactcctgggctcaagcgatccccctcccttggcctcccaaagtgctgggattacaggcctgagccttgttttgtattctcttaatttacttatgtctgaatgagccccacgtggctcgtggcgctgtgccaggcacagtggttttagagttgggggaatttgggccttgctgaagagggtctcaccaagcctatcctgaggattggagggtccagggtgcagtctggtgcctggcaggtagtaggtgctcactgcacacagctcctcccagctcggtcggggggtcctcatcctaaccccgcgggttttctttgccccgattctgcagacgagtacgtgtcttcctcccgctcg

SEQ ID NO: 22739 - DNA, 1043 bp, Homo sapiens
tttggaggttgaggttgcagggagccaaaatctactgcctttcagcctgggtgacacagtgagaccctgtctcaaaaaaaaaaaagttttaaattatttagtcatggtgttgtgctcctgtagtccttgctactcgggaggctgaggctggagcccaggaggtggaggctgcagcatagtataatgatgccactgtgctccatcctgggtgacagcgagactaaaacaaaatacagaactctggctaacaatttacaagccgaatttcactaatgtctgcagtttcctttgaaaaatgtaaaacaggcctggcgcggtggctcatgcctgtaatcccagcactttgggaggcaggcggatcacctgagggtcaggagtttgagaccagcctggccaacatggtgaaaccccatctctactaaaaatagcaaaagttagctgggtgtagtggcagggcgtctgtaatcccggctaggctacttgggaggctgaggcaggagaattacttgaaccccggaggcggaggttgcagtgagctgagatcacgccattatactccagcctgggcaacaagagtgaaactctgtctcaaaaaaagaaaaagaaaaaaaaaacgtaaaacaaggtggattaatgaacagatgccccataaaacaaaagcactgaaatgttaagggcagaatctaggtggtggggtatgggggtatgcacagaaaaattcccttgactttaactgaaagtgtcctaatagggaaatggcacattggggtttcggggccatgtaatggcacaggtttctatcatggccctgcacctgcttttgagtctgtaacttggtattatttttcctaaagcgggtcctccagattataaaagcctcaggcatcagccaggtacagtgactcacgcctgtaatcccagcattttgggaggctgaggtgggtggctcacctgaggtcaggaattcgagaccagcctggacaacatggtgaaaccccatctctactaaaaacacaaaaattacccaggcgtggtggcaggtg

SEQ ID NO: 22740 - DNA, 1124 bp, Homo sapiens
tttaggctgcctgagacatgctccacgacttcctggatgggtgactttgggcaatggacttcacatctccaagcctcagttttctcatcctttgaaatggggttatcacgatacccgcctcatggggccattgtgaggatactgtgagatcatacatgagaaaaacacataaccctggtgcctggaacatggggtggctggttaagtgatagctgttacaggattcgagagcatggactctgggccattgtgctgctgatgcttggtggatgctgttgagtgagtgacttcacctttctgtggcctcagtttcctcatgtggaaaatgggagacataatagtgtctatctcataggtaaattattcagaaaggcatccagcacagagtaagcacactcttaacagctctttcaccggtagttatttaaacatgtattgtgaaatacattcttgcaacttctttctcactacttattctagaaacagagactcggagatctgaaagtggaacagcatcaaacacacacatcacccagaaacctagaacgttagagcttgcaagaagctcaaagaagctcaggcctaatctgaaacctattaacagaacccagttccaatgtaacaaatgcttattgagcacctactatgtgcatgcccttcactggacgtttagaatccgagactgatctcggctcttgaacagttcagaacttaatggggtagacaaagaccaaaaaacaaaaaaaaattatagatagtggcccatagtagtgagagtgagattgagggggagatgagaggaggatacaaagggagtggtcagctccacctgaaagcttactgggtggttctggaaggcttcctggaagaggtaaccagtaagcagaaccttgaagaattttgttgatatgtttatgtatgtatagtatgtgagctaacagacacactaggtttactatgtgcaggtactgtcccaagtgctctacaaatatcagagacagccaaggagcaggagagacaggactatggagggggcgaggacagggccctgggtacactcctgggactgggtagatgatgagatggtctctgaatggggagtgcgggagcaggtggttgatgag

SEQ ID NO: 22741 - DNA, 1046 bp, Homo sapiens
aggctgaaggaagtcagacaagggtttcacaaaagcccacgaattattctagaaaaatgtacggggtggcataccgtgaacttgcaatcttgataaatcaaacatggctgcacgcggggatttcctttgcttccacctgataccacatggtggctgtatgtttattttattcatatttatttgtacattgaataattttctaaatgtgcattatttttgtattttttgagatggagcttcgctcttgtcgcccaggctggagtgcaatggtgtagtctcagctcactacaacctccatctcccaggttcaagcgattctcctggctcagcctcctgagtagctgggattacaggtgcccgccaccacgctcagctaatttttgtatttttagtagagatggggtttgcctatgttggccaggctggtctcgaactcctgacctcaagtgatccgcccgccttggcctcccaaagtgctgggattataggcgtgagccaccgtgcccggccttgttactttaaatgaggcataaagtctcaaactctgtatgttgattcttaaaatctagcaggctcctgcgtttttcttcacctcgtgcatgtaggaaaaaaggggtgtgtcaaggatgcccttctggtttaacaaagaaaatttttaagcatttatactggtggatttaagcatttctctgggtggatcctggggagaatcacccagttggggggccatttggaaaaagcataggagggcttttagggggtgtgttactggggtatttactacctgggagccagggtttcttaactacataccaggccccgggcagtctgtgttacaagggtcagcaaactaggaagcccttggaccaatcccaacctgcagcctacttttttttttcttcttcttgagacagagtctcgctctgtcgcccaggctggagtgcagtggcgcgatctcggctcactgcaacctccacctcctgggttcaagcgatctcctgcctcagcctcctgagtagctgggactatgggcgtgtgccaccgca

SEQ ID NO: 22742 - DNA, 1043 bp, Homo sapiens
tataaacataaaatctgccaaaaaatgctgatattaccccacatggagaaacactgaacccctcttcagaaatcagatgccaatttaaatattactatcagagaaatacactctgatttttttttcctattccctttcttttattttcttttttgagacaaggtcttgctccgttgcccaggctggaatatgatggtgccatcatagctcactataacctcggattcctgggctcaagtgatcctcttgcctcagcctcccagaatagctaggactatgggtgtgtgccacaatgcctgactacttttttatgttttaattttttgtagagaagggctcttgctatgttgcccaggctggtcttgaactcctggactcaggtgaagtgatcctcctgcctcagcctcccaaagtgctgggatgacaggtgctagccactgcacccggccctatttcattttctacagtgttggttgcaactctctacattaatttcatgtaatgggctatgctgtgcagtctgagaaccgctgtcctagacaaactcttgctcacacacataaagagatgtataagagagtgttgtatcacacgttggggtgattgaagcatcattcgtaacagaggagaactggaaacaccatcatagatggcagagccgtggagtggaacattcggcagcagtaaaaggaatgaaactgaacagttttgaaaatccgagtgaaaagccagctgcaaaggcatctgtaaggtgggatgattgtcttagtctcaattgatgtaacaaactaccacaaatatggtggcttaaaacaataccaatttatttatctcacagttctggaggtcaggcggccaatatgggtctcagggctaaaatcaagacattggcagtgctgtgttctggaggctctaaggagaatctgcttccttatccttccagcttctagagaccacccatgctctttggcttggagcctcttcctccatttgttttatttatttattctagacggagttttgctcctgttgcccaggctgga

SEQ ID NO: 22743 - DNA, 2016 bp, Homo sapiens
cttttttatatttatttatccttggcctgggggctgtctcctctcactcagtggtgtgtctcatttgttctcctctgtgcctgagccagcacatggcacatcatattttctcagtaaatatctggcagaaaaatgtattcatcagcctggccaacatggtgaaaccccatctctactaataatacaaaaattagccaggcgtggtggcgggcacctgtaatcccaactacttgggaggctgaggaggaagaatcgcttgaacccgggaggcagaggttgcagtgagccaagatcacgccactgcactccagccagggcgacagagtgagactctgtctcaaaaaaaaaaaaaaaaaaaaaaaaaaaaaaaatatatatatatatatatacacacacacacacacacacatttacatagccccgccttcatcaaatgtcaccctgccccttaaaatgccgcccatgcatgttctcccacctactgcttttgtttccaatcattcctaatggcccggatctattggatcccagcatcactgcttgttagcgcagtggccttgggcaagtcactcctctggtgcagatgggggtccctaagaccaccctcagtttccatgattcactagaaggaatcacagaactgagaaaaattgttatagtcaaggctacagtttattacagcaaaaggatacagagtaaaatcagcaaaggcaagagccacacaaggcgaccccatcagtctctctgattccttaattatctaacagcagcacatagggcagaggccaagagagaccagcatgagctgccagatgtcgtctctcagtgaagtcccatggacagtgctcagttctcccagcaatgacatgtgacaacaatgatgtattgctagccagggacacttacttgggccttggtgtccagggttgttattggggtcagccatgtagacttgtgctgaatactgctgagagatcgagacagacggtaagaacggctgagagctgatgcacgccaggtgtccttccatgcgttggccaggagtgatctcattttagcccatccatgaccctgttaaatagacatctccatttttccagacaaggaaccaaggctcattgaggagaggtcacttgcctgaagtcccacggctaataggcaaatccaggagtctgatccttaaacctccacccttacagatgtggccttggacatggctgcacaccctcgcgtgagttcactcactcaggatgtattgagccattgttccagggcaggtagcattcaaagcatcaggggtgctgttatagccaaggctacagtttattacagcagaaggacacggaataaaatcagcaaagggaagagccacatagggcagaggccaggagagaccatcccgaaggggaacatccctgtgcttgtggggcttccatcttaaggagggcaagcaggcaatgggcagatcaggaaacgaagatatgacttgccaaagggtggtaagtgccatggccaaaaggaggcagagagagatggggtgtctgcttagttgggaagtcacagaagagcgggacgtgatgtttgaacagagacgataattataatggccactttcagaacacttactatttgttggataagtaataacagtaatatatgtaccaggcaatgttctaaatgcttgaatgcatctcatctttccaatcacagagatgctcttattatcatcactttacaaatgaaagggaggttagggaagttggcagaaggcacacagccaggaagcaggggctccaggatctcagcccagggatcttggcctcagaggctatgcttttcaccactgtcctgcctctcagtgcatggagaaatgaatgttcagtgcctagaagggataatcagggaatatggaggttaaggaggcaactgaggcacagagaggttaaatcgcagggttcagaagtgttgggggtgggactcaaagctaaatgatctgcctccacaatctaagctcat

SEQ ID NO: 22744 - DNA, 1030 bp, Homo sapiens
gaggagccggggctgaagcggcagaggggggcaccccgggtgggcggaggggggatccccacggggtcggggcggcaagaggacaccccgacagcctctgcaatgtccggggcccaacttccagagcaacatgtgtagccacgtcctcgcctagtccaggtggccgcaaccttgggggagagacagggcaggacaggaccaaggaagaggaaggagagacggagccagggacagacaggaggtccgggctgccgctgctgccgccaccaccactgccgccgccccggggcctgccccccgacatcggctctctgagccctcctcggaatcttggggtcgctggacgccgggttccggtcctggcccccccgccatccccccaacagaacagggtcatgaaaaggtaaggcggggacaggggatgcagggatggtggtgggaatgtggacccccaaatctaggacagaggaagttggcaagaagcctcgtggagggagggggtttgaacggtgggcaggggtcttgacccccacctagctcccctgtccctcagggactctcctccaccctctctctctccctctctgagcccctttttcctgagtccctacacctcagacctttcacgcccccatttctctgacacttggctccctctccccatccccacatacctgatgccccatatccctgtgcctccatctctctatctcaccttctccctgtacccccctccctgcatcagtccccccatcgcgagccggtcctctccctctctcctctcgctctcccctcccatgtcagagctatgagtctgctattaatacccccgccaaggaccttgagggcatccaggcccccagcacccctcgccccaagctcccaccccttcctcaaggttctggaacacccttccagcctcttccaagcatcaggattcgggtggggagagaccgatgttgtgtgtgtgtgttgggaggtgaggggggaggaaacgggatgccgtctgcagcacaactcgaggttgtgg

SEQ ID NO: 22745 - DNA, 1031 bp, Homo sapiens
gtcgccatttcttaaaacatttcttttctccttttcgttttcccaattgccctgtccgcctctatcttctctgtccccctccatctaggtctctgtccccccctctctctgggtctctgtccccctctgtctctgagtctctatcctctcaaggtctctgttcccctctctctgggtctctgtcctctctcaaggtctctgtccctttctctctggatcaatgtccctttcctgctgccctctctgggtctctgtccccctctctctcagggtccctgtcctgcttggtccctgtactttttcttggggcaccctctcaacacccctcctcctgcctatctctgcatctctttgtctttctgtagtctctgctttccaacctgctgtccagcccccaccagtaggtggggagtggtggggaacacccctggtttcggaagagtgagagtgttgatttgggagggtgagggtggggcctgggggcggggcttcttggcctcagattagacagtgactttgacacgaagttgaagcaccttaagccctgtatctcctttatatggaaacattaagctgctctcgcaggtcaggtggaggatccctttccctcccgccctgcttttgctaggggaggggggtgccctgagcctgagtcgcagccagcctgggagctgggccatgttggccgcagatggccccctggtgaaggttcccgttggctttgggaagtagacaacgggtctgcctcacggggctgaggtgggactggaggatttcgagggcagaactctgggaaggaaagaaaggcttaggacccaaccagcattccccctggcactgcgggggcctggccagctcatggcgttccctgagcctgttccccaactgtgaaagggggtgatgatcttcacctcccggcatcctgagcggccaaggtgagcagtggggtctgagagtccagtgggggctgtgggcatgtcgggagctcatcacgaggcctcgtacataccaggtgtgtttgaaaccagagt

SEQ ID NO: 22746 - DNA, 1038 bp, Homo sapiens
ggcgtgtgaggagggtgcgggggtcggggcagggaccggagtctaggggactgagggaccaagaggaacagagactcaggcccgggactggggcaccggggtgggagatggaaatggaaaacctgggccaggactgaacccagccaggcctgggactgggttctggaaataagagtgcggatggcggtttgggggcccagggccagacacgcaggcctatggattggggaccaatggatggagacccaggtccaggtctcggggacccagggacagagacccaggcccaagactggaggacatctagggctctgtgcttgaacctgatttgaggttcccataatggggccagggcaggtttgggggtgaagcagacgtcctggacccgagagagccgctggggataggggggcagatgtagttcctaagggtgagtccacaggcggtggggggtggggggctgtcctggcgctctgggcctggggaatgtgaggggcaggactggcaggtggctgggcggggcagtggggaacaaaggtgagcgaaaggaggaggcagaatccgggcagagggcagggagagggcctgtggggaagggacctcagtcctgctcccacccgctccctggagagcaggcggccagacacccaggtcagtgctcagggaccagctcttggcccctgccccttgcaggcgctcgcatgtggctcctctcggaccccgtagtccctgtcatatcccttctctccagctgtctccatgcctgcctcgtacccctcctatttgctctcccttccactctgtcttgcctttctcgttggggtgaaaaagtcttactctcttaagtatctttcatcgcctgagtttcacctcattgaccctgtttgtctcctctcagtgtttctctggctctcagaccctatctctattgcgtttgtgattgttttgctgttttacccactgcaccgtatggggggtgggggtgtcggggaggtgtgtctttcagtctttgcatgtctgtttctgcatatccaatcc

SEQ ID NO: 22747 - DNA, 1081 bp, Homo sapiens
gcttgaaccccgaaggcggaggttgcggtgagccgagatcgcccctttgcattccagcctgagcaacaagagcaaaactccgcctcaaaataactaactaaataaataaataaattggggtgggaaggcattgaccctgagctgagagagaactggctcgctgttgaagcagggccacgcatttgattgacagttcgtttgttggaggggcgtggtcacgctcggaaactccgccgtgacgttgcaaaagctggaatctccgcgagaagtcctgtcttacttccacttcccacccttcgggttgcggtctcgaaaccccgcctctcttcgtgacgtcagcacgccgggcgcggtaggctataaaagcctagtggccattgtgttcgttgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccggtgagtaaggggtcggaacgcctgggtccccacggggctgggggcccggatttagaaaggagaaggggttgggagcctggagtcctgagcctgagggaggagggatctggaagccagattcttgggtcccccgtgaaggaatcatctgccaagtagggggtcgggtcagaatgtttcagtctgcgagggaggagggtgtgagggtttgatttgtcaatcttcagcagaatgagagagctagggactatgactttgtcgccaagggaagcaagtaaagacttttgttcttggttcttgggactgggagttctgcgtctgaagaaagagagggctgggggcttggacccttggatctaaggcagaactaggggctcagactcctggctattgagagataagaacagagccaagggacagagatgggcgtggccgagatcagaaaggaatttgggactctcgcgt

SEQ ID NO: 22748 - DNA, 1035 bp, Homo sapiens
gcccagccaatttttaaattttttttttctttttgaggcagagtcttgctctgttgcccaggctggagtgcaatggcatgatcttggcacactgcaacccccgcctcccaggttcaagctattctcctgcctcagcctcctgagtagctggggttacaggcacttggcattatgcctggctaatttttgtatttttgtagagacggggttttactatgctggccaggctggtcttgaactcctgacttcaggtgatcctcctgcctcggcctcccaaagtgctgggattacaggcgtgagccaccgcacccggcccaattttttacttttttttttttttttgtagagacggggtctagccatcttttctaagctggtctcgaacttaatgtgctcaaatgatcttgccttagccttccaaagtactgggattacaggcatgagcccctaaatttggcccctacattttctttaatcttaatcaatttacatttaaacagcccatgtggctagcggctactgtactggacagcgcagatccagagtttaggcagagaagagacccccaggcctgagccctgggccacactagcatgtggaggtcaggaagaggatggagccgtcaaaggaggtggaggggcagccagagaggacagaatcatgttctggaagccaagggcagaaagtcaagtcagatgcaggtggaaattaaccactggatttgcaagatgagggttcctggcctcctcctcaggaggaaggttgtgcttgtctgagggagccgaggaaggagggccggtggtgaggacaggaagtgtggctgaccgagcctgaagccctgcagctgtggggtctacgttggtaggagaggctcccctcacaactggagtcggcactggcctggttgtctgggaggcagaggtccctgataaccctggagctgactctgtgtccagagcactgaatgccagggccagagaatcctgcatgacagtgacccaagcatgtttcctcgaaccctccctttgatctatt

SEQ ID NO: 22749 - DNA, 1051 bp, Homo sapiens
gggtttcaccatgttggccaggctggtctcgaactcctgacctccagtgatccgcccgcctcggcctcccaaagtgctgggattataggcaggagccactgcgcccggccccagccagggctctttttttgcaggatcatatggaataaactgagaacatgtgggtgctgtgtaaaccataaacatgaagtaattgtgatcattagcccttgtggttagatcttagtacaattatgtgcttaatcaggcctcagtgacttttgtttaactaggatgcatcctcagagcagctccagttcattgagcatttaccacattcagccatcttcctagggaggtgccaatttgggatatcctttccatgtgccccttcattcccccaacccctgctccctactcccacccacccctttgacaaagaaggaaaccagggctcagaggggtcaggccacatgtgcagcaagctggctagtaactgagtctttgttctttcccttcatgtaggtgcccactcccacatccggggactggggctggacgatgccttggagcctcggcaggtagagcagaggaggctggggtgtgagggcctctccatgaaggtcttgggtagtgggtacccagggtcctggggagtgtggggactatgttacggtcttctggacctttggctacatacccataaacttcaaccacatgtgggttttcttggtactaaagaattgattaggctaggtgtggtggctcatgcctgtaatctcagcactttgggaggccaaggtgggtggatcacctgaagtcagagtcaagaccagcctgaccaacatggtgaaaccctgtctctactaaaaatacaaaaattagccgggcatggtggtgcatgcctgtaattccagctactcaagagcctaaggcaggagaattgcttgaacctgggaggtggaggttgcaatgagccgagattgtgccactgccctccagcctgggtgacatctcggaaaaaaaaaaaaagaattgggagtgggtagcaattgctttgccaccttaaaaa

SEQ ID NO: 22750 - DNA, 1115 bp, Homo sapiens
ggaccctgctgtctccctaaggcctgtgttgtggggaacagggttgttagttcatttgtttagcccctgccacttcacaagcactgtttttggtttaggcttttcagcagcagaacatagggtaaaagttggcaggaagggagacccctggtaccttgggctcctcctgcatgggaggacagttaaggggctcccacaacccagctgggtgtcacaggctgaagtggtgggttgtgggatagtggtctgtcctggctctaaccttaggtccccaacccttgggctgaggatgttccatcccctccacatagaggaggaattggagtacaagacaggtgtgttgttgccattaaccaaactcataagagggtcagatgtcaacctccagtggctctttattctgaaagtgaaaactgtacagtcacaggcagcatagcagtgtttcactcagcaggggaccgtggatgtgatggtgatcctataagattatatcatattttgccaggcactgtggctcacgctgtaatcccagtactttgggaggccgaggcaggcggatcatgaggtcaggagttcgagaccagcctggccagcgtggtgaaatcctgtctctactaaaagtacaaaaattagctgggcgtggtggcgagcgtctgtaatcccagctactcgggagactgaggcaggagaatctcctgaacccagaaggcggaggttgcagtgagccgggatcgcgtcggctcactgcaacccagcctgggcaacaagcaaaaatctgtcttaaaaaaaaaaaagattataccgtctatttactgtaccctttctatgctttgataacgtttagatgcacaaatacttactattgtgttaggattgctgtagtatttggtgtagtaacacgcttggcctcggagcagtgggacgcaccctctagcccaggagtgttaggtatgctgtctaggctcgtggaagtgccatctcatgttggcatatcgacatcatcatcaaacgacgcacttctcagaacatgactctagtgagaagacaggttttcctcctatacctgtgaactttgatgaatccctttcctccaaatcctggagtgcaggatttcc

SEQ ID NO: 22751 - DNA, 1016 bp, Homo sapiens
ctctgctctgggctgctacttagatgagccctcaaccagtgatgtcctgagggagagctgccgtcagggcgctgcacgcatacgctggctgtggggcgctgcccggcattgggtctgtgctaccttctttgagcttttgttctctatcttcaggacttgggggtaccattgctttgctgcatttgctttttacctttagtcacatttgtggcccccccaccccgggtaagcaagtgctccagggaactcacacagtgtgctggggtggtttccctctggctgcccttcaggaagctcagctgttgtttggccttcgtccactccccagccctgcagcattcattggtcccactgtcatgctccacagtaactgttagaatgcctgctgtctggcgttgccgggtgtgtttccttgctgctgtgacagctttcagctcttcattaaatgttagcatcttgtgaggctttttctaacctgccttgtaaagtcacccgtttctattctctgtcgtcatctgatgtgatcataggatctccttatttacctctttcattagcatatgaaccccatgagggtagacacctttttttttttttttttggagacagtctcactctgttgcacaggatagactgtagtggcacgatctcggtttactgcaaccttcatcgcctccctggttcaagcgattctcttgtcttagtctcctgagtagctggaccacacccagctaattttttgtgtatttttagtagggatgaggtttcgctgtgttgatcaggctggtcttcttgaactcttggtcacaagtgatccgcctgccttggcctcccaaagtgctggcattacagctgtgagccactgcgcccagcacctttttttgtcttgtttactgcgaaatccccaacaactatagcatttccaggcacatagtagatgcttaagaattacttacttacaagagcacaaacatcggcgaataaaaagaattacctattgaatgaatgagagttag

SEQ ID NO: 22752 - DNA, 1377 bp, Homo sapiens
atgtctcttctcctcctccctctgtttctgatgtatcttttttttttttatatacgtgttttttaaaaaacaaaaaccaaatcccccacaacgtgtgtgtgtgtgtgaacctggggaggtaagtgtcacacgttgaacctcaggggcaaagagggaactgggtggggggctggggccagctggaggtggggggaggggtcggattttgggggaacctcccccattccccccactgaagttgggggtggccaggttgcaatgaggactggcctttgaacctgccctctcttccccccccagtagaactggggctgggccacccgaccctccgcttccccaaccctggccccccaccctgttcctcagcgggcagtggggtgataggcatgttgagcgcctgcccctacagttccaaagccccctttgaggctgccgcggcgtccacatgggcagggatgggtgggggagggtgggcagggctgcggcgtgtccaggggccgccgtattaattgactgttcttattgtcactgcagccaccacgcagctggcttgcagctgatgcttacgctccccttacaacacctcagtgtatggttggtataagggtttgtatcatgggtaagatcactcagcaccgcacaccagcccagcttagccaggcagctcaggagcagcgaggcgcccctcctcccaccccagtcgcccccgtagcctccccgcacccatggccctttccttgtttgggtgccctttgtccctcctgccccgatccgtatgctctctgagaatcttgctgatcccaggaggggaaggatgaacctggtgggaaaggcggcggcctctccgcttgggttccacccagcctctgatgacccggcttcgtgatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgat

SEQ ID NO: 22753 - DNA, 1070 bp, Homo sapiens
tgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggtgagcacatcctgccttcgacgggctctcgggggccctgggcctggtggccttgttctcccttctctgctgctttctgcttctctgtctcctgccggcccacctctcccatcgcgtcctcatctccggcttctctctcttgtggccatcacatttctgacagctgcctgcctcctcgttctgggttactgtgaggagcaggggcaccagcctggagaggcctgagcccacatgctggcgtccgcccttgctagctgggggtccccttttcctgcctcattgtactcctcttagtggaaataaccccgagttcactgagctcagtgtactgggcgccca

SEQ ID NO: 22754 - DNA, 1049 bp, Homo sapiens
gcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttccttgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtatgagaattagaagagcaggggtggagaatggaaacctatagttgactggggctgttctgagtgggagagattctggccgtgattggttggggatgttctgagttggaagaatgttgactgtgattgattgggacaggatacatagactgggacctgactggttgatagcagaaaaataaaccaggatgggggctaacagtggatggggcagattggatagctggttgcggctgcatacccgttatggagacaggagccccaacgctgccctatcggatccgtcccaggggtgttctggaccaggggcaactgtcctaaactggatcttgtctccagctgactgttgccctgccccgatccccaggtccgggagcggctgcggatggcgctggagcgcgtggcagtgctcgaggaggagctggaactgagcaatcaggaggtgtgggtgtggccaagacagggaatttgaatccaaggggaggggctaaggggctgcccacggggcggagccggttgggtgggttccagagagaatctattggggcaggactagggcagacaagctatggggttggactatggag

SEQ ID NO: 22755 - DNA, 1044 bp, Homo sapiens
ggacattgcaagagtgatggccctttcttagtgggagagctgccttgaaagagtccattgtcctgacttgggggtttagtgacgttggactgcagtgagacagagttaaagcagtgcttccccaaatttaatgtgtagtggggtggcacacacctgtagtctcagctacttggaagactgaggcaggaggaccgcttgagcccacgaagctgaggtcaacctgggcaacatagtaagaccctgtctctaaaaaataaacaaatacagccaggcgcggtggctcatgcctgtaatcccagcacgttgggaggctgaggtgggcggatcccttgaggtcaggagtttgagaccagcctggccaacatggtgaaacgccgtctctactaaaaaatacaaaaattagccgggcgtggtggctcgtacctgtaatcccagctactcgaaggctgaggcaagagaattgcttgaacctgggatggggaggttgcagtgagacgagatcgtgccaccgcgctccagcctgggtgacatagcagactctttcagaaagagagagagagagagagagagagaaagagagaaagaaagaaatttaaaaataaatataatgtatatttcgaatcacctgagggtcttgtgaaaatgccgataccgacttcagtaggtctggagtaaggtctgagattctgcaattccagcaagtccacaggtgatggtgacgctctaggtctcaggacaactgtttgagtagccaagagtatatgctgtcatgaagggctaggagacaactctggattggtccattatcctgagcagagattggtcattgtcctaccatggggtgggaaaaaaccttggattgggaggttggactgtacccctctcatgcacagtgggaaggggccagagggcctgactcttccctcacctgcccatggccccagatcctggcatatggcgacatgaaccacgagtgggtggggaacgactggctgcccagcctggggctgccccaataccgcagctacttcatggagtcgctgg

SEQ ID NO: 22756 - DNA, 1056 bp, Homo sapiens
gcgtgagccacggcgcccggcctcttttttttttttttttaaagagtctttgtctgtcgcccaggctggagtgcaatggcgccatctcagctcactgcaacctcctcctcccaggtttaagcgattctcctgcctcagcctcctgagtagctgggattacaggtgcccacaaccgcacccggctaatttttgtatttttagtacagacagggtttcgccatgttggccaggctggttttgaactcctgacctcaggtgatccacccgcctcggcctcccaaagtacttggattacaggtgtgagccaccgcgcccggccttaattcatttttaggtattttttgagacagtctcactctgttgtccaggctggagtgcagtgggacaatcatagctcactgcagccttgagatcctgggctcaagtgattctctcgcatcagcctctgagtagctgtgcgccaccacaccaggctaatttatttttaatttttttatagggatagggtctccctatgttgcctgggctggtcttgaactcttgggctgaagagatcctcctgccttgacctcccaaagtgctaggtatagtacaggctgtggtagggtagaaagagcaagttatttttgctttggaatcagacaaaactgaatttaaataccagcttgggccgggtacagtggctcacgcctataatcccaacattttgggaggctgaggtaggatcacttgaggtcaggagttcgagatcagcctggccaccatggcaaaaccctgtctctactgaaaatacaaaaattagctggcgtggtggcgggtgcctgtaatcccaactagttgggaggctgaggcaggagaatcgcttgaacccaggaggtggaggttgccgtgagccaagatcgtgccactgcactccagcctgggcgacagagcgagactctgtctcaaaaacaaacaatcaaaaagaaacaaaccagcttggccctttcttgctgtgtggtcttgaggaagcagcttcccctctctgagccccagtttctctctgtggaaagtgga

SEQ ID NO: 22757 - DNA, 1092 bp, Homo sapiens
cactccccggtcccttagacttccattcagaagtgacacctgtcacctccaccctcatgtgactggccaaagtgagtgtggccatgtccgagttccccaggatgggacctcgaatcctcctgctgggggggtgggggcagcagatgtttcaggacagtctgccacggatcagatgggtgagcaagagattcaggatgggcgtgatgggtcacacctgtaatcccagcattttgggaggccgaggcaggctgatcacctgaggtcaggagttcgagatcagcctggccaacatagtgaaacctcgtctctactaaaaatacaaaaattagccgggcatggtggcacgcacctgcaattccagctacttgggagcctgaggcacaagaattgcttaagcccaggaggcggaggttgccgtgagccgagactgtgccactgcactccagcctgggcaacagagtgagaccccatctaaaaaaaaaaaatgcttcagagattcagagatccacagatgtggaagagagcttctattttgtctcatgtaccacctcacccctcagtttggagttggagaagccgaggcttagagaggtcaaggggctggccaagctcccacagtgataaagctagtgctagggcgacacctgccaggcccaatgtgacaagatgcatcctgagtcctgtgtgccaagccttggcggggcaaagttggggcccggaggacggtaagacacagcaactgcgagttcccagagacagatccgggttccagccccagctcaccatgcactgggcgtgccacccagggagtcagccccactgcagcccccgctgcggggcgtccggagaacgcgccatctgcggcgtgagcggccgcctctcaccaccagggggcgcgctccgcctgggcccagattccaccccttgactgtctccccccaaaaatttcctttcactttcggtctctggctgtcacccggcttggccccttccacacccaactggggcaagcctggtgcgtgaggagacttggactctaggtccccaaggggcggagccagggtccccactcctggggcagggggagcagag

SEQ ID NO: 22758 - DNA, 1694 bp, Homo sapiens
accaatgaaaacacaggaagccgtccgcgcaaccgcgttgcgtcacttctgccgcccctgtttcaagggataagaaaccctgcgacaaaacctcctccttttccaagcggctgccgaagatggcggaggtgcaggtatgggctccgcgcgggccggggcggcaaggggccgggtgggatccaggccggaatggggtcgcaccctctctgtcttgcatgttttgcggagcttaacatccataatgaagcaaaatggaagtcttttgggataaggggaatctgtaggaaatgccgcggctctctttaggcctagggttggctacaatgtggcatttccttctcgaggcgagggtgatagagcttccagcacaggacaggtattttgcaactagattttgcttaccttgaactcgggtagtgggtgggggccctggggtagagtcttggccgaattggacccttgtgtgtcctcagcgatgaggaacacgcggaagtgtggccgggcggtctcggggcaatgagaaactgagttttggccaaaatggaaggtatttttatcccgctcagtgcgcgggctactttgatttcacgtggaggtgttaatcggggtcccctgcagctccggttcttttaattctcaatgcctttctgcggggggtcgagagctgttggctgcggggcactctggaatgaactcgttttccgtcgttttggggattggcgattgtcctgaggcgtgttactggaagtcgagagctgtgatgaatggttccacaaggatgggacatcttttgggcctgacacctgggggccctttccctggctcctggtgtagctacttaagtataaaggagggattggccctggaaaggtttctttgtgagtagtctgttgttggggcgggtgacatttcagagccaggccgatctaggcaagttgtgttcaccaagcatgtgtctttgtgcctagcacagttcgcaatgttttgcgtagttcagttaaccatattcctgaggcagttactggtatccttgttttacagaggaggaaattaaattggaattggtgattttgggccaaggtcacgacttcaggaagtctgtctggattttagagtctttgtaccaacgcttacaaagcatgtgtaacaaccagtgtgtgcttcatgcttttgcattaaaacaatgaggatttctacttttagtgttttttctgagacggagtctcgctgtgacacccaggctggagtgcaatggtgcgatcttggctcattgcaacctctgcttcccaagttcaagtgattctcctgcctcagcttcccgagtacctgggactgcaggtgcctgccacgacgcttggctaatttttgtgtttttagtagagacagggtttcaccatattggccaggatggtctcgaactcctgacctcaactgatctgcccacctaggcctctcaaagtgctgggattacaggcgtgagcccctgtgcccggccaggatttctactccggaggaagctgaggttcggtgcctgagcagtttaccggggaaagcagagtgctctatagcagagctagcatgggcttttgactactctgcctaatctcatcccacctgaaattcggttttcttccaaattaaatttgtggtagaaacatcctatacattagaagagaattagattgtgttaacat

SEQ ID NO: 22759 - DNA, 2270 bp, Homo sapiens
cctacagtttattagttacaaggtcttgtaactgggtagtcagtgggcagagccttgctggtcttcgttcaaatccaattgctttgcaaaatacaatctgagcataaaatactcatagaagaactcagatatgaggggagtttgggcctcttaaactgctcactcactgatcctgaggcagccttgctttctcagtccctgttcctcatctgtagaacggggctccgtgcatagttcccagctctgatggctgggtgcaaggcacgctgttggcacggtaggacaaaagaagggaatgcttgcttgtgaggacaatcaaaggctgtccttgtctctgagtccttttgcccttgtctcccacaggtcctggtgcttgatggtcgaggccatctcctgggccgcctggcggccatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagccactcttccccagggttggggactccaggctcaagaagtaattatgtattaggctagtttttcatttaaacaggaacttagctctggcaagtactgcgctgtgtctggagggtgactgcataggcagtggtgggaccctcaggcggctcggccctgctaagcctttccctccctctaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttgggggtgctggtagactgggcaggcctcacactctcccctctccctagtgaagtacctggctttcctccgcaagcggatgaacaccaacccttcccgaggcccctaccacttccgggcccccagccgcatcttctggcggaccgtgcgaggtgagcagagcgtggggactgcaggtggtgacgggcaggcggccggtgatgagaacttctcccactcacattcgagtttcccgaccatgagatgactccacatgcactaccatctgaggccaccccatgggcccacctcagtggggtgggtgggcatccttatgaggccctctgactgggcctgctatctgtcacccaacaggtatgctgccccacaaaaccaagcgaggccaggccgctctggaccgtctcaaggtgtttgacggcatcccaccgccctacgacaaggtgagctatgccaaaccccacaggcagcggccttacctgtggcgtccatgatgttccgcaactacctacattgtttgatcctcatgaaagcagcactggctgagacgccagtccagccgacctccttccctgtctgtccctcccgggctcttaagcccctctctttctctaacagaaaaagcggatggtggttcctgctgccctcaaggtcgtgcgtctgaagcctacaagaaaggtgagtcccagcttacgctgcaccatctacttgggagatttcaggcctgctgagggacctggggacctggagcctggcagatgatgtccttatctcacgatggtctgcggatgtccctgtgggaatggcgacaatgccaatggcttagctgatgccaggaggcttgggtgggtgcttttctaacaggcctgcagagaacagttgcattatgatatgcccagctgtcagtcacctcccagctctcaacagctccggctcttcagggtgtgggggcttagatatccttacaacttcatttgttcaccccccccccccccccccgcagtttgcctatctggggcgcctggctcacgaggttggctggaagtaccaggcagtgacagccaccctggaggagaagaggaaagagaaagccaagatccactaccggaagaagaaacagctcatggtgaggccaggggctggtgctgaggggggcatctcactcctggacaggcctggcaggtgccttgctcacagagtactcttaactggcaaaggaccagccggggttggggtgggatgcagtccatgtaatgagggcaatgcaacccctcctgaccaccaccacctgcacttattcttggcagaggctacggaaacaggccgagaagaacg

SEQ ID NO: 22760 - DNA, 1029 bp, Homo sapiens
ggttaattccgggcgtccgtgattattttctagagattaactggagtggagggcgcttgcttttgtttctagatgagtgcttcctaattcctgggggctcctggcgttaatggaggctcaagcgttttaggacttaccttcttaaaaaccaagtttaagaaggtttttttggagttctccggtcttcaggggtaattctgtggaaacggactcctaagggctaatccagggagcctgccgtctggtatttaattctgaatccttatgtactacataaggagtgaatcctgggtgggcgatcttgggtcttggagaatgatcctcgctgaaaggtgtccagggtgtgagagggttgatcctggtttagaggatgaattttgcaatccctgagaggccttctggagtatataaattgaaataacctcgggcttagatctgagtatgaattacaggtaaggtcagggtggtcatgtcttagagggtgattctggggcaccaggccttggacgccggcgctttgcaagtaaatgtagagcatggggtctgggaggttctgggaaggtctctagggctggttggctgccggcttcaaacttagcagctcatcagttttctcctcataatctgtagactgagcgtgcctaccaaaagcagccgaccatctttcaaaacaagaagagggtcctgctgggagaaactggcaaggagaagctcccgcggtactacaagaacatcggtctgggcttcaagacacccaaggaggtgcggggaacctcagaagaaagaaggggaacctggcgttcctgcacgtgtgcccacgacgagttgccctgcctgcatctaagtggcttctggggctgctgggaattgtagttgcttccctgaggccacgcccctggctcttttaaggaaccgcccgcccaaggctcactcctttatctttcctatcctttcaggctattgagggcacctacattgacaagaaatgccccttcactggtaatgtgtccattcgagggcggatcctct

SEQ ID NO: 22761 - DNA, 1010 bp, Homo sapiens
tgctgtgtctcctctgattggttgcctttgaggctgctggtcgctgcttcatttctcgccggattcgtccgcccctgcctcgcccctcccctttcgctccaattggccctgttaccatcagcccccaaatcccaccttctcttccaggcttttccgcctctccccaacccaccccaattctttccctctgggtttgccctattcttttggctctttggaactctgaattctttcttcctgattccctttcttcctgattggctctaattctctggcccgccctgttttatcttattttgccccattgccttattctacccaccttgcctttgcctccaaggtttctgattggttccctcttcctaggggtactggtaatgacatgatgctgtccagtttgacccttgaccctcctgattggctccttccctttttccctccccatctttttttctgaaccctcccacttagctcaatcctttctgacacgttctctggtctttcttagacttcattgtcccatcctttcctcttccttgctggaaatatccaaatttggtctccctcccagccttactgaggactctgttcttttgctcctggctctttcgcttctagatttttctacacttttgtctaccatttcctacctgggccccctgtccttatgactggattgccccttgtcttgctttactgtctcacctttcccccttccctcccctcattcatgtctcattagcttggttctatccatcttgtttttgaatttgcccttttctctcccatcccctccttttcctgatccaacttgcttttggcctcttccctttctctcttgactgtatcctacccacccccacctggctgactataacccctgtccccggccaggcctctctggactcttcgacactggcctccaccacgcgggctcagcagggcccgacgcctccgtcatgaaccttatctcggccctggaatcccggggcccccagcctggcccctcc

SEQ ID NO: 22762 - DNA, 1027 bp, Homo sapiens
ctcctgacctcgtgatccgcccgccttggcctcccaaagtgctgggattacagatgtgagccactgcgcccggccttttttttgttttgttttttgagacggagtttcactctgtctcccaggctggagtgcagtggcacaatcttggctcgctgcaacctctgcctcccaggttcaagtgattgtcccctcagcctcccgagtagctgggactacaggcatgcaccatcatgcccggctaatttttgtatttttgtagagacggggtttcaccatgttggccaagctggtcttgaactactgacctcaggtgatccatctgcctcggccttccaaagcgttgggattacaggcatgagccactgcgcctggccatgaaaccccattgccacaaaaaatacaaaaattatccaggagtggtggcgcatacctgtagtcccagctacttggtgggtaggtggctgaggcaggaggatcacttgagcctaggaggccataggtaagctatggtcatggttgtgccactgcactccagcctgggtaacggactgagagggtctcacaaaaacaaagaacaaaacaaaaaaggccaggcacagtggctcacgcttgtaatctcagcactttgggaggccgaggcaggtggatcacctgaggtcagcggtttgagaccagccttgccaacctggtaaaaccctgcctctactaaaactacaaaagattagctggccctagtggcaggtgcctgtaatcccagctacttgggaggctgaggcaggacaatcacttgaacccaggaggcagagatttcagtgagctgaaatcacgtcactgtactccaccctaggcgaaactctatctaaaaaaaaaaaaaggccgggcgcggtggctcacgcctgtaatcccagcactttgggaggcagaggcgggcggatcatgaggtcaggagatcgagaccatcctggctaacgcggtgaaaccccgcctctactaaaaatacaaaaaaatagccgggcgtggtggcggg

SEQ ID NO: 22763 - DNA, 1030 bp, Homo sapiens
ataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacactttaccggcaggctggagtgcctctgtcctgcggcgctggagtgggtggcagtggtagcaggggcagaggttctggaacgggactttcccagagccctgggcagtggggggcctgaggctggcatatgttctgtgtccccgcacagcagagtatcccaccctgaaatttaatgacttcagacaacaaatatttatcactggggggtttcttttgttttttagctaaagacagggtctcgctctgtcacctaggctggagtgcagtggcatgatcatagctcactgcagcctccaactccctggctcaagcgatcctcctgcctcagcctcccaaagtgacgggattacaggcaagtgccactgtgcctggccctgtgttctttatgttacccaggctggccttgaacttctgggcttaaaagatcctcctgccccagtctcaagta

SEQ ID NO: 22764 - DNA, 1028 bp, Homo sapiens
ttcggggccgcactgactgagtttacaccctgactgctgccttctctctgtgtgcccttggggaggatactgcagccctctgcctcagtttcctcctgtgacctttgggttaagaaccatggtgtgcagttgttgggagcatcctacggctggctcctgtgaagcacttggggcttcctgggcaggacctggtggcccagggagtgtccacggctgggccagcaagcaggcaccaggagggaggcaaaggccctgaccgcctctctctccctgttcctttgcagtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgt

SEQ ID NO: 22765 - DNA, 1033 bp, Homo sapiens
accatgttacccagtaactcatccagaatgtcttcctggagggaaacaaaaaaagagaatcaggcatttccatatccttttctggagacttcatatggaccaggtctgttctcagcaacgcagggaggtcaggcttgagctctgccttcaaggggcttccagcctggggacagagccagccatggcatcaacagccaaacaaacactaatgaacgccaggtgctaccattccaacccaaggatctggctctatgcaggtaagacctgggcaaagcaggctgggtagaatttcagaggggatgctcccccagcttgggcctcagcaggatcaaggtgagggagtttttcagttcccaagaggctgacagccccctgcgaatcgaaatccatgaaatcccgggaaggtgtgctcgggccttgaatgctgggtgaagacttggaattttctcctgaggagaccggggcagggacagacagggtcagcactggctcaggtgaggggcaggctggaggcaggggagtggggggatcgtctagagggagaggacaaggcccatggagacaggtcggagactgaggggcatgaaagttgggcacattctcacctgggtatcagaagtactgcctccaccattggtgtccggagaggtgtctggctgggaaaagtccccaactcctgttgagaaaagtggtgaggggagtaggagtgccaggaacccttggggccccagcctcccacacgaaccccaagctggcagacctgagttcacaaactcgtagattttatgtgggtcgtgagggtccttgctccggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgctcctggggccctaaccctgtctcccgagtcctaacaccaccctctttccc

SEQ ID NO: 22766 - DNA, 1051 bp, Homo sapiens
tggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatccctctcctgggtctgcgcccctcccctctgcggtacccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaggatagaatttctcatgggggagtggccctgcttcctcccctagaatggcttggggcttagggctggggacttgccctccatggaggtcagtgggagttgcagctgtaaggtggcagggcctacccatcttacagaggtgaagacgaggtccctctgcctctgctgcagacatggcgtctgcacccacccttccaccctcagggcctggccacggggtcctgggtcccccacaatactgtgcactcgacctggttgacccaggacaccctcctcgttgaacagccctggctacacctgcttcagtgcaactggagccctcaccggcgagtgcctgacacctcggccttttctcttccggaggggcgctcctcagtgtgtttggggtctccctcgctccacgccctccagggggccgcatgtgcacttgccctgcattgcctggcccccgaggttccagggtcccaactgtctactaaccggcttcccgacagggtgagggtgaggtcgcatctacaaccagagccagcgcttccccgccgccac

SEQ ID NO: 22767 - DNA, 1047 bp, Homo sapiens
ctgccagctgtttatgaccagttccagccgatggaagggaagtgggcactggtcgatgtgtggaaaagacaggcatgatctcttcccctgttccccctgcttaatggctggaaggcagtggcgagagcaactgtctagaaatggctgagcaaccagaacgtagacacctgtaacctgctgcatttgaagagcagagctactaagcttatcaagcattttatgtgcaaaaaagcagttctcttggtttctctcatggttgctgaactaatacacaaaagatagacagaataagtttcctcccttgtgagatggaggcagcaacacatttcttgcatgattgctctggggaagaagtggaataagaaatattgtatccagttaacaacagcaaaatggtggattaaataattcaggccgggcacagtggctcacacctgtaatcccagcactttgggaggccgaggtgggtggatcacttgaggtcaggagttcgagaccagcctgaccaacgtggtggagccccgtctctactaaaaatacaaaaattagccaggcgtggtggcaggcagttgtaatcccagctacttgggaggctgacacaggagaatcgcttgaatccaggaggcggaggttgcagagagcctagatggcgccattgcactccagcctgggcgacaacgagattccatctcaaaaaaaaaaaaaaaaaaaaaaaggaattcaaaaattccacccctccataaaaacaatgaaaaaactaacaaaaaccataagaagcagtttgttcacaattctggaaattaaccaaaggcttgcagcaactcaaagagcatttattcaagaaaagtgactctcgataaaaaacggcaagacttgaggaattttaacttatcctagtcctatctcccactccctagctcagcaggaaccctggaaaataacagcccacatttcccacagggaggaagcagaatgaagctagaactcattcaaagcctcataacccaaagaagagtcattctatgattgttaagtgatgcctgggaa

SEQ ID NO: 22768 - DNA, 1050 bp, Homo sapiens
ctcaggtttgtgtgtaagaacaacggggtcctgttcgagaaccagctgctgcagatcggagtcaagtcagagttccgacagaacctgggtgtgtcccgggggactgtgggaatgggtcggagggagaccttggggaaggggtcagagggactcagatggagctctgcctcccccacctactgcaggccgcatgtatctcttctatggcaacaagacctcggtgcagttccagaatttctcacccactgtggttcacccgggagacctccagactcatatcctctcaggcccggcccagcctcctgcctctccacgtcggccttcctcaccgtggggaagccggctgacccaggtccacacttctcttcagcctctcttgggcacgcaattagttctctgagattgagtgtctgcatctgttaagatgggggtgggattccttcccccaggacaggggatgacagtgaagtggtgtgtgggaggctttacttccagaactccacctgctccaggcctcattttgtccctgtctggcaccttccgtgtcctgccatcgtcctccactgggctccatgtcatgatgccagcaccgcctgcactcaggagccaggcctgcgggtccagacgctgatcaggcctgatctgggctgagtcactttgcctctctgggctctcctgtccccgctgtgaagtgtatgtagaccctcctcttcctcatagggttattgtgaagatcagagtgtctggaaaaccctggaagggcggctggaggtatcagtcccccctgcccgttctctgggcctccattgccacattcatgaaattagaaaagctcgacctgaaaactccttctggccgggcatgggggctcacacctgtaatcccagcactggcaggctgaggccagtggatcatttgaggtcaggagttcaagaccagcctggccaacatggtgaaaccccatctccactaaaaatacaaaaatcagctgggtggtagtggcacgcgactgtaatcccagctactcaggaggctgagacaggagaatcg

SEQ ID NO: 22769 - DNA, 1031 bp, Homo sapiens
gaaggcagcccccccggccttgctggagccgctgcagcctccgacagatgtgagccaggacccgaggcacatggtgctggttcggggactcgtgctgcctggtgaggcctgggcaccgtgcgcggggatgggggctcgacgtgtttccccagctccctctgacttggattttggatttctctcctttctctgcatcttgaatcccttctctctggggttggccatccctcctgctctcagttgggggtggctcagccccaggccccctccagtcaaagcagccagtccccctgcctcccgccgcaccctcaggtgccactctctcagcagccccccagcagcctctgccccccgtccccccgcagtaccaggtatggatatttccgggaagggacatgcttctggggacttgctggagccctggcccctggggagaaatctagttgcatgttggagcttgtgggatgatgggagtcccatgggacattgggaaggtgggactcttggggccatggaagctcatgtgctgtgtgatgggtgttgtgagctaagctatcccagctggtgcctcatggggccatgggtggtgtgacctcgtgggataccaggactggggggccatggtcctcaccagtcccttcccttcttcccttctacccacaggttcccgggaacctgagtgcagctcaggtggccgcgcagaatgcagtggaggctgccaagaaccagaaggctgggctgggccctcgctgtgagtcctggagtgaggatgaagggcgggcaggggccaggcaggcctctctccacacacttgttccccacttcttcccttggtctctcccacagtctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggca

SEQ ID NO: 22770 - DNA, 1061 bp, Homo sapiens
caggcagccggcacgctcgcttgtttttcctattggagagttgctcgctctccgggcaggaaacctggaaatgggggcggttttgggggacagcggcgagggaggggcccgcgctttgtaccagcgcccccagatgtcgcacccgtgggcgttctcccctggcggccgctccgtgcccgtggagtgcgcacctagaatacgcgcccgcgcccacatgtgggatgctttgatggactgccgtgagcccagaccttaaacgtaaacattcagcttcgcaggtactttgggctgcacacgcttctccggacccaaaagatgcacatgcttttcagaaaccgtaaggtttacctggggctgtaaaaccgcacatcgcgactttgcaccgtgcacacgcttgccccgatgtgagatttcccctgggttcgcgctcgggtccgcttcttaaatacactgcctcagcggtgtggatggcacagagctgtggcagccctactgaaaccttaaacaggcttcctggggtcataaacatggataccgagacttagatcacctcccacaacttaaacgtaccccttcactccactgccttcgccccttcctgcagcattcgcatctagttgttcaaaagtgctttccgggtcctcagacatgcaccccaaggttttaaacctcagtgcaagtactagatgggcttccctgtgcaatagggatgtcaggcgcgcagttttgcacacgattgccaagatgtgagatttactttaggttgcaccttaaccgtcgtttttaaatatgatcgtcccatcttgatgtgctgctcctgctgtggaaggtatccctgggttttaggcaagcatatgtgttctttactatggctccagatcccagcatatttgaagtcctgagtcaacctgctctcctagacaagcagacattaagtatgtcgcttgggctcttaagtgcgttctcctgacttttacccatctttgtggcagtaaatgcatacgtgtcactgtatatgcggactagatacctcaggtcccagcgccataaacaacttgtat

SEQ ID NO: 22771 - DNA, 1012 bp, Homo sapiens
agccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgtgagtggtgccagcagacgcaggggaggggccggccagggcagagcgagcccggaccgctcacgggggcggacatgggagaggaacagagcaccatgtcccagaccagctggggagagagggtggctagtgtgggcgtgacttctgggggctctgtgctgtccccacggcactggatggggcactgaccctggttctgcgggggcctgctcctcctctgccacat

SEQ ID NO: 22772 - DNA, 1033 bp, Homo sapiens
actggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaacctgcctgccttctctgctcactgcccgatgccttgcagccccctagctctaaggtggcccagcaggctggacagcccgggaactcactgggtctggctctcggctgtccacaccctcttcccccccgaatctccagacccgcaggccttgggttcaagttcagtgtcacagaacctgagctggattttgtcctcaggggtcacacctggccttgagccagcccctcggttgaggctcgtgggctcaccagctggctctcggggggccacacagcgccctccctgtgtgttccccggctaatgtctaaagtgctcatgccaggtcccagctggactcccctcggtagggccccaccttttgttacctgaaaatgtccttaaagcctcctccatgtaagaaactggcaggcctggagcccctcccccgtggggaccaccctccttccagcaaaatgccggccaagctcaaggagaaacagcgtttattgtggaggggagctgggcggggctcagccctcggagaactggcagtacagccgccccagcctcggctccacccatagccggaacgggatctccaggatggcagagaagccttcagccagcgttggggcctcgaactgcttc

SEQ ID NO: 22773 - DNA, 1058 bp, Homo sapiens
aggtaggacacatcttgccctcagtggtcacggtcccaagggctttgctgcccacaatcaagaaggccaccagtcaccaccttccagtcccaggagcatggaagtgaatgggaagacaggactgtcccagcccaggtcaacatggccagtgtctctgagactgcagccttgctcatcctactgggctcccggattggctgtgggtgctcccacaccaggcctgcccctgaggttcgaggctggtggggtgacagatgcagccagttagggtgatttgcaccatcctggggtcacacagggtgcaggggacatccagagaaggcacgtgacccctctggggaatggagattccttccaggaagaggtgatgctggagcttggcactgagggactcttgggagttttctcttctggcagagagagcagcccgtgcaagccagaggcaggcggcccccgtgtgtttagggagccgctggcctttcattgtagctcaagtgtgggattttgagtgaagaaaggttggaggtaagataggcaggggcgaaggacagacccgaggggcctcgagtgccaggttgaggaatagggcccttaccctgcaggtcgaggggtgcctaggaaggttctggaaaggtacatgtccactgggcccccttcccatcttactcatttgtgcttccaaggaatgtgaggccaggggcagaggggtggcttgtggcggggccctcaggagatgcctgtgccgaaggaacatcctgggttgtggttgataaggctgactctggcttcccacgcgcttcccccaacacagtgccgtctccctaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccaggtgagctctctcccagtgctgggcc

SEQ ID NO: 22774 - DNA, 1022 bp, Homo sapiens
cctccctgggcctcagtttcccctactgtgggaggatatagccagctggtgagtgggaggcctggcgcctcacagcaggagcatcagtgatagtttctagaaccagctctgcttctcccccagagcaaaccccgaggctgggggctgccagcaggaggagcagtgggggctggcactggtggccagcagggatgggcccccctacctttctcacctttgcaccctgtgcccggtccccgcagaaagggatgtgagccgcactgacaggaccaacaagttctacgagggtcccgagaacccggggctgggcctgctgaacgatatcctcctcacctactgcatgtatcacttcgacctcggtgggtgccaggcctggggacgggcgtggccggggctgtccaggggagcgctgcgggcttggctgcagcctgaccccatgtccccccaggctacgtccagggcatgagtgatcttctctccccgatcctctacgtcattcagaacgaggtggatgctttctggtgtttctgtggcttcatggagctcgtggtgaggcttgggtcaggggtgggacacaggcctatcgagcgatcaggtgtcctggtacctcacggggtctgctctttcccccctccttccgtcccacagcaagggaactttgaagagagccaggagaccatgaagcggcaactcgggcgactgctgctgctcctgagggtgctggaccccctgctctgcgacttcctgggtatgtctctcgggagggtgggcaggagacaatggggccatagaccttgccagattctctggtagcagccacagtggcatcctggacattgggtcctgatccaaacaagagaaacatccccacacaacctagaatgtagaggcagaattgctgtttgaagcaaaacttcaccaaatgcagacacgcaggaatgctgactcaccccgtcctcatgctcacctagatcctgtttgggctttgcctttggcttaacctgcagggtatttttcagaaa

SEQ ID NO: 22775 - DNA, 1131 bp, Homo sapiens
ggtaagagtgcatgtgccacgtgtggtggtgcacgccaatagtcccagccactcgaggctgaggagggcagattgcttgaggctatagtgagccgtgattgtgcgacggcattccagcctggtgacagagaagaccgtgtctctattttttaaaaaaagcatgtattgagtgccgactctgtacattgggttgcagtggaagttgagatgggaggagccctgttaccacatcaggcatcttggtgggcattaggaaaagcattccccgcccccgccaaaacgtggtctcacccaagggaggcgggctggagctcggtccattgtgaagcgggcagccttctttactgtctaggggagcactgcttcctgccctctgagagcgctaacctgcgtgggtgggcttctggaagaaggcctgggcagtgagaggcactgcctaggaaaagggtgggaggagcattgctagtgctgcagagcatgcaccagggcctcgctccctcattgtcccacaatctctgggggacctctctgtatttcccgacatctgtccaaaccccaccctctccccttcctcttactccggccctttcaccacccgagacggtcccagtaacccttttagtatgagcttagcagggcagggctgcagggaagcgtttctggcagaggagattggcgattgcagaggccctgaggttggggagagctggtggtttggaggaactacagggaggcccaggcagctggagcacaaggagatggggtggagaggaggtcgggaatcccaccctaccccttcccagccgctcctctgccaccaccctggaacactgccagggtccccttgaggggccgcctgcctccacccctgcctgatggggctgctcacagcacaggcagaagggtcctgtcagcacttaaggctgcccacttccctcctccgctcagaaccctccgcggctcccgtctcactgggagaagagctagagtcctctctgtggcccacaaagccctttaggacctggcctcgctcactctctgccctcagctctcaccctctccccctgttccagccactctggcctcttactggcacccatccagcatgctgcagccaagggcctgtgtact

SEQ ID NO: 22776 - DNA, 1048 bp, Homo sapiens
atcctggattcgctgggtgtttgagtactctgtgccaggcacttttctggaagcaggaacaagtcagagaagtccctgtctcgggaagacagacggtagacaagtgatgagttttaatagatcagtaaagcagtgctctggggctgtgagatgctctcagaaggaaactaacgcagggtaacgtgataatgagcgaagagcctgttgctttagctggagtggtccagaatcgaccgctctgggaccctcaagtgcaaagccctgaggtggaaggagcttggcgtatttgtagcaggagccgaggggacgagagaaacacagatgaggtcggagtcatgatggggaactagatcctatagggccttgtaaaacttggtatggaatttctcctttattctaggttcagcggggagccgtgggagggtttgagcgtggaaacaacacgattcgccccatgttttgaaaaactcaccactgagtggaaattggattgtagcaggaataagaatggaaggagggagatctgttaggagggagagcgtcctgcaggcagagaatcaggctccggttacctttgcgggcggagacagggggactggctgatggactgggcgtaggagcaaggggaagagtccaggatgactcctgggtttgtggtttgagcagcaggctggatggggaaggctaagggagaagcaggttggggttgccgctctgaaggcaaagattagtgggggagtgagtgggcagggtttagagcggagccaggagtgggcagggcgatgtcagtgcctcgcctcagcccttccactgaaggaacttgttgccactgtcttctcttttttttttttttttttttgagacagagtcttgctctgtcacccaggctggaatgcagtggtgcaaactcagctcattgcaacctccgcctcccgagttcaggcgagtctcgtgcctcagcctcctgagtagctgggattacggcacccactgccatgcccagctcattttttgtatttttagtagagatggggtttcgccgtgttgg

SEQ ID NO: 22777 - DNA, 1050 bp, Homo sapiens
tttaaaaacttctttctctgacaatttcaaattaacaggaaggttgaaagaataaatagtgtaggccgggcgcggtggctcacacctataatcccagcacttcgggaggccgaggcgggcggatcacgaggtcaggagattgagaccacagtgaaaccccgtctctactaaaaatacaaaaaaattaggcgggcgcagtggcggacgcctgtagtcccagctactcaggaggctgaggcgggagaatggcgtgaacccgggaggcggagcttgcagtgagccgagatcgcgccaccgcactccagcctgggagacagagcgagactccgtctccaaaaaaaaaaaaaaatagtgtaaagaacacctgcacgccctttgcccagatcacctgtttcaacattctgtcctatttatgatttgcatggatgtttcttatctcccttctctctgtatacgtacactcactttttacaaagaattcccaataccttgcagacattatggccgtttactcctaaatacttgagtgtgtatctccttagaatattcttattgaaccacaataaagtcacccacttaagtttaacctgcatataaccttgtctaatcaaccagaggatatatactttttttttttttttttttttttttgagacagggtattgccatcttgtccagtccagtcttaaactcctgggctcaagcgatcctcccaccttggcctcccaaagtgctgagattacaggcataagccactatgcccagtgaacttttttgttgtggttgtttttttgtttgtttgtttgggttttaattgttgttgttggtggtggtttttttttgtttttttttttgagacagaatattgctgtgttgcccaggctaaagtgcagtggcgcgatctcggctcactgcaacctccacctctcgggttcaagtgattctcctgcctcggcctcccgagtagccataattacaggtgtgtaccgccacacccagctaatttttttgtatttttattaaagatagggtttcaccatgttgaccagg

SEQ ID NO: 22778 - DNA, 1022 bp, Homo sapiens
gtcttgcctttggtccaagagtcagctgcaaagctgacctgtgaccccactctggccaattttgaatcctacaaaggactgcccttccaccccgtgcagcctgtgtggcctacagtgattctggccctgacccttgaccctcattctcttccaagtttcctgcctgacccagaccaccacctctgcctggctcctttcagaaccacatgccatcctggccggggaagaccatgactccatgtactccacttccttcccttcccccaccagggcaggtcccaccatcagccatagatcctcgctggcttcggcccacaccaccagcgctggacccccagacagagcccctcatcttccaacagttggagattgaccattatgtgggtgagtttaggggttatgggtgagtgctggggccctgcgctcctggggcagaggccgggccaggtcagcccctctggccctgtgctcctggggcagaggccgggccaggtcagcccctctggctctgcccctctggttgccatagagctgtagtgacagaacagaccagtgggtgccaggggttgtggagtgcgaagcgaaggtgacacagggtcagcttgagggaggtgcttggagcgttgatctgttttgcatacgtagtagctgcagcctgtgcaaggacctctgtgccttaaaattcataacaccagacacataaaccaaaagtcaatttgacttcttttttttgagatggagtcttgccctgttgcccaggctggagtgcagtggtgtgatctcggctcactgcaacctctgcctcccgggttcaagtgattctcctgcctcagcctcccaagtagctgggattacaggtgcacaccaccatgcctggctaatttttgtatttttagtagagatgggcttttgccaagttggctaggctggtcttgaactcctgacctcaagtgatccacccgccttggcctcccaaagtgcttagattacaggtgtgagccattgtgccagcccaatttgac

SEQ ID NO: 22779 - DNA, 1069 bp, Homo sapiens
ccactggagccccctgcacctctgatcatccctcccacaccaggtttcgggcccgagcacatgggtgacctgcaacgggagctgaacttggccatcagccgggacagtcgcggggggagggagctgactgggccggccgtgctggctgtggaactgtgctcccgagagagtgagtgctcccccaggatcagcgggttggagggtcccctcgggaggccattggctggtcccagcttcttccatccacaggcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggtacggcctctgcctcacttctccggcctctatccccaccctcgggcagcccctgtccactgacccccagccccctccaggttcatggtggacacggacatcgtcggctgcaactggctggagctcccagctgggaaatacgccctgaggctgaaggagaaggtgcagggcttcccagggcagggctgggtggggagctggtaccctgctgccaccgctgacccacccatgcccacaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggtctgtccccgggcccgggctcctgcccgcctcattgatgtgccaagtcgggggtcggaaaggcaggtccggtggagggaatggcaagcatgaaggtgccggggcaggagcaccccagcccatgtggccagatggagtgagcacagagggtgtggagatggcctggaggtgagagcagagcaggagccagggtgagccacgtagggccggcaggcagcggggacagccccggggagatggcaggtgcagcctccctgctgtgttgggagtgaggggcaggagt

SEQ ID NO: 22780 - DNA, 1034 bp, Homo sapiens
ggccagcttcaaacccaaacttaaattgccatgatgcaggtgtccaggttcccagagctggacgtcagtgctgcccagagtgtagtaatcgagtctgaggccccgaacctgagggcacaaaccctgaagctggtgcccctctgcaaaccctggcatctgctcagtgaacagctcccctgattctgacatggccaggtagttgggaattcctgaactccacagcctccgtattttgcagttggggaagctgaggctcagagaggttgtgtggctatccctgggtcacctggtgaggcagaggcaggatttgggagctgtggggttcatgcatctgctacgggttgccttgtgaggtggaacatggtggaggtgtccccactttgcagatagcaaaatgggggcccagatggggagggaacctggtcactcgggtggaggccaggccaaaatttgaagctggacctcctggcccctgcctgggttgaagggtgggcgggggagggggcgtctctgaacctgagctcctcacagatgacagtgccaacttccggaagcggggctcactgctctggaaccagcaggatggtaccttgtccctgtcacagcggcagctcagcgaggaggagcggggccgactccgggtgaggtggggccctcagggctgggtgtggatggggatggagggtttccagctgtctcttcagccaccccctgctggtccccagcagccttccctccaggcccaggtgggctcccagcaccacctgccactctcagcctctgtcctcaatgactgcccctggaggaacggcattgcagttcgtcttagcgccgccaggcatggtgtcctgcatcacggcctcttcctgcactgctccctctgctggcagacccccttcccctgcaggttcacacagtcggctcctcttcttttccagatcagctgagctgtttcatgaccacttagatgagatttgtttgtgaggagaaagcctcaaaatagctatggttggacaggagctcacttctgtcgc

SEQ ID NO: 22781 - DNA, 1065 bp, Homo sapiens
agccagatgtagctgtgagggaggctggggagtgcaggcttgattctggtggccacgcggtgaggtctgcctgagcacccttcctgcatggtacccacatgattctcttgtcacagctgtccccaaacagaatttattatgcatgtaactggtacgtccaggcatagggtggacgccaggtgcagctggatccaggcacagggaaggcgtcctcaggacccactccatcgctgggctgggctttgccctccttgtggtggcttttcccctaggtggggcggtcccagctgctcctggcctcacccaccagccgggccaccccaacaggaagagtcctgggtcgactcaggttggctggcctggggagtgtgggccgtgaggtgggtggggctggagaggggccttcgcggaggcctggtgggcatcacagcctgtccagggctgacaccatccttctgaccagcaccctcttctcccatccccaggatgtggcagccctgaatggcctgtaccgggtccggatcccaaggcgacccggggccctggatggcctggaagctggtggctatgtctcctcctttgtccctgcggtgagttggtgtcggggatgagcccccttctccctcgtcctcctcatcccctaccctggtcctgcttccaccattcgaacccctgtgtttctggagcccgcagaggcctgggagactcagacctggccttgccttccgaggcctcctggtctggaggggtcggtccaggtagcgggtgctttcatggggatagcattgtgaggactcccgggtggggggcggttgaacttgggcctgagggtaacagggagccatgggaaggttttgaaaaatgctccgggggtcctgtggtgggggccgggggaggttagggtggagcccaggcagcaggctccccacctccactgaccccactccccccacagtgctccctggtggagtcgcacctgtcggaccagctgaccctgcacgtggatgtggccggcaacgtggtgggcgtgtcggtggtgacgcaccccgggggctgccggggcca

SEQ ID NO: 22782 - DNA, 1036 bp, Homo sapiens
acagcgagagatgggagagacagggagagagagagagagagagagagagagagagagagagagagaagcgccaaagagaagccaccaggagcgtgtggaggggaagccaggtggaactcactgaaggtgcagggagaggaaggggaggcaggagtgagaggaaagaggagaggcaaatccaagggacagaaactggaggcaaaggaggcagaggagggagggagaccaagggcacaggccctaaccacagtgctgccccttgtccccggcccccttgtctccttctgacacagtcggttgctgtggacgggcacagtgagactggggccccatcagcgcctcctctgggggttgggtacagacgatgaggaaatgacagggcggggatgaggaggaggacctagcgcaggggaaggagagggcagaagacagtggggggtggcagtctggaggacaagggagaagattccagaaaggctgagagccacaaggtggacaatcaggaaaaggtggggctgggtggaagcgtgtggaggactggaatatcgcccaagggaggagcagtgtgtgcaagacctagagaggaggaaacactgaggatccagccgaagagaggacacacagggacagggacagcctgtgtgtgtgtgtgttatggatagggggaggaggaggggggagaggaaagaggaggaggagaaggaagaaggaggaagaggaaagaggaggaagggggaggaggaggaaagggggaggaggggtgaggaggaggaggaaagaggaggaggaaagaggaaggaggaggagggaggaagaagaggaaagagggagaggaggaggaaagggggaggaggggtgaggaggaggagggaggaggaagaggaaagagggaaaggaggaggaaggaggagggagtaagaggaaggaggaagaaggagaaggaaagatgaggaaggaggaaagaggaggaggtggagtaagagggaggaggaggttgcggtgagctgagatcgctccattgcactccagcctgggc

SEQ ID NO: 22783 - DNA, 1030 bp, Homo sapiens
ggcctccctccccttcggcaccccgtcctctggagcagccttgagggggtctgcagtggagagacacactctggattgggccctgttgtgggttgaattgtcacccagaaagggaagcgcagaagtcctgacctccagggcctcagaatgggaccttatttgggaattgggtttttgccaaggatggagctgaggttatactggaggtggaggctcctggtccagtctgacctctgtccttgtaagaggggaggttaggcaggctgcagtggcccacacctatagtcccgacactttgggaggctgaggcaggtggatcacttgaggtcagaagttcgagaccagcctggccaacatggtgaaaccccgtctctactaaaaatacaaaaattagctgggtgtggtggtagtcgcgtgtaatcctagctactcagggggctgagggaggagattcgcttgaacctgggaggcagaggcttcagtgagctgaaattgtgccactgcactccagcctggacaacagagcaagactctgtctcaaaaacaaagaaacaaacaaagaaaacggtcaggcgcggtggctcatgcctgtaatccgagcactttgagaggctgaggtgagtggatcacctgaggttaggagttcgaaaccagcctggccaatgtggtgaaaccccatctctactaaaaatacaaaaattagccaggcctggtggcgcatgcctgtgatcccagttacttgggaggctgaggcaggagaatcacttgaagctgggaagcagaggttgcagtgagctgagatcacaccattgcactccagcctgggcgacaagaataaaactccatctcaattaaaaaataaataaataaaagagggggagttggacacagacggacgcacacagagggaagagatgagaggctacaggggcaggcactggaagactggggtgatgtgatacagccaccagccaggacagcctggggacaccagaagctggcgaggcaggaagctcccctgaggtatccc

SEQ ID NO: 22784 - DNA, 1033 bp, Homo sapiens
ctcctagaaatatatatacacaagtattgaataggtcccctgccaatgtaggacccaagacttttactctgtgacattccatttgtccttggctgtacggaataaaagccctttgacgatggcggcctccaatatcataatccgtatgggtgcggccatgccgtcctccctaccaagtttctgaagttgaatgaaccgcggaataaaggtacgccgttatacgccatgataactgttggcggagcgtagcttcaaaagtgttagtgggcatgcgcgcggttcaacagcgcctacggaaatcctaacgggaatgtaacccaaaccggaagtggcctagagcgaccatttagcttctgttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggtgagtgacgggcttgttttggctgagcgatgaggggtttctggggtgggtgatgggtgctgtggggtaagtggcgtttgctaattttagttggataattagcctgttaattttccctcttttcttgcttattttctgcttgtagtatttttgtgacttaaattccaagtgtactttaatatcggattttatattggtccacgaaacttgctaacttgaggacagtgaacgtgcatcttaagagcgcctttgcggatggtgctggaggacgttcagggaagggattcactgtccgtgggactaggggagtcagtgattgattggcagccaagagcttcagaggttggaggactttgaggatcacactgtaacactctcaggggaccagtgatgggcaacctataggaatcagtagagtggggttgccaggggtagcctatggcagccagttgactggaggcgtagggggtcaatgatggggatttgtgagggtgaatgca

SEQ ID NO: 22785 - DNA, 1038 bp, Homo sapiens
tccagggagggggagccccggaccgcagagccggggaggaggtgacggccggagggagtcggggagaagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctgagggaggagcacccgggggcctggatttcagggttcttggaggaggagttgggggtggggagggtggggtggctgggagcccagactcctgaatccttgaaggagggggctgggacctggatcccggggtccagaatctggagaaggctggggacacttcctggattcaagagggaggacagagatgggggctggggctggtaggatcgtggctggaagagactaggggcgagctgcccgagccctcgggggaggtggaggaagactggctttggagtgcctgcggcagcggaagggttaacgtctggctggaggggagggggaggcgcagggatggggctgcggggctttgaggggtcaagggtgagccgtgccagtgggagggggccgaggaggagggggaggttgtctgggctgccagacaggccagggtcagcggcgggggcaggagatgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcagg

SEQ ID NO: 22786 - DNA, 1942 bp, Homo sapiens
ggggccgggggcccggactcctgggtcctggcacccacccgtagaaccgaccttgcggggccttcgccgcacacaagctcgtgtctgtgggtccgtgtcgggggctcaccatcgcggctggggcctccccggccctccccctcatccctggtcctcctggtccctgtctgtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggacccccagccccactcagggacccttagccccactgggctgccccagggaccctgggaggaagagccgggctcttttctgtccttgtccctgcatcccctccttcccctgaaatctgttttccttccctgtctgtctccatctctgctgtgtctctgtggcttctgtgtctctttcacagtggatcctctgactccctcttattctggctttctaggtctctgcccctcccgatatctctctgtgtctctatttctgtcgtttttggtctttctgtctctggctctcagaatgtctctgtgcctatctccatctctgacccccaccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgttgcggggagctgcctcccccagcccctgctccctccctcaccgccagactatgatgagagaagccacctgcatgacaccttcacccagatgacc

SEQ ID NO: 22787 - DNA, 1028 bp, Homo sapiens
gatgggtaaaggtgagatccttttggatatcttggataagaacccttaaatttatctacagacctgtcaccttggagagctgctactgttttaaagatcctggctcctctgtggtatgctgaattggaacataagatttctcttcatcattccttctcacttggggttaagacccttgtcctctcctatactcagagttccttcccttgatctaataaagatacatccatgttagaaacagtcctgctcacaaggaaaaataaagtggaaatttgccataaagtggctgcctcacagtggaaacccgaagtctgggttatcgggtgattacaacaaatagtttttgagcatctgcactgtggtagacacttgtacacacaggatacactgaagaacaaacataaagtagtggcctgtaacaggatggattcagtacagatgctctacagttaagagtataagaaatgaactcttcttcaacctggacttcagattctctctacttcttgccttgtgaatctgcacatcctatcatagcagtcgtagcatcttactccctgaacacataaatcagggtgcgctactgggcttcccaggcctgtccttgggaccaggtgttgaaatcacctttcagaagttggcatcccagctaaataaatttaactggatactcagttccaggttgcctctttcaaaaggcacatcaccccatgccttcataaaaatggtagccgacatttattaagcatgcggtttgccaaatggtaactgcattatttagtaatttaaaaaaattaaagtttgtttttgtttttgttgtgtttgagacagggtcgtgctctgtcgcccaggctggagtgcagtggcctgatcatggcttactgaagtctggacctcctgggctaaagccatcctcccacctcagcctccagagtggccgggactacaggtgcatgccaccacactctgctaatttttgtatttttgtattttttctgtaaaggcagtgtttcactatatttcccagg

SEQ ID NO: 22788 - DNA, 1049 bp, Homo sapiens
ctgtctgtctgtgctcagctctggcaggaactggggcacagagaggagccagtcctgggctcgctgattatagcctatgttaaggatgtggtaaaggtggcatggaaggagagagagactgagcccagagaaggtgtagcggacatcctagaaatcttccaagaaggggcggctaaactgaatctccaaggataaaaataaatttctggcagagggaacagtgctgaggggagaagctggaccccaaaaaagctctcgttgaccatgctctgcgctttatacacctagtcatatttgctcctcactgtaaccgttgctacgagggagggatggtgaacaccattttacagacgcagaagctgggactcagagaggtggaatcactcagtcagtatttcacacccgctagagggcagaagcaggacttagggctctcttatcccagccaagcctgtaccttaatatctgtggcagcccaggtggagagtgggggagcaagtgggcggatggaagaactgagtgctgacagcctgaggaagcagaatggagtccatgtgttctgagcttgggctggggtcagagttgagatgggatagtcacgaagtctgtcttggttccacagataccatctatgatgaagatgaggtcctcctggccctggcagaacagctgggaaccttcactaccctggtgggaggcccagagtacgtgcactgcctgctggtgagtggaaggcaggaagtcctcttgcccaccccttagggtcggcccatggtcctgccggcctagggcagggaggggagcgtgtcagagagcgtggggatcacgtcagaacagccgggccatggacatccgctttaatccaacaagtcaggagtggcttttaatatcgtgaactcagggtgcagttatcatcctttctgtttagtggtcaggtaggtgcccagtgccaggccttacctgggattctacatagggctgtgggtttagagtcaggttgggttctactgcttatttgctgtgtgacttgtaagagaattacttaccct

SEQ ID NO: 22789 - DNA, 1007 bp, Homo sapiens
aggcggttcacactcttccctaccctgtgtggtctccaggtttgagaacccttgcccccagacttcacagagaggcttcacagtagtgagtcttcactgtgcaaaggcatcaattgcagtttcttaaatgtgtaccttcctgggccctgcctccagatattctgattgttttggtccatgctgggataggcctccgggtgattctgctgcagggtggtcagggatcatcctttgagaactacttcctgcagtaacctacaggagaagagaaccttggcttacataattactgctcagcctctgtcccaggcctccttataacagattgccgtaagttccaccggtagtcacttggcaagtgttgattgagtaccttctctgtgccagcccaggtggtgggagaactgaggtgaacaagaggaactctgtccctgcagtatcccagtcacaccgcacctatggtcacactcccatgatactgtcctgaacttgagacgtcacgatagcatgaggacctgtgacagtgacattatgctggcttgcttagtattacatttttcctttgaatcattcattgcaactatttttaaatgctatttttaaacatttgtttttattcttagttttactgtaaaaatatacatagaatgtgctattttaattattttaaagtgtgtagctctgtggcggtaggtttattcacattgtgcagccattatcaccctccatctccagaatttttcacctcctcaaactgaaattccaaacccattggacatgagctcccccttccctctcccccagcccctggcagccaccgtaggagtttgactgttctagattcctcatataagtggaatcagaaaatatttgtctttatgactattagctaatttcccttggcataacatcttcaaggttcatccatgttgtagcatgtgttacatgagacttctcacatacaagattcttgagtttttttgagggctgcatttggaaaaccagat

SEQ ID NO: 22790 - DNA, 1023 bp, Homo sapiens
agctctttccatcctgtcctgggttgctgtgtgcattgcattctctcagaatccttctttcctctcctcagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctggtgagtgaggaggcctgggggccaggcagtgctgcctcaggggaggtgcagtatgtccagggctgtgatggggaaacggggctttgaaggcttagtggaggctgtgacaactgcctggggagtcgaaggaagggacccaggaaatagggccttaaaagatgcattggattcaataagagagaggagggaaaggagcacctcagacaaagttgagaagtgtccggtctttctagggtgggtgtaggttccatgggatgtggctagcagctccccctgtttgctctcctggaacgcttaccttggaacccttggtttctcctgtagggagtggagttctttgatgagaaacttaactccttgtgcatggcctggcttgtggatcatggtgagtaccttcacaggagcagcaagaggagatgggagctccagaaaggcaggatggattggctggggctgtggcgggcagtggaggaggctagagtcactccccacgccgctggatgctcgtatggaccagctcgcatgcttgttagagtcctagagaagtgttgagtgggaggaggacgaaacagatcacccaggggttgcctggtatagtggagagccagagggccactgagcagccagaccagggttttgaatcctgcccttggggctgtcagatctaaaacaagtcacctgctgtctttgaatgagccccacactcattctttgaaacttcttattctggtgccttggggccattatgagaatggctcattgtttacactaagagagg

SEQ ID NO: 22791 - DNA, 1580 bp, Homo sapiens
cagttttgtattgtgtaaaatgagagttacagtaatacctagattgcagggtgggtggcgaggaccaagtgaattagtacctggaaagtgtgtaacagtttcaacatgagaagtacacaacatgagaagcagagttagctgtacattgccagagaaccccctgtgggccatttcctgtgttcttgaagaagacttgggcttggaccctgtccccaggaggtctcagagtaatcaggacggtactagggagagaactgtggcaagatagatcagttatctcggtatctattctccccttcctaatgtagaagctctgatttttaactgggcagatgactacatggattcaaggtattttcctagtgtctcttgaaattaggtgtggtattgtgaccaaattctagccaaaaagatgttgaacagaagtggtatatgcagcttctaggaagtgttcttaagggggaaggcgtcatcccccacctttcctccttcctgcactctggaatgtggaccagatggctggagtaggagctgccacctggggccagaaaatgatcttaggcgtgaaggtcaagtaaggcaggacaagagagaaggagcctgcctccccgaggctgtgaagagccatgccagtactgtcacctgggagaattaaactggtcaagtgcctgttcgtttagggtttcatcacttgaaggtgaccggaattctaactgatggagggaggggcccagagcaccctggagaaaggagcaagggacgtatggctggtggtgtctgcatggaagggtttcacagaggaaatgatgcttgagcacattttgacccaggtggtggaagggaaatgtggctttgagtgacaaggtgatttcaccagctcagccttcatattaccacatccctaccctttgttagactttattgtgccctaggggatgaggctgaaggagaccaaaaagcatctttagaaatttccatttatgccctgggcgataaactctctcccagttgagaactactgctctagaaatgtgaacacacgtgtaaccaaacgtcaaagtctgacattaaactttgactttccccatggttaacgctgctggtccattgtaacaagagtgcagtggaccagcagcctttgcattctcaggagcttgttagaaatgcagagcctctcgtccctgccccgacctgctcaggcagagccttcattttaacaagatgcccaggttcatctgcacactgaagttagagaagtcctgccttaaatactaacccagtttttctctcttgagagtgaggttaatgctacgtgggtctagggctgaggatgtgctatggctcagaggtggggtctacaattggacatgtgtatgtagacaaggctcagggatatgttgaggctgctagattgggcaagtgatggaatgggattattacaggaggtggaggtgcgatggatacccaggatgtgctgggtaatgaggtgatactcagcgaccacaggagtgagtatgagagacgagggtgaaggatagcttgagttattgaacgctggcagagtcctgagttaaccagga

SEQ ID NO: 22792 - DNA, 1033 bp, Homo sapiens
cttaaaggtctccaattagttttaattcaaataaaacttcagcaagacgtgttgtaataaactgtcaaaaatcaaagacaaaagcacaggggtttttgttttttgttgttttgagccagagtcttgctctgttacccagactggagtgcagtggcaccatcttggctcattgcaacctttgcctcctgggttcaagcgagtctcgtgcctcaggctcccaagtagctgggactacaggtgtgcaccaccgcacctggccaatttttatattttttagtagagacagggtttcaccatgttggccaggctggtcttgaactcctagcctcaagtgatctgcctgccttggcctcccaaagtgctgggattacaggcatgagccaccgcactcggcccaaagacagagttttaaaggcacaaaagaagagagactcatcatttacaatggaactctataaagctatcagcagacttctcagtaaaaactcttagaggccaggaggacagtaggttgatattattacattacagcagaaaaaaaccctggaagctaagaataatttacttagcaatctgtcctttacaaatgaaggacgttgtataaggactttcccatacaaacaaaagctaagcaagtatatcacttctaggcctgtcttacgaaaacgataaagggagtttttttttaatatgaaaaaaaggacattaagtagtaacgtggaaacgtgaaaggatagaactctctgataaaagtaaatgcagaatcaaatttcaggatactctaacactgtaatggaagtatgataatcacttatatattgagtataaagtctaaaaggcaaaactgttaaacataataggcatattaacttgtttagggatatacaatataaaagaagtctaacatcaaaaatataaaatgtgggtggaagaataaaagtgtagtgttttctatgtgatagaagttaactttatcaggttaaaatagccatttataagtaaaatatgttatatgcaagactcatgctaatca

SEQ ID NO: 22793 - DNA, 1048 bp, Homo sapiens
tattttattccagtcccctccctgtgaatgtgaagtgaaagagagatggagagcgaggtagaggaaacagaaaaatttagagagaaaataatgaggaagatccataacaagacggcaacgcagagggagggtgagagatttgcaaagtgaaagaagcaccccaggaagtagcagggagagaaaagcaactcgagaaatgtagagaaaagttctatttctagacagatgaaggacagcaaggtagggagaggggcagcaaagcgggaggctcctcagacaaagttggggagaggaggagggatttggagccagggcagaccgagcagcgtggtgctggcacagcaagagggggcagccggtgacaaggagggcaaagggagaaccaccccagagatctggggttgccagacagtagggacaagggggcgtgacagagaagagggaatttaacaggaggagcacagatgggagaagaaagaggcagaaatatatggagattggagacaatcaaaagattggagagaaagagcaacaagaggaaaaaaattgcaagatggagcagatgaagtggaaaagaaggaatagagggaagaaggggagaaactgcgggagaggagaggggctcaaaatctcggctcactgcaaccttagcctcctgagttcaagcgattctcctgcctcagccacccgagtagctgggactacaggcgcccgccagctcgcctggccaattttgtatttttagtagagacagggtttcaccgtgttggcctgacgggtcgtgaactcctgagacctcaggtgatctgcccacctcggcctcccatagtgctgggataacaggcttgagccaccttgcccggcctcctcacattttattaatttgctggaatggttcccagaactcagagaaaattttacttaggtttactatcagttataaaggttattacaaaggatacaggtggaagagccatcctagcaaatcaaaatagaggagtgtgttttggaaaccgttaattttatccatatctgaggtgaggggcag

SEQ ID NO: 22794 - DNA, 1039 bp, Homo sapiens
acatcacaaaatgcagtcaactctaggacaactctagcttcctctggaagctcctgccatcttggttaggaaagactctgattttcttcatgataatatcttacgttccttttatagttacagatacaggtctcattgcacaatatgattgttgaaaacacttgtgaaatttttttagtaaaattgcctaagatactttttatagtagacaatgaaaattagtgtgtgggtttataataaatataatgtattatataatatgattaaaatatatttgttataaatatgatattactagaagagcatttttccaaaagctatggaaatgtcattttcccgttacagcatcaagcaatatattccatggttcattttcaactctaataaaattatattttgtgtttatatatgcacgtatagacacatatataatattttttttttacttttttctttttctgtacattgcatccagatgctatgcttgtttgtttttttttttgagacagagtcttgctctgtcacccaggctggagtgcagcggtgtgatcttggctcattgcagcctccgcctcccaggctcaagtgattctcctgcctcggcctcccgaatagctgggattacagacatgcaccatcaccacacctggctaatttttgtatttgtaatagagatggggtttcaccatgttggccaggcatggtcttgaactcctgacttcaggtgatccacccgcttcggcctcccaaagtgttgggattacaggcatgagccaccatgcccggccagatgctatgcttaatacattttttccgaatgtcactctagtgaaaattttaggggacacaaaaatgagactgttgtttggagacaatattttttgacaagagtatgcacaagacaatggcaggtataaacgttttattgtaaatatgaaaaaggaaaaaatgctttcactatattagaggacttgaagtaacgtgaagtgattccaaccctttatctttattttatttatttattttattatttattttt

SEQ ID NO: 22795 - DNA, 1032 bp, Homo sapiens
ttttaaaatataacttcttttggaaaagtataataaaacacaattcacaggccagggtggtggctcacacctgtaatcccagcacttagggaggctgagatgtgtggacaagagttcaagaccagcctggccaacgtggtgaaattccatctctactgaaaatacaaaaattagccaggtgtgatggtgtgcacctgtagtcccagctacttgggaggctgaggcacaagaattgattgaacccaggaggcggaggttgcagtgagccgagattgcaccactgcactccagcctgggcaacagagtaagactctgtctcaaaaaaaagaaaaaaaacacatttacagacacataactacatcacagataccttaatggggattcgtcagaacattctcttcaatccagttaatctttacaactcccttctcattttgagtgaagattaataccctttacatatcctgttggtgaaatgtggttttcattttagggacacttaacattcagggacgtggccatagaattctctcaggcggagtggaaatgcctggaccctgcacagagggctttatacaaggatgtgatgttggagaactacaggaacctggtctccctgggtgaggatcatgcccctgcagaagccgggatctgcccttggttatttcagcattttcccttgtgtgcctcctgggagcccctgcattgtttgactgacattaagcaggagaatcacttgaacctgggaggcagaggttttggtgagccgagatcacgtcattgccagcctgccaacagagtgaaactccgtcccaaaaaaaaaaaaaaaaaaaaaaaaaccaaaaaaacccttattgactcaggctgggatccgtggctcacacctgtaatcccagcactttgggaggccaaggcaggaggatcacttgaggtcaggagtttgagaccagcctggccaacatggtgaaaccccatctctactaaaaatacaaaaattagccgggcatggtggtgggagcctgtaatcccagc

SEQ ID NO: 22796 - DNA, 1035 bp, Homo sapiens
tatcctctcatttgggttaccagtactgtctggaatccttttatttcattttgaagggctccctgtagcatttcttgttggacaggtctagagtagtaatgaactttcttagctcttctttatcgaggaaaatctaaatttctcctttatttttgcaggtgacttttgctaaatatagtattcttggttgattttaagcactttcaatatgtcatctcactgccttctggcaggcaaagtttccgctggagaaagtacatagtcttataccttttcctctaaatggcaaatatcttttttgttgctcctgtcaaaattcttcctctgtctttgatgtttgataatttgcttataatgtatctctgtgtgaatgtccttgggttcattttaatttgaatggtcaagcttcttgaattgtatattcaggtctttcttcagaattgggatttggacaattatttggacattatttcttcagttgcaatttctgatcctctgtcttctccttgtgaacctctaataatttgtatgttgttgtgcttgagagcatccgaaaaatgtattagcgtttatttgcttttcttctctgttttttgtttttggtctttgtagctgatactgtgttttttttttttttttttttttttaaattagagtcttgctctgtagcccaggctggagtgtaatggctccatcttggctcactgcaatctctgcctcccaggttcaagcgattctcctgccacagcctcctgagtagctgggattacaggtgcatgcccccatgtccatctaatttttgtatttttagtagagacaggctttcaccatgttggtcaggctggtctcaaactcctgacctagtgatcctcctgccttggcctcccaaagtgctgggattacaagcgtgagccactgtgcctggtggagctgatacttttgaataactgacctttaagtttgctcattctttttggtgctctatccatctgctgttgagcacctaatgaatttttactttatttattgtgtttc

SEQ ID NO: 22797 - DNA, 1050 bp, Homo sapiens
ctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcctcggatcattgtcccttcttatgtagtgataaagtaaccttccttgaagtgtatctatccgtaatcaatcaagttgctgcagcctatgcactggcccagaataaaaaacgtggtgattctgctaaagcttctctgtctttccctgtgtgtgaaatcttaacgtctctacttgggaacgctgatcccattcatttagagttgatgtttccacgtggctatttccaagctttgccttcaaataaattctgtacttaatcatatattctaaattttattatttactgctgacatcagtttctgtcggattgtaggagcctcaccagagagggcccctgtcgccatgttgtaaaactcacacttgccaaaagttgtgggttagggtttctccccctccctcaggatgacgctagttagctgacacagatggtcacctccattaccaagtagagtcaggatgaactatgtgtgactgttcaactatgtgtcctcttccctgaggactgattagtgtttatcttgaaaacatgtccttaatgggttgtatagaacactgaagcatctgatttcaaactcttagctcttttcctctatttcccatcacattctggtctaaggcttatttattaataaaatgatttttatttctttattatcgtggagatgatttttcatttgggggaagatcattttg

SEQ ID NO: 22798 - DNA, 1044 bp, Homo sapiens
ccgcccttcctcgcccgggccccgcccaccttatcagggttcctcccaggcctggctcctgtcctgcgcagattcgcacagacacggcagcggatcacctcagtgaaggtcacactgcagcgcctgagtttggctctgtctctagttaagtcggcccttcgcaggcccctggctctgctatacttgggacgtggggtccccagagacctggaaattcccacccccttttctccaaatagagcatattgagacttccctgtgagggtctgcaggtcgcttccttttggggttttttttgcagagacagagtctcactctgtcgcccaggctagagtgcggtggcgcaatcttggctcaccatgacctctgcagcccaggttcaagcaattctcctgcctcagcctcctgagtagccaggactacaggcacctgccaccgtgcctggataatttttgtagtttttggtatagacagggtttcaccatcttggccaggctggtcttgaactccttgtcaggcctctgagcccaagctaagccatcgtatcccctgtgacctgcacgtgtacatccagatggcctgaagcaactgaagatccacaaaaaagtgaaaataaccggttcctgccttaactgatgacattaccttgtgacattccttctcctggacaatgagtcttagaagctccccactgagtaaaaggatattaaccccagaggcaacaaaagaaattaaattagtggaagaaaaaattcagtcagcacaaataaatagatcccttagtctcactccaacttttgatttttgctactgcacattctccaacaggcatcattgttcaaaatactgatcttgtggagtggtcattccttcctcacagtacaattaagacttttacattgtacgtggatcaaatagctacattaattggtcagaaaaggttatgaatagtaaaattgtgtggaaatgacccagacaaaatagttgttcctttaaacaaggaacaggttagacaagcctttatcaattctggtgcatggcaga

SEQ ID NO: 22799 - DNA, 1106 bp, Homo sapiens
gggcttttgagtccatgcgtcagccttcctgggcggtctcaccttcaccacccgaaaacaggtgctaggagagaagctgagaggagcaccggtcacgccccggccccgccctctgccggctctaaagcgcaaggtctctccgcctcgcgccccgcccctgcctcgtccaggccccgcccacctccttgcgggtcccgcccaggcctggcttctgctctgcgcgcgcagattcgtgcagaccaggaagcggatagcgtggagtgacggtgccaccgcggcgcgtgagtttcgccctgtcttgtattaagtctgctcttccaggttcctggcgcttctgtacctgggacttgggatccccacaaacctggaaattctcagccgtcttccttcactcagagcaaattgagacgacctcgtgagaggccgtgggtcggttccttttgggtttaaggtccccctgaggctggtcccgtcccgggtgtttctgctacagggcaatgtatacactttctaacctgtagttttcctgctgtaaacctttttctgactcctcccgccccgcgctttttaaagtcctcacctgagaggtggattctcgcctttgtcggcccctggagcccagcgccgctgccccagtcccggaaaggccgcgtcctctgcctggtcctaggatcctgcagaccccacccttgccttaaggtgctgtcgccccttcacctccctccttgtgccgggccctgctgctccacgggtttcgcctccacaatcaccgcttcccctgagcccgcgttggggaggtgcccggggcctgtcctgtgacgcggggtgttactgcctgcccagctccagcccctggaaaatgcgctcccccgggatgcaggcgtcttactccaaaccctcctgtgactgtgtgggccaaagggatcaggagacggacagagagcagtggaaaacctgagacagaaaagaagaatgagaaagacctataacagatggcaaagtagaggatgggtgagggatttgccaagagacagcaaaagtgaaaagaaaacgataagaaagcaggaggagaaaagcaagtgcagaaatgtagagaaaagctggat

SEQ ID NO: 22800 - DNA, 1007 bp, Homo sapiens
tctttttgcctaggattgtcttagcaatgcgggctcttttttggttccatatgaactttaaagtagttttttccaattctgtgaagaaagtcattggtagcttgatggggatggcattgaatctataaattaccttgggcggtatggccattttcacgatattgattcttcctgtccatgatcatggaattccatttgtttcctcttttattttgttgagcagtggtttgtagttctccttgaagaggtccttcacatcccttgtaaattggattcctaggtattttattttctttgtagcaattgtgaatgggagttcactcatgatttggctctctgtttgtctgttattggtgtataggaatgcttgtgacttttgcacattgattttgtaagggatactattgattttttaatgttgacgttgcatactacaactttactgaattcatttattatttctagtcattttttgatggagcttttagggttttttatatgtataagatcatgtcatctgcaaacaggaacagtataacttcttcacttcctatttgattggcttttctttttgttgcctaattgctctgcctaaggcttctagtactacattgattagaagtggtaagagtgggaatcctcgtcttgttcctgatatttcaacttttcaccattgattatgatgttagctatgtgcttgtgttatatcacctatattatattgaggtacattcctcaatacctaatctgttgagagtttttgttaggaaagcctgttgaattttgtcagatgctttttctggatctattgtgatgatcatatggattttatccttcattctgttaatgtgctatatcagatttatagatttgtatatgttgaaccatccttgcattcctgggataaatcccgcttgatcatgttgaatgatcctttttatatgctactgagttcagtttgctagtatcttgctgaggatttttgcttttaggtttatcaaaggtac

SEQ ID NO: 22801 - DNA, 1480 bp, Homo sapiens
gaggagggtgaaatgcattaacacgcataaaacccatagacgcgcacccctgagtgggagtgcacagtgagtgctgctgttttgtgctaagtctggatgtctgtacatcaggagcaacgtacatatgaaggtaactgggatgggtgtttgcaggttcacaaaatgaaccacagcctcaaatggcctagaactgttatccttaacctgagggcctgcctttaactccacttacaactttccaagggacattctgtgtatatttactgtatgtgattatcagtgttagtgtatctgtcccccaccaccaccaccctaaggagatactctgtaatttcatggcattaagaaggatggacatgccccaaagacatttagacccattggtctacaatcgaaggctgtgtaccttgaccacaattattgttcaggatggtggaaatggttaagtaattataccacgttcatttcatggaatactctgcagctacaaagaagtaagtttagttataaccgtaagaaagaaaaatgcacctgacataatattaaacactactaatagttattaacaatagtaaatgaaggaaatgcttcagttgcctacaaattccattgaataagatttttgtaaataccttatccaacatgacattttagtatattatttaggattattcatgaatccttcaaaagagaggagcctggccacatttattgagcgcatttttgtaccatactctattgtgttttgcacacactccttaatttattcttaccttagtctgtaacaaagtaccatagaccggtggctgaaaccacaaacatttattgctcacagttctggaggctggaagtctgagaagagggtaccagcatggtcaggttctgatgagggcccttttccaggttggagactgtcaccatcttgctgtgtcctctcacggaggacatgtgtgtgcttggaggctctttggcagagctctaggaggtgtgtgtgcttggaggctctaggagatagtctttttttttctgtaattgagatggaggcttgctctgttgcccatgctggagcgcagtggcacaatcttggctcactgcaacctccacctcccagattcaagtgattctcccgcctcagcctcccgagtagctgggattacaggcacatgtcaccatccgcagctaatttttgtatttttagtggaaacagggtttctccttgttgatcaggctggtctcgaactcctgacctcaggtgattaattagccggcctcagcctcccaaagtgcgggattacaggtgtgagccaccgagcctgccctgtgggaggtattttatgtccttgcttttgctggcttctagacactgccccacatgccttggtttgtgaccccttcttccatcatcaaagctgcaaagacaggccaagtcccttttccatcacgtcactctgaccctacttctttctgttcatctcaccct

SEQ ID NO: 22802 - DNA, 1067 bp, Homo sapiens
gaaaatatgttcttttttcccagatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcattt

SEQ ID NO: 22803 - DNA, 1046 bp, Homo sapiens
tttgctctgtcacccaggctggcgtgcagtggtaagaccatagctcactgcagccttgaacccctgaacccaagccgtcctcttgcctcagcctcccaaatagctagaactacaggcacatgcccccattttttgtagacacagggtctcactatattgcccaggctggtctcaaactcctgggctcaagcaatcctccggcctcagcctcccgatgtgttgggattacagatgtcagccactgcacccggcctcacggcttcttatacatcccagaaagcactttgctttagattcggagatgggagccgttgaaggttcttgagcagaggagtcacacgagctgacttacatttttgcggtatgtttcttgctgctgtgttaacaaatgaccgaggggaaggcaaatgagacaacgagaggctcatctagggtgggggcagcagggtttgggaagttgtttgaattttgagtatattctggagctaccgtgggcaggagttgctgatggagcagttgtaggatatgagagagaagagccaggggcgtctccaaagcagggtttttccaccgcagcatggttgatattttggggtggataattctgtgtggaggggccgtcctatgcattgtaggatgctgagcaacagccttgatctctcctactaggatgccagcagcgcccttcccagtcgtgacaaccaaaattgtaaattgtgtctaaacattgtcagctgtctcctgggggataaaatcgccctgagttgagaatcaccgctctaaggctttggcctgagctcctgagaataggggagccattcataagatgaaacagcagctgttttatttattttctcttatcaaatttattatgaaggagagggaccatgggctcagttttgggcatgttaaatttacgatgcccattaacagataacatctggacagaggtcagcacagtgaaggtcctataaagtgccatatagtaaagatttcaggctttgtggagcagtctctatcacgactactcgtgaaaacgaccaaga

SEQ ID NO: 22804 - DNA, 1047 bp, Homo sapiens
atttaaaaattagctggaagtgctggtgcgtgcctgtggtcccagctactcaggaggcttaggtgggaggattgcttaaacccaggaagtcgaggctaaagtgagacatgatcataccactacactccagtctgggcgacagggcaagaccccatctcaaaaaaaacaaaaaaaaaaagagagagaagagaccagaacaaatgataaaatgtccttatgtcattgaaggcttaagctttcggccagtctactattaaaatgtgagggagatggccgggcgcggtggctcacgcctgtaattccagcactttgggaggctgagacaggcggatcacgaggtcaggagttcgagaccagcctgaccaacatggtgaaaccctgtctctactaaaaatacaaaaattagccgggcgtggtggcgtgtacctataatcccagctactcgggaggctgaggcaggagaatccctttaaccctggaggtggaggtttgcagtgagctgagatcgtgccactgcactccagcttgggcaacagagtgagactctatctcaaaaaaaaaaaaaaaaaaaaaaagggagggaggtgagaagtcaccaaaggagtggagaaaggagtggccacaggtttggggaaaaacaggtccttggatgtcttggaagccaaaggaagttagcgtttcaaggagaggaggaatgaaggctgactctgttgttgttgtaattgtcattcatttgtcactgaatgcgcacaataaccctgcaaagtaggtactttatttatttatttttattaattttgttttcgagacagattcttgctctgtcacccaggctggagtgcagaggcgcgatctcaacccactgcaacctccacatcccgggttcaagcaattctcccgcctcagcctcctgagtagctgggattacaggtacccaccaccacacccggctaatttttgtacttttagtagagacggggtttcaccatgttgaccaggctgatctcaaactccggcctcaggtgatctgcccgccttggcctccca

SEQ ID NO: 22805 - DNA, 1013 bp, Homo sapiens
gaccagcctgggcaacatagggagaccccgcctgtgtaaaaaattaaaaattagttgggcatggtgatacatgcctgtagtccccactactagggaggctgaggtagaaggattgcttgagcccagaaggtcgaggctgcagtgagctgtgattgtgccactgcactccagcctgggtgatagagcaagaccctatctcaaaaaaaaaaaaaaagaaaagaaaagaaaagaaaaaaagaaatataacatgggtgaccatatatagttaaaatttttaggctgggcacggtggctcacgcctgtaatcccagcactttgggaggccgaggtgggtggatcacgtgaggtcgggagttggagaccagcctggccaacatggtgaaaccccgtctctactaaaaaaacaaaatttagccaggtgcagtggtgggcaactgtaattccagctactcgggaggctgaggcaggagaattgcttgaactcgggaggtggagtttgcagtgagccaagattgtgccactgctctccagcctgggcaacagattgaggccctgtctcaaaaaaaaaaaaagaaaattaaaatttttctagtagctacattaaaataaataaaaaggaacaggtacccagcatagccaagatattatcacttgaacatgtaatcaatataaaaattattaatgaaatattatacatagacactctctctccctttttccccatcctgagtctgaaacccagtaaatattttaccctcacagaacctctccattgccacatttcaagtgttgggagctggaggcatctgcatgggacagcccagcttgtgccccctcctcagggatttcagccacaccccgaggtcttctctcaggactcaagagtctgggcccacagccctatttattagtgccgaccatacagagcccctttgctagcactttgccctgcttattatctcattaagccctcgccactttgccaggggaatgtattattagcaggaatctga

SEQ ID NO: 22806 - DNA, 1030 bp, Homo sapiens
ggcttacccctgtactcccagcactttggaaggccgaggcaggaggatcgcctgaggtcgggagatcgagaccatcctggctaacacagtgaaaccccgtctctactaaaaatacaaaaattagctgggcatggtggcacacgcctgtaatcccagctactcaggagctgaggcaagagaatggcttgaacccaggaggtggaagttgcagtgagccgaaatcgagccattgcactccagcctggtcgacagagtgagactccatcccaaaaaaaaagaaagaaaggagggacattgagcttgtcatcttacctaccacaccatggtggaggtgctgatgggttaagagtttgtatgtgggagttgtatattcattcactcattcactcattcattcgttcattcattttgataattgtagtaaattatacataacataaatttaccatcttcatcatttttaagtatgcatttcagtagtggtaagtgcaaccaatttccagaactcttttcgtcttgcaaaatggaaactcagtacccgttaaataactccacatccccccaccctccagccctggcaactaccatgacactttgtctctatgaatttgattattccaggaatttcatataagtggaatgacacagtatttgtctttttgttactggcttatttcactgagtataatgtcttcaaggtttatctatgtttatagcatgtatcagaatttgcttccctttgaaggctgaataatattccattgtatgtacatagcacatgttgtttatcctttcatctgtcaacgggcactggggtgtttccgctttttggctattgtgaaaaatgctactatgaacacgagtgtatgaatatctatttgagtgcctgcttttaattcttttgggtctatcaccagtactggcattgctggatcatatgatgattctatttgtagtttttgaggaacctcgacactgtttcccatagccactgcaccattttatatttctaccaacagtgcacaaggtt

SEQ ID NO: 22807 - DNA, 1070 bp, Homo sapiens
cctgggttcaagtggttctcctgcctcagcctcccgagtagctgggattacaggcacccgccaccatgcccagctaatttttgtatttttagtagagatagggtttcaccatgttggtcaggctggtcttgaactcccgacctcaagtgatccacccgccttggcctcccaaagtgcagggattacaggtgtgagccaccgtgcccggcctcagcccttatttcttgaggtctcccgtgtgccaggcctactgccaagaaatgctgggacacacagaggaatcggactcccatgccctaccccctccaggaactctcagcttaccgaggacgaagaagatcatctaccaactaatgcatgtcctacggggcacctcagagcaggaaactgacccaagttcggtgggaggaatgagtgtgcatgtgtgtctgtgtgtgtctagggaaagcctcctcaagaaggtgcctcctgagctgcctgctgcaggtaaagtactacatcagcaaagaatgtgagctggaatgttccacagcatgggcagaggtctgcagaactggacagagctgggcagttgaggaaactacattgtttatacttatatttttaatttttttctccagctatgtgctagaggtggtaaaacattaactgttcccaaggatgagaaaatagctgaggatgagcatcttaggaggggaaggagatgaggatgcatgacccctagaggcatactccacccctcacacacctctgcttgcttcaactactccatttctctccagaaggttccaggttccctgcagaaagagactggaacctctctctccccatccccacaggactagagactacaactcccatgatccactgcggctgctcttctcacaactggactccagacttcacggggtctcatgggaaatgtagtcctcatcggcttccgcatcactttccttgttttttttcccacgcatttccagacttttcaaccaattgagaggtgggaagcgccttgctattattgaagccaacaacaccctctttcttacagaggtgggagccggaagtcc

SEQ ID NO: 22808 - DNA, 1038 bp, Homo sapiens
gagcgaaactccgtctcaaaaaaaaaataaaaaataaaaaattgcattgcaatatgactttatctttattttgtgacccctccccctctatcactcttttaaaaaacttgcatggagactatttcttttctttcttttttttttttttttgttgcccaggctggagtgcaatggcgtgatcttggctcaccacaacctccgcctcccaggttcaagcaattctcctgcctcagcctcccgagtagctgggattacaggtgcacaccaccacgcccagctaattttgtagtagagatagggtttcttcatgttggtcaggctggtcttgaactcctgacctcaggtgatccacccgcctcggcctcccaaagtgctgggattacaggcgtgagtcactgtgcccggcccaatttttgtatttttagtagagatgggatttcaccttgttggccaggccagtctcaaactcctggcctctagtgatccaatcgcttcagtctcccaaagtgctgggattgtaggtgtgcctggccgctaatggagtcttaatttgaattttgtgttttctgattcctgtgtttgctttaagaaaaaaaagttgtgggaaaatgtgctaaacataaaatgtgtaattttaaccatttcccctttttattttcaatttttatttatttatatatttttaagaattgggatcttgctgtgttgtccaggctggagtgtactggtgtgatcacggttcactgctgcctcatccttctgggctcaaatgatcctcccacctcagcctcctgagtagctgggactacaagcgtgcaccaccacacctggctaattttttaaaattttttttttgtagagatggagtcttgctatgttgcccaggctggtctcaaaatcctggcctcaggcaatccttcgtcctcggcgtcccaaagcgcttggattacaggtgtgagccacagcacccagcctcctcttttatttttagttgacatgtagtacttgtacatatctgtgggaaacagaaggatggtt

SEQ ID NO: 22809 - DNA, 1047 bp, Homo sapiens
tcggatgcaggtgcccccggctcatgcttccaaaaccccctcttgatttgtcactgtatggggtaaggcatagtttcctggctgtgtggatgtaagatacctgagtctcaagcgggagactccactgtagaccctgtccctgggaccagagacttctctggtgtagactttccaaggtgggagattccagccccccacccttggcatggggcatctcagtggagatgactacctctaccccaggccctaacgcatccttcttctggagtctcagagcctctgtgtggccacgtcagcagccacctgggttaaggatcacccttcaacatcacttctcagagctccttgctgcagaggcggaagctctcccagatcaaaggtgcctcatgacaaagaccactctgtgggcacatgacggcccccaaggttaaggaccacccggtgttagtttcccagggctgacctcctgcccctccctcctcgagtctttgtgtggtggtatcatcttccctgagatgaagtctggggggctcttctttactggttttggctctgattttagcgtgttggctcctgtgaggctggtgtcctgctcacctccccccgccccgccacccgccttgtgggtcccttccctgtggggatgtgtgttcctcttgggtaagtctcctcctgggccgaggttcccagattcctcagtgctcttggagagcctttgctgctggagcacaggttcttcacgcctgagagtggacctgcgatcaccaccttccttggaggatcttggtggatgcccccctgactacagcaaatggggctctttcttctctggcggcgtctctgcttcgagactcaggctccagcttcccttctctctggtcctttgctggggggaccagaggtacagataccctcatgatataaggattttcttagcggggaaggtgttgtctctactgtggctaaggctccagcctctctaggggacaagtaccctgggcctctggcacttgccccttctctgtggaggagctgcctcctcactgg

SEQ ID NO: 22810 - DNA, 1031 bp, Homo sapiens
tggagcagtttgaagatatttggcagaaggtacaggggctgagaccctaataatctgggtcttcagagaggagggcacaggaaggcggctcaggacctctgggtgttgaccagcgggaggggctacatatgcagatgctgaggacctaagagaatcagctctaagatggattgggggtaggggttggggggggtcctcgagtccctagcataaggaagaatcactggagtgggtactgggacatcccctcccacactgacttctcaattctctccatccctcagctccacaatgcagccaacgcgaaccagaaagaaaagtatgaggctgacctaaagaaggagattaagaagctacaagtgagggggctgggggcctggacgcctttgtcctgagggtagagggaactgggagagtggactgctgggtcccagggagaaggagctgtgggccccagttcctgggtcctgaggtctgactttcttgcttttcccatctgcagcggctgagggaccaaatcaagacatgggtagcgtccaacgagatcaaggacaagaggcagcttatagacaaccgcaagctcattgagacggtaggagcccagagcctgagtcccagagaggtgggaaggtcaccagattcttgagatcccaaggggcggaggcagagcggccagaccccagaggtcctcaagagaagtaaggtttctgcacctaagggaagtgaagaggcagcggactcagagctcagaaagtagggtcacgaggctcaggtcggagtgtctgctggcccttagtcagctcctttcccacctttgagagcccccctgccaactgcactctctacagcaaatggaacggttcaaagttgtggaacgagagaccaaaaccaaagcttacagcaaagagggcctgggcctggcccagaaggtagatcctgcccagaaggagaaggaagaggttggccagtggctcacggtgagttggggtagagaagaggaggtgaactctgaggatcctgagccctgggtg

SEQ ID NO: 22811 - DNA, 1051 bp, Homo sapiens
actcgaacctctgtgtctcaattaacttatctgtaaaaatggggggaagaccacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatgaagtagtacaaggtccttgtcctcagagaactcagtcccctctcctggttctcccaggttgccatctttgaagcacttaagacattcatttagaacctaggtcctctcccattgtgtcctcagatgttaaccacagacttcctgtcctttcctggtttggcccaaaaccatcctccaagttagtacatttcagggcatccagtcattcagaaattcccacaccacttccgtcaccaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgttctggcagctggcttcggtggaacctctgcggccccctccgtttcctcctcgctgaagtggcatgataacatttcctacccaagaagaaccttgtgaggatggatgagagtgtgtgcgtgcagggcagctggcccggtgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttccc

SEQ ID NO: 22812 - DNA, 1177 bp, Homo sapiens
tctggagggtcaaatttaccctggccaagatccgcaaggccgcccgggaactgctgacgcttgatgagaaggacccacggcgtctgttcgaaggtgcgtatgggagtccacagcagagggatggggtgcagggcttgtgaggttcattctcccttctgttgcctctgttccagtgatgagagttgtgtcattggataaatggaaccagccttctaacttttagtggcacttgtgaagtaggaaaagtgtatctggatcagtctttgccctgtttcttaggtgtgtggcttttttgcccagttattggaccttcagtttagtaatgaccagagctaaagataggcctggcacacctgggcacccgtctatatctttatattctgtttatgtggcctgtttgctagtggatgagagtagactatgaagtggaatttctgggctaagtgatggtgataacagggtttgcacatttgcttggtttattgtttttttaattaagttttctcgttttatttagtcttttgagacggagtcttgctctgttgcccaggctggagtgccgtggcgccatttcggcttactgcaacccccgcctcctgggttcaaacaattctcctatcttagcctcccaagtagctgggactacagacaggcgcacgccaccacacctggctaattttacttttgagacggagtctcgctccattgcccatgctggagtgtagttgtcgcaatcttggctcactgcaaactccgcctccagagttcaagcgattctcctgtcttagcctcctaagtagctggaatcacaggcatgggccaccaagcctggctaattttctattattagtggagatgggttttcaccatgttgtccaggctggtgcttgtttttttaagctggtcaaggacatttaggtggtatttagcaaaggcctgaacaggagagaacctgtaaaatgtctcagggaacagcatttcaggtgatgactttaggagggcatgcagatcacatagacttaggcttactttactaattgtggtgaaatacacattaaattgaaaatgtaccatcttaaccatcttgttttaaaatctactctgagatgcggtgttattggagtgctttctacagcagattggcatgaccaagattggcatttgtatatcctgagac

SEQ ID NO: 22813 - DNA, 1026 bp, Homo sapiens
gaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacga

SEQ ID NO: 22814 - DNA, 1042 bp, Homo sapiens
aaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtc

SEQ ID NO: 22815 - DNA, 1045 bp, Homo sapiens
catccatcctcttggttcaggttcctttcacaacccgtactccttagcttttttttttttttttttttgagacagagtttcgctcttgttgcccaggctggagagcaatggcgcagtctcagcttaccgccctccacctcccgtgttcaagcgattctcctgcctcggcctccctagtagctgggattacaggcatatgccaccatgcccagctaatttggtatttttagtagagacgtggttactccatgttggttaggctggtctcgaactcccgacctcaggtgacctgcccgccttggcctctcaaagtgctgggattacaggcgtgagccaccgcgcctggcccctagaattttttgtagaccttttccccttgatggaggcacccctaccctctggacctttcatcacagcctctctttgctcacatgggtttcagacccttctcctttcctttgggaagtctgctctggcttccctgtttccaaatccttcgttttccacctggagctctacaaaggggccaggggcttcccctcactccagcctttctagtccacacccagaactcttcagatccttgaccccagtggcttttcagtcagcctccccttttctgcccagcttctcttgagtccatctacttttcttccccactttgtgacgtgtttttagctcccccttaagtctccctaactcattctttttctcataggcagtgaaaaagcagtctggctcccgaggtccaccccttataccccaaggtccagatggcggccaacgtgggtgatcaacgtagcacagattggttagtgaggcgagagggacggaggccagtcgggagggaaagaggaagcaagacccagtgctgtcctctggggtgggacctcccgtggccttaggggaggtgatgccacaatccctgtgggtgggggtggtggtaaggcaaacacagagggaagcatttggttgtggtgtggagaggggcaagctttcacctctctgagctttcgtttttcacagtacagcgcttgctttgcag

SEQ ID NO: 22816 - DNA, 1048 bp, Homo sapiens
tctctcctcatgctcattctgccatggccatcgaagcagagacctccttgatgcccgcacccgccaggcccgctctcgctttgccctggctgcagtgctccctgtgttgccgcctcttggaggtctctgctcagatgccgccttcagagagcctctacctgacacactgattgaaagtagcattcctgcctcgcagcctgtccctctccctttctttgccatcttattgtttcatgatccttattgctggatgtattacatgttgatgtctccagccggacatgtaattccagcacaagcttcattacagcatgggttttccttttgttctgtcgtagtgcttagaagagttggcactcagtatcgttgattatattcttccgagaactagctaagtgagatgtgggattgatagaggtttttcttttcctaatatatgagaggatgtggtgcattaatatagtggagagagaaaggggtgagggattggtagagggtcatggctggtgtagttcctgagcaggctggggaagcggaaagggtaggcctcccactaaaccctccctccctgcgcctttgcagagcatgtaccagagctatggctccccttcccagtatgggatggccggctcctatggctcagccacaccccagcagccatccgcaccccaacaccaagggactctgaaccaggtaacatcctagcccagctcccataccctgctcaagcagaggaagtgtagatttttgaatgagctgtcaatgaggaatggcttgtactccttaagctgcttttttccttccaagcaactcctgatctgaaaatgaggaggacagagcatagtgtttgaacctggggtgggtttaaggctgagccaaggccagggctgagatgttgaaagacatctcatctttttccctagcatggtcacccacaggcgtgcacacaccggctgggttttgcattgaatgtgcagcttggaggaatggccgggctagtgcacaggaggcaggtagacctgggtttgaatcccagctgtcccacccc

SEQ ID NO: 22817 - DNA, 1033 bp, Homo sapiens
attgactggagccgggagcccttgccggggttagtctgggtgggggacataggtgggagggtggtgctgtgagaggcatgggctgggtatggaggtaggagagttgcgggtcccaggtaccaggagctccaaagagaaatgaaccggaaagttggatcctggggggatgaagtcctggttggagggaggccggtggggtggggtggggaccatgggtgctggagaggcgtgcattgctcagtggttaagcgcaccctctggagacggaaaacctgggttcgcgtctcatttctgcactgtagtagctgagccgcctggggtaagtgcctttcctttcggaggcgggtcggtaccttgagggaggtggtggcggctgtcctgccagtgtctggcggggttggtgacgccctgccctgctgtattctcaggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaaggtactgaggctcccggctggggctgtgtgtgagggagggggaggcgtttcaggcctgaccctcctgcttcttcctgcagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggtgagactgtgtgagggctcgacacacgggccagggtggaggagggtactggggacccatgggagaaggaggaggagggccggacaggtggacagccagctgccaa

SEQ ID NO: 22818 - DNA, 1471 bp, Homo sapiens
cccaggtgcagggcatccgcaccgagttcacggtggaggtgtacgagacccatgcccggatcgccttggagaaggtgagctggcctctgcgggcctccccagcccctttcctgctgccgttctgccctcagcaccctcactctgctctcctccctcggtgcctctgccttccagggtgaccatgaagagtttaaccagtgccagacgcagctcaagtcgctgtacgccgagaacttgcctggcaatgtgggcgagtttactgcctaccgaatcctctactacatcttcaccaagaactcgggaggtgaggcccagtccccaggacagaggccatggtacccagggttgagccctgctgacttcaccctctttgtcttggtgctagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttggcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagag

SEQ ID NO: 22819 - DNA, 1135 bp, Homo sapiens
tggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttcccctcaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaacccccccccgggccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtc

SEQ ID NO: 22820 - DNA, 1500 bp, Homo sapiens
gactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccaggcggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccag

SEQ ID NO: 22821 - DNA, 1113 bp, Homo sapiens
caagaggaataagcagacctacagcactgtaagtggggcccggatgcgtggctcctgcgggaggagggtcctgagtctcttgactctgggtcagagggcgggaccttcgcatgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgag

SEQ ID NO: 22822 - DNA, 1048 bp, Homo sapiens
aaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttgga

SEQ ID NO: 22823 - DNA, 1027 bp, Homo sapiens
gcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcattatgaaatatgcatgtggtcttgaaaaactgcaaatgaaagaagagtatgcaggggaag

SEQ ID NO: 22824 - DNA, 1046 bp, Homo sapiens
aatgaaacaagccacataaggcacctaagtacaatgcttgttagaggtcaacaaatgttggtgacttgttctggtcttgggtcaagccaagagacttgggatttgttggcagggagatgggtggagcaatgcatgtttccagtatgaagtgggattgggggcgggggtcctccttcattttggagggagaaataccgaaagacagcatgtgatgggactctggagccttgctgcctttcttcaaccactggccctgccactagttaacaatgtgactttagaagtttgtttgtttgtttttgagaaacagagtctcactctgtcacccaggctggagtgcagtggcgtgagctcactgcaacctctgtgtcctgggttcaagcaattatcctgcctcagcttccccactagctggaactacaggtgtgcaccaccacacccggctaatttttttatttttagtagagacggggtttcactatatattggccaggctagtctcgaactcctgactatagttgatccacccacctcggcctcccaaagtgctggcattacaggcatgagccaccatgcctggcctgactttggaagtttaatttatctctctggccctcagtctcttcctttgtatttcagagtcaatgcttgtaaccatcttctagggttactgggaggattcgttgagctcacacacatcagagttacaagagtgctgggctggtagaaagcacacatccagtgttatatgcgcacgttactctttattaacaaaccagaatttcatcacaaggcagcgttgttgcagcagaacggcccacagtctggcatcagaaagacctggaatcagttacctgctttcctctttattggccacatgaccttggaggaatgccttccccatgctgctcctcagtttccccacttataagatgggcccagtcatggtacaggactgtgctgcctccaggcaataacaaatatcaaactggtcaaacaataaatgtgaaccgttaatacacttgctgtgggactcctgtcccttg

SEQ ID NO: 22825 - DNA, 1035 bp, Homo sapiens
caagaccttccgctaccgctccaacctgctggagcaccagcggctgcacctgggcgagcgcgcctaccgctgtgagcactgcggcaagggcttcttctacctgagctccgtgctgcgccaccagcgcgcccatgagccgccgcggcccgagctccgctgccccgcctgcctcaaggccttcaaggatcccggctacttccgtaagcacctggctgcccaccagggcggccggcccttccgctgctcctcctgcggcgagggcttcgccaacacctacggcctcaagaaacaccgcctggcgcacaaggccgagaacctcggggggcctggagcaggggcgggcaccttggccgggaaggatgcctgaccgaggggttcccatcccactcccatcaaaagcccccttctggactcccacctcccaggactgatcagactcttcccccctcctcgctgttgccccatccttcagaacttcacacggactggcgaccttcagggcgcacgcccgacaggctcaagactgaatcactcccatcctcgacctctctgccctcccctcatcccatcagacactgaaccctatcctccgtccaaccctcgtttgtgacccgcatcagcccccgccccagcagcactctgcccccagtaagttttggcggagatgggtctgaaccgcccctccccctcctttggaatctggctggacagtggagtatgagcagagttgggagggcacaagggagtgctgggtgctttttggggtgggggggtggggggcggggtggcagacgcggcttgtacagagcggagaataataaatcttaccatgagggccgctggagtccatccttgcatcccacccagggagagtggggatcacatggtggcaaagcacaaagttaaaacttgtttcctctgcagttttgatgccgggcgcctctgtctctcactcactctcattcaacagggacttactgaggatttgctgtattcccagcgttagtctgagctgggcaaatggagatggacaag

SEQ ID NO: 22826 - DNA, 1912 bp, Homo sapiens
gccattttctccctcgcttccccccacttcacggccgcgcggcgccccccaaccctggttccgtggcgcgcgcctcgttcacgtgacgtccccagcgttccgccgcgcgctaggcgaggggaagggggcggcggggcgcgggcccgtgacgcatgcgcacggcggctgtccctgcgccccacgtggtcctggcggaggtggcgcgggggacgcggcacgagcgcgccagatgcctcgacgtgaacttttgttttttaaaatctttttggtttctctgaaaaggagattatgttagtccccgtaatctcttttctcccgctgccttggcacttccgcttccggtcgggcccacggcagcgtctccacgccccctttgtttccaaaatggcggttgtgagaacttggtgggggggcccctttccttccttcacgtggatgagggcagagccgtttcggcggatgcttggaggccacgggcccctcgcgtaccccttttcctttttgctgatttgctctgatctctcccgccaggtggtttctgccccgtctgttggtagtggggcgcctcatattaacgtgtttggcacatgttgcctaaaagcatctgcattctttgagtgtccgcacgcacacatcctgcatatgcggggcttttggcggtcccgagaatcgcgatatggagtgtttgagacaaacctcaaatcatttacaatcccaatctcagggcacctgataatactcagtctcagatctcaatatagagataagaaaacaggttctgagggaggaagagggatctggcccactgcgctaaactcttcacttacggggaaggtgggaggcaggttcccttcagggtatcgaaaattgtgatgggttagaacaaaaagcctggggccctgatcttagggattccaataatattagaagtgggagagttgttaagacgctttaaaaatcctccgtgtttcagtttgtgaagaaatacaggaccagggaagattggagacttgtttcttttcaggcttcagctgcccatgttcctagctcgttcggaggacgaaatgagggctgaggaattttcctttgaacccgggctagagttgggtaggggctgtattaggaaacagtgtcctggggaagcaataacgtttactgagggtctgactctgtcttagttgatggactgctcaagagcataggctttggagttgagcacatcaggaagtttagatacctgctttgtcgtttagtaactgcttttaatacgtttatatatttttttccatttgtagactgattattattttcttgttaccggattttgagaagattaaaaaggatgatagtaacgatagatgtagttaaactctgagcgcttaccgtgtgccaggctcttcgctaaactcttagcatgttttactaagtggatccttttaacagccttgtgaggccaaaatgatttccacctctactggggaggaaactgagggctcagaaaagttaaaaactttctcagggctcagctagtcagaggcagagctgagattaaatggggtaacatgtaaagtgtgtggcatgtggctttgcgtacactgggtgtgcagtaagcgatatttgcaattgtaaaattccatgcttagagaggagggtcttccgctcacagagattgtgtcagagttgggaaagggcaggaaaaggtgctttccaaatgtcattctgccacacaacacctggatggagtagatacgaccctcgtttaaagagaaaaccaagtcttaaaggctaagttgcttttgcatggtttttgttgttcataagcagaaaagcaggtactgattctgagctctggctgcaaggccaagttccactctgctggaccaagtggagctgattgggcggttctttgagg

SEQ ID NO: 22827 - DNA, 1106 bp, Homo sapiens
cccgcgtgtcactgcctgtagtctttgtctctgcggaggacgggccagcttctgtacgtgtcgccttctgcttcagtcctttcctctgctacctgtatctacagggaatttccttgtctatatcccaggcacccagcgggcatcattgctttctctgcgtgggttcctgtctgcctgcttgcctgtttcagagccttagcagcagaaagggctcttggggctcacagcctgtccatcttataagcgaggagctgtgcccagtgccgtgcctgtgtgcccgctgctctacactgctggcctgtcctgccgattgttcctcccaatttcagtttttgattttggggtttttggccttcaaggggacaattatattgtcattaatggttctagccagacctgagtgttctgcctgatccacattcgagagtatggcctcgtgcttaactcactgatgtcagagtgtttaaattctggtgtcaccatttcctagctgtttgaccttggtaattgtgatctctctataccttagtttccttacccattatgtcagcccccagcagtgtttttccgaagcagtagtgaggattaagaacaaacaaaacaatttagtacagattccggttgtaggaagcatctcaatatttgttgctgtttttttccctgctgggtgcatatttttctgagtgttggtggttttggaattgtgatgcttttccagacattcacattgcatcgcaaaaacgtgagacaaaacactgtgggtgaggctgaagtttaacatcctccctcagtgccctttcctcctcttgtccccagggatgatcactccaggagatgcgtgttaacatatataagcaccttaacgtgtgcatctgttttgtgtgtgtgcttcatggctagctgagaaatctgggtgtctttgaattaaggaaatggtgtggcggtgctcatgaacccccccgcccccccatgctcatggtttatcctccatcttgaagggccggtctctcttcaggggttgaagggtctggtgagagcagaggtttctgtggttttgccagtgaggctccgttcctagtggctacctcaggcaaatagagggttga

SEQ ID NO: 22828 - DNA, 1022 bp, Homo sapiens
tctacacccccacccatattccactgttccttccccccctcctccctcccctcatccctctccccttacccccaaacccctctgtgtctccctctctcacccttcccctcctctctccacctcccttcccccgcccccccccttgtctcctattccctctgcaggaggccatgatggatttcttcaacgcccagatgcgcctgggggggctgacccaggcccctggcaacccagtgttggctgtgcagattaaccaggacaagaattttgcctttttggaggtgagctgggggagtgagtgaggtccaggaaacgtgtgtgatgtgagggcccagcccttaggctgatgttgtgtggagctgccttgtgctgtttccaccaggccctctgcagcctcttctccacccggtcgctgaagtgagccctgttatagcattacagatctgatcctactttctgccttccatttgctttctgtgtgacctgagaggcctgtttggcctctgtagacctctttggccttttccagaccattccggcccagtcctctctgcactctggccacactgaccttcccagaacctaccatgctcctgcctgcttggctagagttctttacaccagctaactgatgttcctaactagtcttctgttaccccagctaactgatgttcctaactagtcttctgtgtctgtgtttctcaactgtcgggaaaaggccttggtttttgattttcgactcttggtggactgataactctcatgaagtattgtgaaggtgtgggcagtgttagcttactgcagagatttctgagcactccctctcactgtctgagcactccctctcactctgtccctctcactctgtctttgcctcactgcagtccacttgcagttgcattgctccggagatgggctgaaatgtccccctcaccagaaagactccagtactgtcatctccccgttcaactaacctttcccgtaacatcccttttcagcactttgtccctcttccgtgtcat

SEQ ID NO: 22829 - DNA, 1082 bp, Homo sapiens
cagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttatggagcggctgtgtgtccagtatgtccgaccctcttcctcggttctgggctcgggtgggggttcccttggcaaactgcgggcccctggctgggacgcccctgctgccggcgccggcagcctcgaggccttccctgcttgcgcggtgcccttctcggggtcggcacaggcacagccccgggggacgtgaggttcccgagtgctctcccaccccgccgacaggagggatggtggccgagcgggccggggcgggcgtggcgtgggtgtgccaggagctccgcggttgccgccaagcgagctggagctgactctcggcgttccgtgagcaccgcgcggatcccccgct

SEQ ID NO: 22830 - DNA, 1053 bp, Homo sapiens
attaagatagtgccttttctgccgccacccttttggaaatgttctctgttttttctctgataataatagcagccagtgttattgagcgcctactatctgtggggcacagagccaagcactgcatgtacccatcttatttaatcaacaggcctaccaggtaggaattctttcatttcagagttgagcaaactgtgtctcaaggaggtgtgcgctgcaggtagctgatgtggccaggatttgaacccacattttatattctttgccattagattccatttttcttatctcttatttctcagcgccaggtctctttttgtttctgggcctctttcttccttggcctcctgcctccctgtcttcccatgttcttgtatctgctgctgcctgtgtttttctcattgtgtctctgcctagctccctctgcccaggtttctatgtgtctctttctgtcagaactgtcttctatttcttctcagtccccttctctgcatttgttacatcatctcttcatcttaatgtattaggctggggctgttttgggactccagagagttactttttaactagctacatctgtcttcaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaaggtgtgtgtccctgggcaaggggctgaacctctgtgtctcagtttccaccctgtgaggtggctatgaatcatggggttgtttcaaggattaactgagttaatacatgtaaagcacttaaaacagtgcctggcatgggataagagcagtgcgagtgtctgctggtgtcatcatcatttgcttgactctcttgtttctcgtcaccagtctcgggatgggttaatttaatttaggttaatttaaaagtatgagttttggagttcaggtgggcctcgggttgagtctgccctgccattcctg

SEQ ID NO: 22831 - DNA, 1050 bp, Homo sapiens
cagtcgctctcacacgtacctctcgcgggctcttactcgtggtcccggtctcctcctggtccccaccttccagcccagcgcgcacactagacggcacgtgctctccacgctctttctccagcgccccttgctcacccgccccccgttggagtggcccatcctctccgcttagacacctgcagtcactgtcactagctgaactgcgccctcctgaaagctctatgttgaaaccctaccccccaccctgcaccgaccccgtaccccagaatggggctgtatttggagacagggcctttacaaggtaagtaaggttaaaatgaggacattagggtgggtcctaatccaatctgactgttatatagtggggttgcaccttcatgtgaggacgccgggagaagacagccgtctgggagccaaggagagaggccttggcggaagccaaccctgcagcaccttcatcttgaatttctggtttccagaactgtgagaaaatccattgacgttctatagcgctcccagctggcggtactttgttatgacagccctaacatgaatgcagccatccacactgtctgggggaaggcacacacaccccacagcacccttgctgtctcaccccgtatcgcaaaagctcacgcatgtgtctctcccgagtccctggagggtcctgccacctacatctctctccttggcctgccgcctgtgatgctcctgggccccctgctccagcaccgctcccttccttctgtaatacagacaacagagacaggagatggcctggccccacttcatttctgttccctgggaaataagcatcgcaagtgatccgtagaatggtagacatcatccacttcccaagcatctctggctgaatgctgttctcatccacttcccaagcatctctggctgaatgctgttctacacatgcacgtgggaggcaccagggagcccagaagaaatgaaaagcctgggcagactcgcagttctgccacacagtgaatgtgctactcaagccactcagcctgggctgcagaggttggaagcctcact

SEQ ID NO: 22832 - DNA, 1107 bp, Homo sapiens
gccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggagtctgagctctgtctggagtctgtccggcacagccaccctcccagggccgagcgtctggggtgcccggggcttctggggtcagctgtcttggctcccaccacagactctcttggcatgagagaggctctgggag

SEQ ID NO: 22833 - DNA, 1049 bp, Homo sapiens
ttttttttccattaaaaaggtttctaaataaaatcactgatgtatttgagtatttcttcaataggagcattactctgcaaagagtcatataagagtaggggtgatgttcatatttgacaaccaacaaggcaaaggcacacagcagaacttatcctagctgggatcctggagtttgctgccatgctgggcattaatcttcagttgctgaattccttatggagaaatctggtgtggtcactagcagcactcagtgaagtagctgtttatcaatgagtgtggcagtatttcagtatttaagaaatcagtatgttcaggtgtgtaccattgaatgccatctctatgtcagcccagcttaagagcaggctctgtgacatgtcaaaaccaagatgcatatgcctaaccatacaacaagccctgataagtcttgagctgatttatcttgttaggaagaagacccatttttaatttttagggagcaaactaggtcttgttccgtgttatcttaaagatccttaattcaacattcggtagtattatttgggagctgtactgtaacatttttaaaactctcttgctcatcaaacaggcacaattgtgtatgtttctctagtgagagctgtagatattttttgatgcattttattatcagacttggagacattcactaagtaaattaatagtgcttaaattactattattttgtctcatgtagcatgattataagttaccaactatctttacaacttagtggggttatcaagagctgttaggcaatcatttgtcgcctcttacacacagtctcaggaaaatttttatttccaatgaacatttgtcccatattgaagtaacttttattgtacttctttgattccttcttatcaagtactgattatacagattcaaacatttattgtaatatcactcttcttcttctcaagacattagaagtcatagtctttgagatcaacttcattttatctgtgacaaattttttcttgttttgattcagatacctttttgtttgtttgtctttagaaacggggtctcac

SEQ ID NO: 22834 - DNA, 1056 bp, Homo sapiens
aaagaaattaaaaggactgaatagtgctggtgataatgtcaaaaggtgacttgtgataatgctttgtgttctctgatcttcctagatctgtggtttggtgtttgttttcttgcttttagagacaaggtcttgctttgttgcccaggagggagtgcagtggcaggataatggcttgctcaagcaatcctcccacctcagcttctcgagtagttgggactacaattacacagcaccacacccggctaatttttgtatttttttaaagatggggtctcactatgttgcccaggctggtctcaatctcctgggctcaagcaatcctcccactttggccccccaaagtgctggtatgtatcacaggcatgagccaccacactggcctggtgtcctgtcattaattttagaaaattctcagtcattattcaaatattttctctcctttctctcttcccctcctggtattccagttacgcatatatttcaccttctgtaattgtcccatggttcttggatattctgttctttttcttttttcattctttttttttcctctttgtatttcagtttgggaaatttctattaacatatcttcaagctcacccattcatttctcagagtgtcttagtctgaggggctcactaaaggtaatcttcatgtctgttacaatggttttcaattgctaggatttccttttgattccttcttacagtttgcatctctctgcttacattacccatctgttcttgcatgttgtctactttttccaagatgcttctccttctgtgggcttccctaagaactccttcttaaatagagtctgtgccttgcagttttctctgttgtaatctactgttattgaccagagccccattagtgtggcagtgaggtacagtggggagggaagcattctataatcttattattaaatactatttttctagtgggcttgaggccttggactgtgatcttcagaagcacttcttagcctttcaaaaatcctgccttactgagacagacaggctatagagggactggagctggccaattgcctctccc

SEQ ID NO: 22835 - DNA, 1033 bp, Homo sapiens
tcggcgacccagactccgggctgagaggcctcctaatccaaccaggaggaccaggagaggcccaaaaggggacacagggcagtgaccgccaggcttggagaggagccgctcctggcaaagccagcgccctatttctgaacgccgcctccgttccggactacacttcccaggggctattgcagcggaggacacgcccacttccggaaaggacccaaagccgggcgagtgcacgtcccgccggttgctgaggagaagggaggtctgggcggggcagcggccgaggctggactggggcgcggcgggggcggtgtcctggttcctgtgtgggcggcgggcgtgagcgtgcgcgtgtggcctggtggctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgtgggcaaagtcctagagcccggggaagttgcccgggcggggcagcctcggctgaagcatttcctgtcagccctatctggaaggggcagagcccaggacagggctccatgtccacaggacggcgaggagcgaagaccatggggactgagtacacaggtaagagtgacagatgacggatgtggctgccggagtggacattgaggttttgggtgctgtctttcggggttcaggtgctggaggaggatgtcccccgtttctaaggctagtggacctggaagtcgaaagatttggagggtcaccttgggtcagagtggagctgggtttagttagggagggaccttgacttggccagagacacctaaccagataacctgactcaggtccttggtatatcactaagggcccatgggagagaacactac

SEQ ID NO: 22836 - DNA, 1061 bp, Homo sapiens
atgttggatatatttagattggtgcaatattgcaccatgataataaatgataaatggatataaatgacaaatgctataaaccatgatgagcctgataggggacaaatggtgccacgtgatttatttctgagtagcattgtttgtattattagtgaagttcaagtcttagaaaatgtttactagccatttctgtgggcagggaaatgatccatcttgtgctttagcagtctacaggaatctgagtatgctttaaagactttacagaagcaaatgtgtgtgtgtaaatatttgtggcaaatattcttcccagatttgctttttgtttctttattttactttattttttctgtataaaagcatttcatatttttaaaatcaaatctgttggtttctcccactgtggtgtctttcttcatctttaagctgtgaaagggtttctccatccacaggtcacatagcagctatattttcttccttttcaccatttgtcatttgaatgttaacaatgaacttttgaatctacctgtaattgattttgctatataaatgtgtcagtagacttatttgggagctttggtttattctgtcttcatttgtttggtacctttgttgaggtacacatcacgtatcacaaagtgtacaattcactgattttgggtacattcatagagtcgcgttaaccatcaccacagtccatttcagaatattttcatcatcctgaaaaagagccgagtacccattggcactcatttccattttcccccatcagtccacggcccctggcaaccagtaatcagctttctgtctctatgaatttgactgttctggacatttcaaataaatggaatcatacatggtgtggtcttttgtgactggcttctttcactcagcataatatttgcaaggttcaaccatgtggtagcacatatagagcttcattcctttttttgactgaataatattccagtgtgtgtttctacatattttatttatcctttcatcagttgatggacatttgggttgtttccactttttggctattatgaataatgctgctatga

SEQ ID NO: 22837 - DNA, 1018 bp, Homo sapiens
aagggagactccctttcccggtctgctaagtagcgggtgttttcctttgacacttacgctaccgctagaccacggtccgcctggcaacgggcgggcgtcttcccagacactggcattaccactagaccaaggagccctctggtggccctgtctgggcataacagaaggctcgcactcttgtcttctggtcacttcccactatgtcccctcagctcctatctctgtatggcctggtttttcctaggttatgataatagagcgaggattattataatattggaataaagagtaattgctacaaactgatgattaatgacattcatatataatcatatctaagatctatatctggtataactattcttgttttatattttattatactggaacggctggtgtccttggtctcttgcctcggcacctgggtggcttgccacccacgtatttcaggaataaataaaagccaaattttgttgtgttgtaaccaagaagagaaagccccaatttggtcatgtcctgcccacagccccacataaagatgagttaggtgtgtgtttctcacatcaacagccccttagcatgtgccatgtgttatggatactgctgggatggaggaaagatggcagaaatagtgcatatataatcctgcattcaaaactcctcacagtctgtgtgatagaaagaatgaatggcagggcgctgtagctcatgcctgtaatcccagcactttgggaggctgaggtgggggatcacttgaggtcaggagttcgagaccaacctggccaacatggtgaaaccccgtctctactaaaaatacaaaaattagccgggcttggtggtgggtgcctgtagtcccagctattcaggaggctgaggcaggagaatcgcttgaatccgagaggtgcaggttgcagtgaaccgagatggcgccactgcaatccagcctgggtgacagagcaagactctgtctcaaaagaaagaaaagaagagaaaaggaaaagaagaggaagaaaacaaa

SEQ ID NO: 22838 - DNA, 1043 bp, Homo sapiens
tagggggttgtgggaaccccaattctaatgtagttggtcaaaagcacaggccacaaccaggtgattgtgactggcatctgaagtgaagggcaattctgtgggacttagtcctcaacctatgggatgtgacacttccttcaagtagatagtgtcagatttgaattataggacacctactggtgtctcctggaaaactgggatggatgaaaaaacctccactcatttggtcacacaaatgttctgttttgagtgagttgaaagaaaagaacagttagtttttttgctttagatgtggtgtcagaaatgggatgttgaatgattgtgtaagagtgggagcacttggcagagaagtcaaagatggcggctgtagctgctgttcgctggctggggctctgcagcaggcttgaccagccactgacgggtcagccagcaggtctatgtgaacaagcacacagctgagattttattctggaagtgcaaccctctcaaatattgaaggaactgatataacagggattgaagaagtagtaattccaaaaaagaaaacttgggataaagtagccgttcttcaggctcttgcatccacagtaaacagggttcccacggctgtaccttgcgtgtttcaagataatccttacctcataccaacatcctcttcagaatctcgttcatttttactggcaaagaaatccggggagaatacggccaagttcattattaattcatactccaaatattttcagaaagacatagctgaacctcatacactgtgtttaatgcctgagtactttgaacctcagatcaaagacataagtgaagccactctcaaggaatgaatcaagctcagaaaagtcaaagtctctgtggacatgtttgatgagcttttgcaagcaggaaccactgtgtctcttgtaacaacatatagtctcttggatttattgtgttactatggtgaccaggagccctcaactgattatcagtttcaacaaattgaacagtcagaagaattggaagaggaaaataataagaggtctaggaggaaa

SEQ ID NO: 22839 - DNA, 1321 bp, Homo sapiens
tgtggtcccagctattcaggaggctgaggtgggaggatctcttgagcccaggaggtcgaggctgaagtgatcttattcatgccactgcactccagcctgggtgacagtgagctcctgtgtcaaaaaaataaataaataaaaataattcatgagagaccatgaaccagaggcaaaaaaaaattaataataattttctatgtttcattcacagaaacagtgatactgtggatattcatatatgtatttcattttccacttgtggaggtgcattttttgatcattcttggagtgaaattattggtttgtaggctatgcaaatgctcaagtttgcaagatcattccctttgttttctaaagagcttatgccaatttgcacttaaccaggaaagagaggttccgttgacccatatcctttccattataaggcttatcaatgtttgctcatcaaatggacacagaatagtctcgtgttcttgatttccctttctttcactgctgtaatgttttagcaacttactatgatttttggttgatttatattttcttctgtgaaaatagaaatcattttttattttatgatgaatgcctatttccattaacctgttttcctttcactgcttggtaggggttcttagtacattcttatccttaccttttatcacttatatatgctgaaaaatattttctagtttttaattttgttctcttactctctttaaagtatctttctccaaaaggtcttaatttactgtagtctaacttatgacttttcttatataattaatgatttttttgtcttgtataaaaaatgttggtttacctcaatattaaaaatatattttattctaaaagttttaaaacttggcatttgacattttttcagtgaggttgatttggaatatatagtgtgatagcaatgcagttattttcgttctccatgtggctacccaatttttctagcttcgtttccttaatttaacagaccatcaagttccatagttaagtatagttggtattttacagggaattatattgaatttatataatttgggtcgaattgtcagttcgtattattaaattcttcattgatctagatcatctttattgtcttcaaataagattttataattttcttcatcttgatcatgtgtatttggggttttttgtttgttttaagagaaaaggtcttgctctgttgcccaagctgggtgcagtggcacagtcatactttgctgcagtcttgaattttgcggctgaagcaatcctcccatgtcagcctcccgagtagttgggactacacaggcttgcaccaccatgcctg

SEQ ID NO: 22840 - DNA, 1098 bp, Homo sapiens
acagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttaca

SEQ ID NO: 22841 - DNA, 1029 bp, Homo sapiens
gtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccacttgctttggttgtatttggctctttctaacttttcaaggtggggttttagattattgatttgagatttttttgcttttttaatgtaagcattacattgtataaatttacctcatatcactattggtttgatcccacaagttttaatgttttcattacattttaattctaatagtttttattttttgagacattctctcttagccatgaattatttaatagtatgcttaattttctggtgtttggcatatttgttactgatttctaatttgtt

SEQ ID NO: 22842 - DNA, 1049 bp, Homo sapiens
attttaaatatagaaatgtcatttgcaatttgggacagttttatttcttgcttcccatctgtataccttttatttgcttttctcatgttattgtactaggtaggatttccagtgtgatgttgaatacgaatagtgacaagttatccatgccttgttcctgatattagggggaaatgttcagtttctcattattatgatgttgaaagttgcttccaaagagtttctctatcgagtttagaaagtttccctctattcctaatttgctgggatttttttggttattattaataagtgttgaattttgtcatatgctttttctccaccaattgatttaattatgtgatgttacttctatagtcagttgatatgatgtgttaccttgattgagtttcaagtattgaaccagcctcacatctttgtgataagccctacttgatcatggagtataattttgtttgtgtactatgctacagtatttcatttgctagtattttgttgaggaagctttcctctgatttcatgagtgataatctgtagttttctttcttcaactgttactgtttggttttgatgtctagatgataactaacctcctaacatgaattggaaggaattctcttctgtttttttggaagatcatgtgtagaattggtgttatttgttcctttaatgtttggtagctttctccagtgaagaagtgggacctggagattttccttttgaatgctttttaattatgtatttattttatttaataggtatagaactattcagagtatttcatattggatgaatttttatagattttcttaaggaagtgttcattttatgtaaatgttctaatttgtagcattctttgaaatatttccttttatcctcttgatggcagcaggatctgtacttatgttccttgttgtattcttgatattggaaatgtatcacttattattgtcagtctttgtagacatatgtcaatttcattgatcatttcaaagaaatagcactttatatcactgatttttctccagtctctgttcttaatttcactg

SEQ ID NO: 22843 - DNA, 1025 bp, Homo sapiens
caattacctgccttacatcactgtagctcttaagtttcttaagtcagaaactaacaactggtgtgtctaacatcatagcctgtgtttttaccctcttctttacccgcagtggttagggaggcctgggggtgagacctaaagtaacctttgcaagatgaggcctccttctagccagtgatcttgggcatgaggagtcatggcctttcatactggtggaactgtgtagacttaaaaaatggtatattggttgtttaaggagttctcaggggacctgtgtggcttccacggtggttttatatgtggttccccttactcccttacctgctgacatattctgagagggcacgtttgtatggttatgttgctgaatgtaccctcctactcagccaggatagatgtaatctccagatgggcccatattgtcttggctacaacctgctgtgccctctatgactcttgttgcttgctcatggaatcttctggcctcagggatgcctgctagtaggacttaggtagaaaaggaagcgatggctcattgtgaattctccctggaagcaggtccaggccctaacacctgatcaggtgtcaccacgtcaggtgattctttggtgaggtggatgatgatgactacacttctctgcccttgtccatgggagtggctgaaatgtatatgtggatttgaaatgcttcattctcattaactgcattaactttgctaatagagaaatgtcaggttacataatcagaccagagggccctgggcttaaatcctgcctctgttgataagacctgtgactttgggctgggcttggtggctcacacctgtaaaccctgcactttgggaggctgaggtaggtggactgcttgagcccaggagttcaagaccagcctgggcaacatgggaaaaccctgtctctacaaaaagtacaaaaaattagaccggcatggcatcatgtgcctgtagtcccagctgtgcaggaggctgaggtgggaggatcactagatcacaggaggtcagggttgca

SEQ ID NO: 22844 - DNA, 1036 bp, Homo sapiens
aaatttaaaaattagctaggtgtggtggcaggtgcctatcatctgagctactcaggaggctgaggtaggagaattgcttgaacctgggaggtggaggttgcagtgagccaagatcacaccactgtactccagactggacgacagagcgagaccccatctcaaaaaaacaaacaaacaaaaaaaaccatcatttcattttactgtttgagtccctgtggtaggtttctctatatcacagcacagaaaccattgtaaggtcactcctttcattcctaattttcaaatacaacagtgaccataatgataactgatgatggcccacaatttaccgatctcttatgtagtgtctagcactgtgccaagtgctttatagaaattttccccttttttaagagacagggtcttcctctgtcgcccaggctggagcgcagtggcaccatcatagctcactgtagcctcaaactcctgggctcaagcagttctcctacagagtagctggaactacaggctcatgctacaacgtccggctaatttattaatttttttgtagagatgggatattgctatattgcccaggctactcttgaactctgggcctcaagcaattcttctgccttagtctcccaaatgtaacgggattacaggcatgagccaccgtgcccagccaagaattttcctatttaaccctcatcacagcctatgaaacagaatctgagagtttctgtttttcagatgaggaagtggagactaggatcaactaaatcatttctctggcatcagctgacttggtacaggcaagatttgaactgagatgttctgactccagagctacactcttaacctcccttcaatatgaactcacgattcagcacagagttttcatattttgtgcttgagcattgggccgtcttagattctctttctctgttctcactgggctttggttctctttttactctgatcttcacttttatgttggcttcatcagttatctcatagcccatcctttttactcttacatactctccaaggctaa

SEQ ID NO: 22845 - DNA, 1042 bp, Homo sapiens
ccaggattctgttcaccctctgtcctaggagctctgtcctaagagtagctgtggccatcactagctgtccctcaggcagaatcttgagcatcagcttcgtctccgccccttcctgtctctgaatcctgatcaaccttaacttcttatggggctgcctcctctcactgcagtcctctggattcgctgaagactctgtgtctttgtatattctatgtcctaaggctaatatgtccttctaactttaagctcatgaagcatcctctctgggaagcctccttgacctcttcctgtccctgccccttctaggctacattaagtgccccttccctggcctcttgtagctccttgacatgttcttgagcaagcttatgatagagtgtcatcattatgatgtccacctagtctcatcttgactgtgagtggggatctctattccagaccatctgtactctgcttgagcttctccctctgggtttctctttaaaaatttcaagagttggccaggcacggtgggtcacgcctgtaatcccagcactttggaggcagaggtgggcggattacttgagcccaggagttcgagaccagcttgggcaacatggtgaaaccccatctctattttaaaaatacaaaaaatttagccaggcggggtggctcacacctgtaattctagcattttggaaggccgaggcaggcagatcacctgagttcaggggttctagaccagtctggccaacatggtgagacctcatctgtaaaaatacaaaaaaattagcccagcatggtggcgcacacctgtaatcccagccacttgggaggctgattcaggagaattgcttgaacccaggaggcagaagttgcagtgagctgagatcatgccactgcactccagcctaggcaacagagtgaaattccatctaaaaaaaaataaacaaaaaaaagccaagcgtggtagcatatgcctgtagtccagctaccttggaagctgaggtgggcagatcccgggtgatccgcctcagcctcccaaaccaaagtgctgggatta

SEQ ID NO: 22846 - DNA, 1971 bp, Homo sapiens
tcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgctttgacttttttaaaaaaattgtttctccgtgtgtctttaaccacccagtaccatacttttttcttgatctggatctacttgtcaatttcttctttatttttctgtaggatggagatgatattgtagctgtttgtacataatgtaatccagggagtcctaattcttccctctgattgtggtttctcagcttttttactgctctttagagagagtaaatagttcaaaattcacctcaacaattttctagaggtcaatttggaaccaaaaatgaaataagacatgtagctaaagtaagttaaaagattatgataaactcagaaaataaacacagagaaggaatctcatttttcagtcttacagaagattgtgtgaaggctgactatacataaagtgactggaattttaacaggtgaacctgcatatgtatatgcaggtagttgtcaccatggattgagtccagtcgtagtaattaatatgtttaatcagaatattttggaatttctcttttggtattctttttgtttcttttattgtttttaattgacaatgtttatggggtttggtgtgatatttcaatacatgtgtgctaagagtaatgatcaaatcagggtaattagcatatccatctcaatcatttatcatttctttgtgtttagaaacattcacagtctgcttttctagctatttgaaaatataaaatgtattattgccaattgtactcattctgcagtgccacagaacactacaacttattcaaatggaatcttacttgctgtaattttgtatttgttaaccaatctctatctgcctctctgctgtccttcccagcctctggttaccaccattctcaaccttttatgcttgcatatgagtagaaacatggagtatttctctttctgtgtctagcttatttcacttaatgtctttcaagctcattcatgttgctgtgaatgacaggtttatttttcatggctgagtagtattccattgtgtatatatgccatgttttctttcttcattcatctgataatggacacttagactgatttcttagctattatgaatagtgcttcaataaacataggagtgtagatctctctttgacgtatagatatatttgtttttgcatatatgcccagtagtggtatagatcattaccagtggatcatatggtagttgtatttttaacttttgtttatttttcattttttaaaatggggtcttgctgtgttattcaggctggtctcagactcctgggctcaagcagtcctgcacctcagcctcctgagtagctgggactacaggcacacaccaccgtgcctggctatagttttagatttttgaggaacattcatactgttttccatatggctatactaattagcattcctaccagccatatataagagttcccccttttccatgttctcagcagcattttttattttttatctttggtaatagccatcctaactgaggtgaaattatatctcattgtggttttgatttgcatttccctgattagtgatgttgagcattttttcatatacttggccatttgtatgtctccttttgagggatgtctattcaccttatttacccattt

SEQ ID NO: 22847 - DNA, 2663 bp, Homo sapiens
ttattattataattttttttaattttttttttgagatggagtctcgctctgtcgcccagctggagtgcagtggcatgatctcagctcactgcaagctccgccttctgggttcacaccattctcctgcctcagcctcccaagtagctggaactacaggtgcccaccaccatgcctggctaattttttgtatttttagtagagatgggttttcaccatgttagccaggatgatcttgatctcctgacctcgtgatccgcccgcctcggcctcccaaagtgctgggattacaggtgtaagccaccgcggccggcccattctttctattattatgtgtaatttgttaagagttttcatcatgaggggatattgaatgttaccagaggctttttctccacctatggagataatcacattttttgttcttcattctgttgatttatcatgtttattgttttgtgtatgttgaacccattcttgcatccctagaatgaattccacttggtcatggtaaacaatctttttgatgtacttttggatttggttggctagtattttgttgaggagttttgcatttatgttcatcaggaatattggcctgtagttttcttttgcatgtgtgtgtccttatctggtgcttgtgtcatggtaatgctggcttgtggagtgagtttagaataattccctcctcttcattattctgggaaagtttgagaagaattcatatttaattcccctaaaatgtttggtagaattcagcagtgaagccatgagatcatggactttcctttgatgggtgactttttattactgcttaaatcttgttactcagaattggtcaattgaaattttctgtttcttctaggttcaatcctgatgggttgtatgtgtctaggaatttattttctgtaggttttccaactttttggtttgtagttgttcataatagtctctaatgactctgtatttttgtggtatcagttgcagtgtcatttttgtatgtgtttgattttgagtcttttctcttggttagtctaatggtttcttttcaaaaaatgaacttttcattttgttgatcctttgaatttttttttaagtctcagttttatttattactcttctgatctttattaattctttccttgtaattttgggtctgatgtgttcttttctagttccttgagaagcattgttagatttttcttttttctttttttctttttttaagagacagggtcttactgtgttacgtaggctggagtgtaatggtacaatcaactcaaactcctgggctcaagtgatcctcacacctcagttttgaattcttgggctcaagcagttctcccacctctgcctccagaatagctaggactactggtatgcgctatcatgaccagctaatcttttttttttttttttttttttttttttttttttttttagagataaggtcttgctatatatatggcccaggctggtcttgacccagcatcaagtcgtcctcctgccttgcgctcccaaagcactgggattacaggtgtgagccaccatgcccagccagatctttcttgtttttgatgtaggtgtttattactaaatacttccctcttaaaactgctcttgctgcatcccatacatttttatatgttgtgtttctgttttcactcattttaagacatttaaattttgtttcttaatttcttcattacccattggtcattcagaatcatgttatttaatttccatttatttgtgctgctttaaaagttcctcttgttattgatttctaggtttatttcattgtggtcagaaaggtacttgatgtgattttaattcttttaatttttgtgatttgttttgtggtttaacatgtggcctctccttgaaaatattgcatgtgcttatgaaaaaaaatatgtattctgtagctgttggatgaaaagatctgttagtgtcttttaagtccatttggtctaaagtcagtttaaacttggtgtttctttgttgattttctatgtatatgatctgtccattgctgaaagtagggtgttgaagtccacaagtattattgtattattgtattgtcttcccctttagatctaataatatttgccttacatatctgggtgctctgatattgggtgcatatatatttacaatttttgtatcctcttcctgatttcatccctactgtgtttgatacaaagtctcttatcgtaagtatagctactccttatatagtcatgattgtggtaaaaaaaaaaaaaaaagaaaagaaaaaagaaaaaaaatgtatagctactcctgcttgcttttggtttccatttgcatggaatatattctattccttcgctttcagtctgtgtcttttttttttttttttttttccagacatagtctcgctctgtcacccaggctggagtgcagtggtgctatcttggctcactgcaacctctgactcctgggtttaagcatttctcctgcctcaccctcccgagtagctgggactacaggtgtgcgccaccacacccggctaatttttgtatttttagtagagatggggtttcactatgttggccaggctggtctcgaactgacctcaggtgatccacccgcctcagcctcccaaagtgctgggattacaggtgtgagtcactgcgcctggc

SEQ ID NO: 22848 - DNA, 1023 bp, Homo sapiens
gggtgtgactgctctggatggttaatgcactgttttcccaggatgcctggcattgcttcagctctggcctagaggggcaggatgtagcagcatctgggaggggtaggtggaggagcttcgccaaggcatcctttcctcaggaggcaatgtgcagcttcagctcaggtccctggaagcagggcagttttgggagaagtagactgagaggtagacagtgagaggtggatgttgcacatctgccagagcattgttttcccaggagggagtgcacagcttcagctctagtcgaaggtgacaggacacagcctagcatagggacttgaggggtaggtggtgcagctctcccactgcatggccctacatgggaaggtggaaaagctgcttgtagatgttgggccaccaggtgggggtggatggtgatggcttatcctcagggatgaagaggtgccatggaaccagacagaactccagccgttccaaaataacagcacagtagctgtatgggccactgggggcaggacagtgtcagctccttcctcaggagcacagctgtatggactccaggcgggtccgtcagctaagcttagtgcctgtgagggctgtaggggaccccagtggtgagtactgtaggtgtccaaggtggtgatgtacgctgctggtatgctattgctcactttttccacatacggagaaattccttctggttttcagctgatcttggctgggggatggggttgtggagaccaggtgttccattctctgcttggctatcctgagtttctgtgctcaccagagtttttgttattactttgacatattctggtgctttcctttagttatttgcattaaaatgtatttgcttatttattttggctctgtgggggtggggagaacagcatttacggactgctaatctgccttcttgctgaagtcactctcttgctacagatatttggttggaaacattttcgtttgtattctgtaaataactaggagtagaattgctgtgtcatatgatatgtg

SEQ ID NO: 22849 - DNA, 1662 bp, Homo sapiens
aatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccgtagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcattcttctatttcatatatttctatgacattatatcttagatgtgtaatttatgaa

SEQ ID NO: 22850 - DNA, 1046 bp, Homo sapiens
accactctattttgattactattgctatctactaaattttaaaatagggtaaacttattcctcactctttattctttttaaaaattgatttggggccaggcatggtggctcacgcctgtaatcccaacactttcggaggccaaggtgggcagattacatgaggtcaggagttcaagacctgcctggccaatatgatgaaaactcgtctctatttaaaaaatacaaaacctagccaggcaaggttgcaggcgcctgtagtcccagctactcgggaggctgaggcagaagaattgtttgaacccgggaggtggaagttgcagtgagctgagatggtgccactacactccagcctgggtgacagagtgagaccctgtctcaaaaaataaataaaaaataaaaattgatttggctttcatatcaattgtttcctttggctttgtatatacattttattgcatgtttgtctctatgaaatatgttgctgggattttgatataaattgccttaaatctaaagatcgttttggtgggaattgacatcttgttgagtcttgcagttcatgaatatggtacgtccctctgtttattgaggtcctcgttgatttatttcataagggttttgtaattttcagcttatagattatggacatattttaaaaatctagacagtttcttagagggccattatatgttgtattgagttttaaatttcagtttgcacttgatacttgcaattatagagaaatatataaattagaatttttatatgtattctgtgactttgctgaagtcagtagttccagcaacattttttaatagctttcttaggattttcttcataaatattaatgttattagcaaacatcaaacatcttacttctactttttttttttttttttgacactcttgttctgtcacctaagctggagtacagtggtgcgatcttggctcactgcaacctctgcctctcgggttcaaggaatttttaccctcagcctctcgagtagctgggattactagcacactccactatgcccagctaatat

SEQ ID NO: 22851 - DNA, 1067 bp, Homo sapiens
aggagaactggtgtagattcttcaaaagaatagagggtggccgggcgtggtggctcacgccggtaatcccagcactttgggaggccaaggcgagcggatcacaaggtcaggcgttcaagaccagcctgaccaacatggtgaaaccccgtctttagtaaaaatacaaaaattagccgggggtggtgacgcgcgcctgtaatcccagctattcgggaggctgaggcaggagaattgcctgaacccaggaggtggagattgcagtgagccaagatcgcgccattgcactccagcctgggcgacagagcgagattccgtgtcaaaaaaaggtgcggagcgcgggtctcttccgcggaaactgacattgcgtttccgttgtcggcctcccgctgcaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttttgtgtattctcagcttatctaaacttaatgaaatttcttttatatttaaaaatagtacattctgtctcatgtcacatatcagtagatcaattagtatttccttgtgaacaatgttatttataaagaactcattatc

SEQ ID NO: 22852 - DNA, 1069 bp, Homo sapiens
caccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcac

SEQ ID NO: 22853 - DNA, 1021 bp, Homo sapiens
ttcacactccagactgctgtattccagcccaaattactcaaattagccaatccatggggaacatggaaaacgtagctaatgcaatccgcttgccttacctaagttgtcccctgcagcctcaggttgctgttactgtgtttcagatgcaaccctctgtgggaccctacccaagttctctcattcttagctataggtaataaattgttctgattttgtgtatccaagtgacattgggttgtttcttgctatcagaagaacccagaaaagtattatgaatctagtgaatgttggaaaatctttagccattagcataacctcatttcgtgccagcatgttcaccctagagaaaagtagaagtgaaggcaatgtcatctttccttgttaacatgataactcagtagagcaatgctttggagattagctttttagggagagagccagcagttgagcctcctgcatctgaacatccacactagggatattgtctgtactgccagatatatgggaagattttgtgaactgtgttgcagttttcaacttgactggggcctttcccagagttatgcccctgccagtgcctatttaaaaatgtcatctcttttctaccaactggcaaagagccatggtgtgtagcattttagtcacattaaaatgcagttatggcagcatgctgtgttctctatctgaagaattcactagtcacttgaacactttggagtcctcacccccctcctatgattgattagggcatagacatcagccttggacagaagacatggactggctttggcaggcagattgcagaaatttcctttctccaggggaaagtattggttatctcattgatagtggtaggaggcagatacattgctaggcagactaaggacgggtccctggtgaaacccaaacttcaagccaacgacagtttaaagcctgaaaattgagctgccagttccaagtagagtccatgactggagtgagaacttcctcaatgccttttagccaatcaaatggtgctttt

SEQ ID NO: 22854 - DNA, 1100 bp, Homo sapiens
tgcctcagccttccgagtagctgggactataggtgcacgccaccacacccggctaatttttgtatttttattagagatggggtttcaccatattatattggccaggctagtctcaaactcctgacctcgtgatccgcccacctcagcctcccaaagtgccaggattacaggagtgagccactgcacctggccagaagccatattctataataaatagtggttggattaataggacatgggagagactgcagtagagtggatgagtcccctctaaaggagcactcacaaatgccctggtagctatggctgtgtggggtggggtattacaggaattccaaagacctaaggagctgtgtacctcctgtagccaaggtcaatgtcagaacaactaaatcaatgattttatgaattcctgtagcctccctggactataaatttcaaaccatagttgcatcatctacatagtgatgggccttgagccttccctaaagataaaaagcctacatagcccgtgctgccccatcacctgtgtgtcggaacatcttccttgtttcaagctacatgagtgcttttttattctgttgaagtgtgtcatgtcatgcctggtgaattaataaatctgtcctctgcaactgacagggttcttccactgtgaaacaagagggttgtatataggttgcgtttaactaacagagttaattaaacctttttactttaaaaattactcagtcttgggccaggcgcggtggctcacgcctgtaatcccagcactttgggaggccgaggcaggcggatcacgatgtcaggagatcgagaccatcctggctaacacagtgaaaccccgtctctactaaaaatacaaaaattagctgggcgtggtggcaggcacctgtaatcccagctactcaggaggctgaggcaggagaatcacttgagcccaggagttggagattgtggcgagccgagattgcgccattgcactacagcctgggcaacaagagtgaaactccatcttttttttttttttttttttttttgacacagagtcttgcactgtcacccaggctggagtgcagtggtgtgatctcagctcactgcaa

SEQ ID NO: 22855 - DNA, 1070 bp, Homo sapiens
atctgtgggtcagatttaggaatagacatctttagattctggaggcaatgctgttagggagaaggaaggggaaggaaggggctgaggactggatctttctgttgggcacctggatggggttgctgggcatcacaaagacagatgagggagtggatggactgaggatatgtgtgtgtgtatttgtgtgtttatgttggagatggcctttggaaaataaaggcttttgagggggagagtgcacataaaagttggatggtgaggcatctccacaaaagaggtgagatgatagtgaggtctgggaggggcttagtaccctattatggactcaacagggttttgtggcaaatattggttgtacctgggtagtttcacgcgaactctgagactattttggcagaagatgggatcatctagaagcattgctagtcctggggtggggatggtgttggggaggtcagtgtatctgggctttggattagagttgggggatagagaaagtcgtgactgcttatgggacaacatatacatgtagaagggggagacagccaagatctggaactcaaaggaggtgtgcaagaatatgtgggtttggaaagctgaggtcaaagaaagaaacaggattgggttgggagacgttcaaagcaatgtttcctaaacattgcattctggtcattctaggggcaaatacgattctggttgcatttgtcatgcactgcaggatttcatgtgcagagtggcatggtaacacgccatggaaatactcccagttgggctgtggtggttgttagtgttgccaagagtggaggtgttggatacatgagggaggtgccatccaaagcctgagtggaggagcatgaatagatggttccacctctggcactgggcacttaagggaggagggtgagtccaagtttggttatctgagaggcaagatctgggtgactctagggaaattgagtgacaaaagaaaggtaggcccccatgtgccaggtgttttttttgttttgttttgttttttgagatggagtctagctctgttgcccaggatggagtgcagtggcgcgatctcg

SEQ ID NO: 22856 - DNA, 1057 bp, Homo sapiens
tgacctgtactttaggtgttatgaggtctgcgtgtatccttcagtagtccatgaatactcgctctcacacaatcagatctctctggatctggacacaaccgtcatggcctgttgaaagccatttatagaggagtgagttggagaccccacctgccctccctgcatggtacttctcccttgtgtccttaccaccaggattcccccactacacacacttcacaggcccacctctgaacactgggccttcctctcactggccttatttccttgcctgtgaccagtcctgtgccctcatttgtgggtgtgtctcacagacatttgtgatggggctgtctcctccctccggagttcacgtgcacttcaccagcatttctgttcttacaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcacatgcacgcagggtggcaaggattttactgccagctcagaccttctccagcaacaggtcttaaacagtgggtggaagctgtacagggatacccaggatggggaagcctttcaaggtgaacagaatgatttcaactccagccaaggtgggaaagacttttgccaccaacatgggctgtttgagcaccaaaaaacccataatggggagaggccttatgagttcagtgaatgtggggaattgtttaggtacaactccaaccttattaaatatcagcaaaatcatgctggagaaaggccttatgagggcactgaatatggaaagacctttattagaaagtccaacctagttcagcaccagaa

SEQ ID NO: 22857 - DNA, 1033 bp, Homo sapiens
ttcacctcctgtcagatgagcagcattagattctcatagcagcctgagccctattgtgaactgtgcctgtgagggatctaggttgtgtgctccttatgagaatctaactaatacctgatgatctgaggtgggacagttttattctgaaactgtctgccccctcctctgtccctgatgcgtggaaaaattggcttccatgaaaccagtccctggtgccaaagaggttggggaccgctgctttaaactactcctcttcctcattccctacgccaaccagcccctgacaatactactgtatgaattttactataaatatctcatatgaggaaacttaagttttagtcttttgtgacttattttgaggcttatttccctaaatgtcttcaaggtttatccatgttgtagcatagcttatgattttcatcttttttaaaggccgaataaaatcccattgtagtcatgtgtcgcctaacaagaggactgtgttctgagtaatcatcttaaggtgattttgtcattgtgtgaacaaagagtgtacttacacaaacctgaagggcacagcctattacgcacctaggctatatgatatggtccattgcgcctcagatataaaccttaacagcatgttacagtattgaatattgtaggtaattgaaacacaatgataagtaaatgtgtatctaaacatatctaagtttccaaaaggtactgtaaaaatgtatgaaaaatggtaaaaactttatagggcactaacatgaacgaagcttgcgggacccctctggttgagtcagggagtgagttgtgagtgaatgtgaagctctaggacattactgtaccctattgtagatgttataaacattgtacacttaggctactctaaattaattttttctttagtaataaattaaccttagtctactgtaacgtttttacttcatgaacttttaaaattttaaaaagctttttgactcttttgtaataatagcttaaaacacaaacacattatacagcctgtatagaagtactcctttat

SEQ ID NO: 22858 - DNA, 1049 bp, Homo sapiens
tattattattattttgagacggagtcttgctctgtcacccaggctggagttcagtggcacaatctcggctcactgcaagctccgcctcccgggttcacgccattctcctgcctcagcctcccaagtagctgggactacaggtgcccgccaccacgcccggctaattttttgtatttttagtagagacggggtttcaccgtgttagccaggatggtcttgatcttcctgactttgtgatccatccgcctcagcctcccaaagtgctgggattacaggcgtgagccaccacgcctggccacttcccgttaattctattttaaattgtggggggaattattttccatagcagctgcaccattttacattctcaccagtgcaggggttctagtttttcacattattgccaacactttgttttttaatcatgatgggtgtaagatgttattttattatggttttttaatttgcatttcagtattggtgttgagcatcttttcatttgcttgttgactaattgtataggttctttggagaaatatctgttaaatgtctttgcccattgaagaaagtttttgtaaattttcagataacattgtatgcttttgttgtgtacaacatgatgtgaagtatatatactttgttgagtggttaacatgtacgtattatatatgtacatattctgtatacgtattttaaatattaaccccttgcagatatgtgtttttcaaatactgtctaccattcagtctgcttccttttcattctgttcatgtcttttttttttttttttgcacaggagttttcaaatttcaatggagtccaatatatgttatgtttgtttcctatgcttttggtattatacccaagaaattattgctaaatccagtgtcatgaaccttttttcatgttattttctaggagttttatagttttaagttgtacttttatgtctgatttatttcagtttgttttagtaaatggaggaaggtaagagttcaacttcattcttttgcatatagatatccagctttttgaaagtcatttgttga

SEQ ID NO: 22859 - DNA, 1013 bp, Homo sapiens
tacagggcatcacatggtgaggctgctgagtgtgctcacatgttaacgtgctagcgcaaatcattctctctcttttttttttttttttttgagacggagtttcgctcttatcgcccaggctggagtgcaatggcgcgatcttggctcactgcacctccgcttcctgggttggctcaccgcaacctctgcctcccgggttcaagcaattcttctgtctcagcctcttgagtagctgggattacaggcatgtgccaccacaccccgctaagtttttatttttagtagagcagggtttctcccatgttgatcaggctggtctcgaactcctgacctcaggtgatctgcccgccttggccccccaaagtgctgggattacaggcaagagccacggcccctggccctttctcttcttataaaaccaccagttctcccaggataacccattagtctatcaacccataaattgattaattcattcctgaggatagagccctcatgattcaatcacctcttaaaggtcgcacctctcagtactaccacactgtagattaagcttcaatgtgacttttggaggagatggtcaaaccatagcaagcagtttgggaaccatagtctgtacagaaacagtgattgtattaatatgaagtatgagacaccagcaaactagagtggaatggatgagcgccttgtaaagagacatccatgaatgtttcagtaactatggctatgtgagatgagggtatacagaaactctgaggacctacagacgtgtgtatctcctgtaggcaaagtcattgtcagagcaagtaatccaaaggtgttatggattcttgtgtctctggcgttataaaacgtatgttgaattttaattgccattttaacagtgtggagaaatgggacctttaagaggtgattaggtcatgatggctctgcccttataaaggaatcaatgcctttatcataagagtgggtttgttaacccgagagtgacgtttttataaaatcagctgtct

SEQ ID NO: 22860 - DNA, 1048 bp, Homo sapiens
ctactgggactgggccacagaggaggggaagtgatcagatcttggatggatatcaaaaactgaacagacaggaattcctgttgcatcagatgtgactgaaagaaagggaatgaagagccattctggatttttatttgtatttttgtttgtttgttcctgaatatcaggaaggatggagatgggtaaggctgtgcagggagtaggttttggacatggtaatcctgagatgacccagagtggaggtgtcgtgtccacatgggcagcttgcccactcacatctggaagtttggggagggatctgggctggagatatggtagatatgggctggttgggtagaggcctggactagggtaagtcctggggctcctatttaggagggagaatcttaaggttccctttcagatgggccctaaggtgagagaagggagagatggccctgtaggacggggctgcctctatagcatggagttttgtggtcagaagtggttctgtctggtgtctgccggaatggagggttatagagtatgaagacccaggactgcatggagactgcagtgttgagtagtatataggtttgccactccaggctcagcagttcctcatgtacagtccgtatggacaaaaggaaacgtcagccaggctgctggagcagcccctttggtgcctaagtttccctagccgtcagcacaggagggatgatcaactgctccagtagaagggctctcagcaggatggtcttcaggggagtatatagcaggcagccaggttgccaaaaggaatggtatgtgctcaggtttctcagacccaggtcccagtttattaacttgtgaatttatgaggtaagtatttaagcactaattgatcatagttcatatacacacaggggcaaataaaacaacacggatttattaagttaaactgatgtaagcacttcataattggttgtaaagttagtatactggaaagtatttgattaaaataaagcaccttaagtatcacattcttaatttaaaagtaagtttaagaaacccatattttctttttctt

SEQ ID NO: 22861 - DNA, 1049 bp, Homo sapiens
actgtgttggtggtttcatgacagtacagctgacccttaaataacacaggtttgaaatgtacaggtccaattatatgtgaattttatttcaataaatatattggaaagttttttgaatatttgagacaatttccaaaaaccagaattcattgaaataagtatgtcaagaatgcataatacaaaatatatgtaggtactattttatcatttactaccataaaatatacataaatctattatacaaggttaaaattagtcaagagtcacataaacacagactgtacttggtgcttccagagaaatgtaaacaaacacaagatgcagtattttttttttttttttttttttgagatggagtctctctctgtcaccaggctggagtgcagtggcatgatcttggctcaccgcaacctctgcctcccaagttcaagtgattctcctgtctcagtctcctgagtagctggaactacaggtgtgcaccaccacgctgagctaatttttgtattttttagtagagacagggtttcaccacgttggtctgtgttggaggtcaaaagaattagggtcatgaccaactcagtatgccactggagactatatgagcaaacaacaaactagtctcatgaatgcagtatgttggcaagcctacaactgtgtctgcagccagatggaatgctaagggcagtcacaccccaggtgcagtgttccttgtggttatctacaggaacatctggagtctgttgtataaagaaagcaattatgtgagcctgtgataaatcaagcagctgaccaactgttacgtcttcctctctgtggattctacctaataaatacaaagggctgtagaagctcagggcccttgttccctagaagcaaggagccctctgaccccttctttaaaacagatctttttgtcttcatttctgcatttgtccttcttcattcagtcccgaaccgacagccacaagtggcgcccgaacagggacgtgagtgaagaaggtctgctggagcagagaaagtgaaactgaccagaagaatgagaaacccca

SEQ ID NO: 22862 - DNA, 1108 bp, Homo sapiens
ctgagactgcctctgacttgggtctaacaaagatgtgaggtggtgctggatccttgttgcatttagcaagcgctgcctggatcccttgagcagagtggcatgtggagaagccaggtgaagtacctgtgtcatggatgctgagggcagtggagttcaaggtgtagcagtcacgatctggagatgtgttcccatgaatggtgtgcaaccggggagggagtatggctgtactcaggatcctcgtactggcactttaaaccaagatggtaagcacaggtttcagtatctgggtctccagggaggtgaactagcaggagcatggatgagattccatgatgtaaggcccagagcccagtgggagacaccataaggacctggtatctcctctgagttggagaactagggaggagcgagatttactggggttcctggggattgagtctgctcatgatttcatctgcccccatcatgcagggccatgtgacctttgaggatattgctgtgtacttctcccaggaggagtggggcctccttgatgaagctcaaaggtgcctgtatcatgatgtgatgctggagaacttttcgcttatggcctcagtaggtaagatctcttaaaaccacaccatcaacctctgctggactctgctcttcccctttttccaggagtttcctgtctttcccagagttggacatgggcccttcttctttccttggttcttgacctgtggaagacataggcgttgtggttgccaggcctgggttttttctgccccaacatctactgtcctgaagccttttagttaagagtttgggttcagactcttgtaacttgcccaaccgacaccacttggttttgccactccttgctaaggtgactgttcagttctgtggtggacctgtgttacaggttctccccctgcctttagtagacgtgtctttggacctgcctttctcaggaattacaggtacttacatggttgctatttgtagggaaccctagactatgacagcaagaccccctcccaagggtttttttgtaataaatttccctcctgtagtctgtcatgggttggcgcaccctgggccagtgttgttgacccacctccctgtt

SEQ ID NO: 22863 - DNA, 1033 bp, Homo sapiens
gacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccacatttaatcttggggcttcttcttatggtctggggtggattgaaaacaggctctgccaaactgaagacagcctttgtgcggtgcctccaactttgcctcaaatgggacagtgggttgagggagaacagttcttagtccagttttgatgttaacttccatagctgacaaagcttgttaagtaagaattaagatcttgtgtagacctgatttgtctggattttagagttatttgagagcccatatttcaccttgaggagggtgctgctgctgtgacagcctgcagtgttttgaaacagcatggattgggtgtcttgtttgcagcatgtgtcccatgttccccaacactgttgagggaaagctgttcctcaggacctgctgagtggccatattccctgaaggcctgaatctgtttcacaggccactgttggtaagatctaaagcatccagtagggaaacaaaattgataaatattgagtgtgagtaattgggattggggagattgtggcaaactagaggggaagtgcccattgtaaaaacacatccacagacagtccaggcactaaggctgaatgggatcagggtatccagaaatctcaggatctccagggccatgttactgttaggtcaaggtcactggtgcagcaacgaatgtagtttttctagattcctctccctccctgggctctttacctaatgtctttgcggcacaggcggtaaccctgggagtaaagaggtgtggtccaaggaagtagcttttgtgaccagctggagtttctggtgactcttttggcaatggtcctcattgtttgccagttttt

SEQ ID NO: 22864 - DNA, 1051 bp, Homo sapiens
atttataatcagatatttcgttaaaggcataaagtcttcagattgcatttctaaaatttaaagaccgtttcgtaactataagattaacatacaaaataaaaattgtatgtgtacaaaattataaatgttttatatacagtactgaattgtatcaactgctgcttatttaagacagattgctatcagcatacaaaatatatttgatgtttagtaggtgtgtctttgagtttattaacctatacgtactgcttacttctttaatatttatgtaacgttgctaaactgcttgtccattagcttcccacattgtgctgggcgcagtggctcatgcctgtaatcccagcactttgggaggccgaggcggacggatcacgaggtcaggagatcgagaccacggtgaaaccccgtctctactaaaaatacaaaaaattagccgggcatggtggcgggcgcctgtagtcccagctactgggaaggctgaggcaggagaatggcgtgaacctgagaggcggagcttgcagtgagccgagatcgtgccattgcactgcagcctgggtgacagagcgagactccgtctcaaaaaaaaaaaacaaaacgaacttcccacattgttgatttggcttattaaatctcagattctgttcagtgtgttcaccgctcactccgccccccattccccagtatttcctgtatactagatattgatgaaatgagtgattaagatctgttccaagtggacaggtttatgttggtgacaaacctggaaacacagtgtgccttttgctaccacaacatgagcagcctggaaataaacattacaggtattgtgtgtgctggttgtgagacaggtgtgcagtagtgacagcacatcctagcaagatacacatacatctgtggcatacattgacagatgtaggaaactgacaccccccagcacagcctggagccatttgtgtatgccacatccgcaacagaaaagatgtatgacaaacctgaaacacacacacaggtatgtgcaaaacacgcaaggatcctgtgagacgggatggag

SEQ ID NO: 22865 - DNA, 1039 bp, Homo sapiens
tggtttaatgcttaataaaagcgttttctgtctctaccttcgtggagaggatttctgggttgggagaaggttttgtatttatttcactgttgccatcacacacctgtctgctgggacaaaatctcaatcaccgatttcatcaacatctagtgtacaagttaaacaatgttagagattcaataagccacatctagaatacagcaaattctaattaaaaaatgactcagcaacttcaagaaataagaaaacaaaggtaaatggaacctgtaggttacagacttatgagatacaactactgaaagctattaaatatacatttggatcctgaataaaaatgatcttccttaagaaacacattgttttagacaactgagaaaacagaagcgataaaatatttacattttaaaatatatttgtgtgattttttggggggttataaaagagcctttacattttaaaattgcattctgaagaggctatgcattaaataatatgatatccgggagtataagtaaaataacgcactagtacacatgaggaccgatgaaacataaatgactatgaaatgataaatggtgaaggaaaaaaaaatagtgaaggaagactggagaaaggttcatctggcttcataacagtcttttccatctttttttgtaattgaacacagctgtaacaggagacaaaatatgtcattgtaccagtaattttacacaatgaaaattaattttatatgttgagaatgaactaaaaagacagaaggaaactgcgttccagggtgtaagcatgtatgaaaatatcaaaatatgcattttaaatataagcactttaagttccattatacctcaaactactttaaaaaactactcaaaatatccataacaaatgaatgaatgaataaacgaatactggtatatccacagaacatcatacttctcagcaatacaaaaaaaagaaactactcatagaggtataatgatgaatctcaaaataaatacgtgactatacccagggattaaaaaagagtaaatacattatggtt

SEQ ID NO: 22866 - DNA, 1052 bp, Homo sapiens
gtctcaataccagggccctgcagctgtcacttactccctttccagatgcacatcattcttcagaatacacatccctcctatctccagacaccacagccccaagcccagggctgccacctcactgcccacaccataggcatctccctgctcttacctcccatgtcactgttttaatctcttcctctttaccccattagcgaaggcaggattgccacactagggttatggatatggacaaacacacaatacctgacactagaaagacgatacagcagttgggtatggtggctcatgcctgtaatcccagcactttgggaggccaagacgggtggatcacgaggtcaggagttcaagaccagcctgaccaatatggcgaaaccccatctctactaaaaatacaaaaattagccgggcgtggtgaagcacacctgtaatcccagctactcaggaggctgaggcaggagaattgcttgaacccaggaggcggaggttgcagtgagccaagattgcgaaactgcactccagtctgggcgacagagcgagactccgtctcaaaaaaaaaaaaaaaagaaagatgatatagcagtttattaatcatatgtacatagaacctgggagatgaggacaacatgtaccacacagggtcacatgggggtctagtccagaaaaaaagtgaataaccaaaaactgtgggatgcaagcactttgagaacaaaaggatcaactgccccctggttcccacaatgggcttgtttggaaaactccatgacctggtagggagctgaaatctgctacaaagtgataggcagaaattgtgcctggtctccttgattaaaagggttgtctgtttgggagaagagtagggagggaaacttgtactcaggccatttgatgccaccctgatttcaccagatgtcatactgggccttaattttagactttacaccataacttagcacacagcgtccagagtatgctcgacagattcaaacggatctaatactaccctagatctcccagggcatccactagtggtagcagccccaaatcct

SEQ ID NO: 22867 - DNA, 1898 bp, Homo sapiens
actctggcctgggcaacaagagagacactccatctcaaaaaaaaaaaaaaaaaatagaacaacccttctaaatgtaatccacagctcactcaccttagtccacacaatgaccaccacattttggatgtctccattctgaagcactccccagatttccagacctgggtgttcagccacctacttaatgcctacttaatgtctctgaaacatctcaaactcttacatgaccaaataaagctcctgttgtctccagtgaatattactgttaataccaacttctccatctcagttgaagaaccatggggtcatcgctgaatcctgtttcactccctcgctgtctacatcagaaaatttagttgctccctttaaaaatttgcatccagaatgcaacacatctcctaatcaatgactctggtccattaccctggactggctgtagcttccactctgatcttctttcctcttccctcaaccccacagtctgctctccacgctaacgggatggaccctgttaggactttggtaagatcacctccctcttgtaacccaaatctctcattacctccagaataggtacccaacttctcaggcagccactgcagtcctgactccttccccctgctctttgttcccagctaaaaggaaacagatctatggtttcctcaaaaatctcagcttagttttactaagcacttgcgcctcctgataccagtgccagagataacctttcacaagtttccactggctgacaaaaatgggaacacctcagtataacccctgtaacctctggcatggacttaagagccctgggcttggaatttctccagggcaccagacccaggattggggtaacagcacttaagaatactaggaaaccacaatcccaagaacatgggggtagaggctactgagggaccgaacactctccacttccctatgtgagttccatacgcccttctacaactgggagaaccagggaaagaggaatgcatccctggtgaggctagatgagctcaagcctccctgtagccctgcctggccctgaactcaggctggctgttttactttctggtctcagtgctgtcacctcttgccaactgtagggcaatgaaaaaaagatgtagcctcccactatctcaatgtcctcatcgccccatcgctgctcttcctgtgaacagtctttggaaaagtttttaaaccctaacatagggcgggcacggtggctcacgcctgtaatcccagcactttgggaggccgaggcaggaggatcacttgtcaggagttccagaccagtctggccaaaatggtgaaatcccgtctctactaaaaatacaaaaaattagccggacgttgtaatcccagctgcaggcttgtaatcccagctgctggggaggctgaggcaggagaatcgcttgaacccgggagtcggaggttgcagtgacccgagatcgcgtcattgcactccagcctgggcgataagagcgaaactccgtctcaaagaaaaaaaaactaacataaatggcgtccctcctttgttcagaactctccgtggcttctagcatcctcacaatgacagtacaaccctaggagtaactccgcctcatattcttcgttccctgcagaaaacagctttccgaattctcctggctcagtcgcgcctcaacctttgcacgcgccggttcctccgcctgtcacgctctcccacacctcgtcacacgcagtgtcaaaaaaagggccccacccacgaacgcctcagtgtccccgaccctgggcagcggggactcgagcaggcgcccctcactgatggctttagaacgtgggtgggggaaggtgtgtgaggacgggaagacgccgcactcacctgagttggcgtcctcagagtggccgctgccatcaga

SEQ ID NO: 22868 - DNA, 1101 bp, Homo sapiens
aagtagctgggactacaggcgcacgccatgacacccagctaatttttgtatttttagaagagacggggtttcaccatgttggccaggctggtctcgaaccactgacctcaggtgatccacgcatctcggcttcccaaagtgctgggattacaggcatgagccaccgagcctggccgagaaatctctgctgctttgttataaagttttggagccgcaaaataaatagcactcgaatataaaattttctttttaattctcagcaaggtaatgtacttttttttttttttttttttttgagatggaatcttgctctgtcacccaggttggagtgcagtggcgcgatctcggctcactgcaagctccgcctcccaggttcacgccattctcctgcctcagcctcccgagtagctgggactacagttgcccaccaccatgcctagctaattttttgtatttttagtagagacagggtttcaccatcttggccaggctagtcttgaactcctgacctcatgatccacccacctcggcctctcgaggtgctggaattacaggcgtgagccactgcgtccggccccaacatttattttaatgttcagattctcccagatgtttggacagtgggaactcattaaagctgtgctctctgcttttttatgtcaatattattgataatttcattactttctaatccaaaaatattttcaggctcatgttgtacccttgctatcccagccccagaatcagcctctttttcaaggagctctggttttcttcaatagataacaatgcttgtaaatattagtaagcattagctgtgctcttttctactggtaaatcattgattattaggtcctcttggagagaaagcagatacatacacatgcacgcacacatttttttttttttttttgagacagagtcttgctctgtcgcccaggctggagtgcagtggcacgatctcggctcactgcaagctcagcctccgaggttcacgccattctcctgcctcaggctcctgagtagctgggactacgggcgcctgccaccacgcccggctaattttttgtatatttttagtagagacagagtttcaccgtg

SEQ ID NO: 22869 - DNA, 1334 bp, Homo sapiens
ccagggaagccaaaagattggacacccctgatttaaagtgagagatgtgtaactactcctttaacttgaactcttagaggccactgtagggttattaactgacctgatttcaatattgctgtgtgtcagggaataggaacgcttaaagagagggagaaggatggggatcagctggtcagtgaggcagtcagaagacacataacaatttttttttttttttttagacagattcttgcactgttgcccaggctggagtgcagtggcacgatcttggctcactgcaagctccatctcccaggttcacaccattctcctgcctcagcctcccgagtagccgggactacaggcgcccaccaccatgcccggctaattttttgtattttcagtagagacaaggtttcaccatgttagccaggatggtcttgatctcctgacctcgtgatccacccgcctcggcctcccaaagtgctgggattacaggtgtgagccactgcgcctggccgactttaggcatttgacacagatctctaactaacttaatgcaggcagcaggagataaatacccatgctcagctgcatcatgaaaacggaagaaactggaacacattcaacaccctcaacacattccagctacatcaaaagagtctggttcctaccttctggccttaggataatgacagaatgtagtacatcctaagttccagagagttaccaaaaacagagacagcattctggacaaacacaaagattagagaagcaccttaaatctttggccagatggattcgtgagatccttctactacactaggcaagactgggagaagtagtgaacttttttttttttttgaaatggggtctcagccaagcatgatgactcacacctgtaatcccagcactttgggaggccgaggcgggtggatctcctgagggcaggagttcgagaccagcctggccaacatcgtgaaaccccgtctctaccaaaaatacaaacaaattagctgggcgtggtggcgggtgcctgtaattccagctactcaggaggcagacaagagaattgcttgaacccagaaggcagaggttgcggtgagccgagattgtgccactgcactccagcctaggaaacgtggtgaaaccccgtctctactaaaaatggaaaaattagcggggtgtggtggtgggcacctgtaatcccagctactcgggaggctgaggtaggagaactgcttgaacccaggagacaggttgcagtgagccgagatcgcgccactgcactccagcctgggtgacaagagcaagactccatctcaaaaaaacaaaacaaaacaaaacctggc

SEQ ID NO: 22870 - DNA, 1070 bp, Homo sapiens
caaaagggcagtctcattcaacatcagcagatccactctggagaaaggccacatgagtgtggagaatgtgggaaatgttttcatcaaaagggcagtctcattcgacatcagcagattcactctggagaaaggccacatgagtgtggagaatgtggaaagtgttttcgtcaaaagggaaacctcattaaacatcaacgagttcacacgggagaaagacatcatgaatgttgaaaatttggcagatctgttggtaaaaagagcaccctcattcaacattcgtgagatcacactggaaagcacttatgagtatggagaatgtgcaaaatcatctagccaaaaggttggcctcattcaacaatagcaagatcacactggggaaaggctttctgagtgtagagaatgtatgaaatcctgtacatagaagttttgcctcaccaaataccagaagggtcacactggagaaagaccctatagttatggggaatttgggaaattacctaacaagaagtcccacctcactgaacactactgagttcacagttgagaaaggccatatgactgtaaggaatttgtaaaattatttagccagaagagctgcattactattcatcagataatttacaatggagaaaggccacataataatttctcacataataaatgtgagaaatcatttccgtacagctctgcgctccatgttcgtaagagttcacactggacaaagccttatgagagcagcgagtagaaaatcctttgtgggaaaactctggtttcattaaacacaggagagttcatgctagagaaaggcctcaacagtgtagcaaatatggaaagacattcactagaagctctgccctgcaagttcacactagagaaagcccttctcagtgaagtaaatttggaaaattgattagtcaaacctctatgctccttcaaaatcagagttcacactggatcaaggctttatggtgtgacaaatatggcacattctttatctaaatgtctaacatattatgcacagacaagctcctgctgtggaagtgccttttgagtgcagagcatttgcgagg

SEQ ID NO: 22871 - DNA, 1068 bp, Homo sapiens
aaaaaaaaaaaaaaaaaaagtcagccgggcgcggtggctcacacctgtaatcccagcactttcggaggctgaggtgggcggatcacttgaggtcgggagttggagaccagcctgaccaacatggagaaaccccgtctctactaaaaaatataaaattagccaggcgtggtggctaatgcctctaatcccagctactcgggaggctgaggcaggagaatcacttgaacctgggaggtggaggttgcggtgagctgagatcgcgccattgcactccagcctgggcaacaagagtgaaactccatctcaaaaatataaataaataaataaataaataaataaataaataaataaataaaaagtcatagtttctgaggatagcaaatgcagcacagaagtggaatagaaccataaatatctgaaaatgctagtggttctttttgtctgtggatttatgcatggagggcgtcagaatgatttggggctaccattgctattgagaaacattggaattctgtggtaattttggattcctttttaatttaccaagactactgtggatgatgtcagccacattatggtgtaagccctaaagttaaggtcagtatcatgtgctaccttcatgtctggtgataccagtactacctcacatggtctgagtgcaaatctccctccccactctgctctttgggataatgtgtcctagcttaactacccttttaatcaagaggactagacagagttcctggttattatttatttgtagcaggtttcagtttctttttttcttttttttttttttgagacggagtctcgctctgtcgcccaggctggagtacagtggcagatctcatctcactgcaagctccgcctcctgggttcatgattctcccgcctcagcctcctgagtacctgggactacaggcacccgccaccacacccggctaatttttgtatttttagtagagacggggtttcacaatgttagccaggatggtctcgatctcctgacctcgtgatctgcccacctcggcctcccaaagtgcagggattataggcgtgggcgtgagc

SEQ ID NO: 22872 - DNA, 1049 bp, Homo sapiens
ccactatgctccagcaggagtgacagaacaagaccctgtctcaaaaattaaaaataaaaacaagccagttgcattcttttatgggaatcagggactatcacaccctcttgattgagcaaagcttacataccacaatccctggttgctcttttttttttttttttttttgagacagggtcttgctccgttgcccaggctagagtgcagtggtgccatctaggctcactgcaacctccatctcctgggttcaaatgattctcctgtctcaggctcctgagtagctgggactacaggtgcatgccaccatacccagccaatttttgtattttagtagagacggggtttcaccttgttggtcaggctggtctcgaactcctgacctcaggtgatccacccgcctcggcgtcccaaattactgggattacaggcgtgcgccaccgcgcccggccactctctcttatgcatagtgcaacccccatgtggctctctgtggtgagtggtgtcctcttctctcaagcgctgagcatatttgattaatgaactttcgtgatgacttgtgttcagcgtcaggtgttgtgtttggccatcatcataaccctagggtgaaactcctactctttaccagtagaagaaagggggattaaaatactgtaacttctggcaagaccagagagaggcctatagtgtgggcagttaggtggtggtggcaattggcatgtgtctgtggtgtccaaagatgggaaggatgtgtacgtacataaggattatgtttgaaaggcctcaggcactgcactgggattcatgtgacctttgctgtaccaggggaattgctagaaaggagaggatggaaccctttatttcaggaccacagcatagatacctgtgtgcttatctgcctcttgttgctgacggctatgtgtcatgattaatggtcccatgaggacacagtggcactagtgggcaaaatttctcctctgagttggggatcctgggaggaggaggatgggcaagggtagatatgttggggaagtggactgtgggtcttcagc

SEQ ID NO: 22873 - DNA, 1805 bp, Homo sapiens
ggctaatttttggggtatttttagtaaagatagggttttaccatgctggcaaggctggtcttgaactgacctcaggtgatccacgcccctcaacttcccaaagtgctgggattacaggtgtgagccaccgcgcccagcctctatggagtatataatcttttttttttttttttcttgagacagtttgctctgttgcccacgctggagtgcagtggcacagtctaggctcactgcaacctccgcctcccaggttcaagcaagtctcctgcctcagcctcccgagtatctggtattacaggtgcatgccaccacacctggctaacttttatttttagtagagatggggttttgccatgttggttgttgaccaggctggtctcaaacccctgaccttgtgatccacccacctcggcctcgcaaagtgctgggattagaggcatgagccacggttctcggccacgtatatacctattcttaacagtccctgaccaaaggatgttgtgctctagtcatgttggggggggcctggacatatttatatagtactcacacgtcatcagcaaataaggttccacaggcaagttgtttgcaaatgaaggagttatagaccctgcctttattctgtctgttgactcatttagtcatgcccttgacaatatgaggccttctatatctgtgataatgctaagcagccccaacctcaacctgaacccaactccctgtttgtgcaaataattccatagactagttttttggtttgtcagatactcttgtgggtaggctgcatactcaacaaagtcaacatgtacctcaccagcatttctttgcttttaggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgt

SEQ ID NO: 22874 - DNA, 1058 bp, Homo sapiens
ttgcagatgggcatggtggctcatgcctgtgataccagcactttgggaggccgaggcagaagggtcagttgaggtcaggagttccagaccagcctggccaacatgctgaaaccccatctctactaaaaatacaaaattagccaggcatcgtggcattcgcctataatcccagctacttgggaggctgaggcacaagaatcactttaacctgggaggtggaggctgcagtgagctcaggtaatgccaccccataccaggatgagcaacaagagcgaaactatctcaaaaataccataattttggggttcataggtcaacctgaaagggtggcagttttcatcacaatctctggtgcttctgagagcaacatgaaattgttctctacttcacaagggatggtgcattatgtttcagtgctgttgagggtaccttcacaggttgtgaggttatagtggaaatgataagtttttcggaattactgcattttaaaagggcttctactatgatccagacatggctgtgaaggatgaatacaaacagaaattctcaggaccttcttaattgaatcttatgtggctaaggtcactgctggagagaataacctaaagattttgttatttgtggtagtccttctagtctaattgacctaaaggtcattcctgcataggcaggaggaagaagaaagggagcagggatgtccattagaccactacgtggcccatcatgtgaccagccgtcattctttctgaatcatctggaaatggtctttattgttcgtcatgtttttgttaccatgaaggctagttgcctcactcaggttgaggagatgatacagcaatagttaataaacctcttggaaaaatcaagtccagatttttaaaattacatttttaaagctgtaataagaaataaatcacttttttttttctttgagatggagtctcgctcttgttgcccaggctggaattcagtggcacgatcttgggtcactgcaacctctgcctcccaggttcaagcgattcccctgccttagcctcccgagtagctgggattacagg

SEQ ID NO: 22875 - DNA, 1046 bp, Homo sapiens
aataactggggggtcttttttatttatgttaattttttttttttttttgagacggagtctagctccgtcacccaggctacagtgcagtggcgcgatgtcagctcactgcaacctccgcctcccgggttcaagcaattctcctgcttccgcctcccaagtagctaggattacaggcacccacctccgcgcccggctaatttttgtatttttagtagagatggggtttcaccatcttgcccaggctggtctcaaactcctgacctcaggtgatccaccagcctcggcctcccaaagtgctgggattacagtcatgagccaccacgcccagcctacttatgttaatttttataccatagaagcgactaagggcgtgtctagagttccttaaggtggaggtggtgataaagagaaagacagggttatattgacaaggctgacagtaagaaggggtagtccttttagtgaaatagatgaggggttttaggtctgcacaaacctttttgtggaagtctaactttgctattgggtagtttgagtgatgcagtcctatttactacaatgttgccaggcagtaggagcagaaaattggtgtcttggctgcaggtcattacaacaatgagtgctaggaataactgtgtcaattaaagggctgggatataaatatttgtgtgaaaaggctagctgctgttgatcttttacatttctacaaggtatgacaaagcaagcattaaaggcaatagtctgagtgagtcagacttagttacattaataacaaaggagctaataacagaataagaaaaggaagcagtatagaaggtatatgaaaattaatctttctttaacttagtagggcttgatcctagtacagtaacccatgattctgagaggaagatgttttcttgacttgagtgtggtgggtccatttttttttttcctcagctgtgtggacggcagtctcaggggttaacagcgtaaaatagggttcttcccaggctggtttgagttttttctttctagcttttgatgaggacgtggttttcaggctg

SEQ ID NO: 22876 - DNA, 1065 bp, Homo sapiens
gccgcctcatcttccactccacaccaacaacctgaaagcaagaaaatgctggtgaagtgcatgttaactctggtgggaaggcacagaccacccacaagtgtatctgaaaaactgaggaattactccaaggaagtacttggaggaacaggatgttggcttcaggtggaagatggtgctatgtattattactggactataatggtcacagaatgtaggaggcctcataacataaaggacacaaccatgtatgtaacacagggagtagaggcagggtctacaatccctgcatctgcaaaccactcatctgcagaatttatgtcctcatgacatgcgagtgctgtagagagggatttgtccaggccaaggaaaacacaagcacaacacagcagcttctgcttgaggacagtttaacaaagtgtacacatttgctaacacaaaacctgtatgctaatactggaaaccactgcagatgaagatgtgaataaaattaagatgtgaggtccagagatgtgaagattattcaggggaataaatatcagactacaagctcatgtacaaatcagttaaaggatttaaaaaaaaaaaaagtacaactgacaaggagtacaactgacaattctgaggttcttaacaatggggaagaggccagtaccagtggctcacagctgtaaacccaatgtaggaagatcacctgagcccagaaatccaagaccagcctgggaaacatggtgagaccctgtctctacagaaattatttttaaaatggccaagcatggtgactcatgcctacaatcccagcactttgggaggctaaggcaaagggatcactcaggcccaggagatcaagaccagcctgagcaacacagcaaaacctctctacaaacattagccaggtgtgatggtgtgcacctgcagtcctagctactcaggagactgaggctggaggatcacttgagcccaggaggttgaggctgtgtgaactatattcacaccactgcactccaggtaacaaaaatgacagtgtgagaacctgtctcaaaaaagaaaagagaagaggagaggaga

SEQ ID NO: 22877 - DNA, 1033 bp, Homo sapiens
agtctacaaacagcatcttcaatttaaactgtcagttaaagttcttaagatttaggaaatgatggagcttggaaagttatgagattacaaaattccggaaagtccattagaaaaaccacaggatggaaaaaaaaataagccaggcaacaaagcttcagaggtccctgctggcccagggagagatacctgcagtgtccagcatctcagtgaacatgatctactttcaaaggcaggggcttaaagcgagggaagggggggaactggtggaagcaaaggctctccccatcaccaccttggttttaggtagggattttaatttaactgaaggacatctctcaacttggacaataattaatccctcaacagcacctcatatctgctatgactttgcagcgcagcagaaagaatgtttagtatctaatagataaaaatttcatcgaaaaaattaaaatattcttgcaacacccccccaacaccaattcctattctaaagtgaatctatcacttgtgctgttgatacttgaccatgtacttaattggaaacctagatgcaaaagactgaaactgaatcttcaccccaaaatgaaaacaaaataaaatgagtaacttgaggtttatggcatatagtttaggtaaacacacacacaaggagaagggggaagaggaaatggaaggtgtcggaagcaaagctgagtgacagaacacattcagtcagggcagatgtctatacagagtgtagtggaacctcaggaaaagcttcatatggattcatgcgcacgcgtctggaggcaccagatccctccatggcagatccaagaacagggagctgagggagaaggccattcccttcattccagttttaggagctccacatcgaagacgagagtggcgtgtggtgggatgatgcctgggtgcccagtggcaccgtaggcagaatctggagatatagtcagttgggctgtctgacccacactcatctaagcaaccctttcttcccagcctcggatcacctcctgctaaaaattaaggggct

SEQ ID NO: 22878 - DNA, 1055 bp, Homo sapiens
tctgtcgcccaggctagagtgcagtggcacaatctcagctcaccgcaacctctgactcctgggttcaggagattctcctgcctcagcctcctgagtagctgggattatatgcatatgccatcatgccaagctaatttttgtatttttagtagaggcggggtttcaccatgttggccagactggacttgaactcctgacctcaggtgatccacccgcctcagcctcccaaagtgctgggattacaggcgtgagccacccacacccagcccttatttttattttttagagaagaggtcttgctctgttgcccaggctggagtgcagtggcacgatctcggcttaccgcagcttcaaactcctgagctcaagcgattctccctccttcaggctccctaaccctaaccccaaccttggggcagctgggaccactggcctgcctgacctcaccccactaatattttttattttttgcagagacaggatatggggaaaagaaatcagattgttactgtgtctatgtagaaaaggaagccataagaaactccattttgatctgtattaagaaaaattgttctgctttgagatgctgttaatctgtaactttagccccaaccctgtgctcacagaaacgtactgtattgaatcaaggtttaatggatttagggctgtgcagcatgtgccttgttaacaatatgtttgcaggcagtatgcttggtaaaagtcatcgccattctccattctctattaaccagggacacaatgcactgcggaaagctgcagggacctctgcctgagaaagcctgggtattgtccaaggtttcccccactgagacagcctgagatatggcctcatgggaaaggaaagaccttacatcccccagccggacacccttaaagggtctgtgctgaggaggaggagtgaaagagggaggcctctttgcagttgagataagagtaaggcttctgtctcctgctcattcctgggaatggaatgtcatggtgtaaagccaaccattcccattcgttgtattctgaaataggagaaaactaccctg

SEQ ID NO: 22879 - DNA, 1128 bp, Homo sapiens
gaggttgcagtgagccgagattgtgccactgcactccagcctggcagcagagggagactccatctcaaacaaacaaacaaacaaaaaaagatactttaagttgtttaaaggccagagagaggccagtggtgtgtggcagtcagctggggatggacatggaatgtacctggaagtctaaagaatgaggtgcgttcagagagggtatctctgctgtgctgaaggtgccacattgggcttcccatgacctcggccatactagggaaagtgcctgtcaggagtgggtggactttatgtcacagccactgcacagatacctatttgttcaactaactattgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgactctggagaacctggcacttatgtcctccctgggtaagttgctcacactcaccctgtgacttgagctagtctctgttttcccctgtctttccccattggcaagactttctcatgtcaggagcatggacacagcttcctgcttcagttctatgggtaggttcttggttgtaggactgaggtgtacatactgccctactcctttcttggagcagccccagcacctgctttactgcaggctcccagggagggattcccagtcagaagcccaccttgttagtcctgtggatgtttgggtgtccttgtccagatttcaggttcctgtgtacccacagtctacttcctttctctagctgctattttcttatgccttcctgtggcaggaattgccttcacagactacatcactgcctatatagaccagaggctgttcttgcaagatcttctttagaaattctccttcaaatactcagtttttttctctcatgggctgagttgttctgagacaatgttggctgttcccttgttctgtctttcccttagtctgt

SEQ ID NO: 22880 - DNA, 1746 bp, Homo sapiens
tttttttttttttgagacacagtctcactctgtcacccaggctagagtgctgttgcaccatctcggctcactgcaacctgtgccttctgggttcaagcgattctcccacctcagtcacccaagtagctagaattacaggtgcatgccaccacaccactaatgttttgtggttttagtagagacgggtttcaccgtgttgcacagactggtcttgaattcaactcttgagctcaggtgatctgctcacctccgccttccaaagtgctgggactacaggtgtgggccgctgtgtttggctgaaatgtatgtcttttaaaggagtgtccacagttatccagtcactgtgtctgtgatggataagcagatacagaaattctcaagacttccataataatgaatgttgtgtagctaagctttggtcagaggaaataatctaaaggttttgtgaattcatgtaaccttttgggctgctcaccttaaggtaactcctgtattaacaggaggaacagaatagggaaaaagatctcagttcagtgatgtagctttgtgaccagccagtgatccagttcaatcaggtagaaatgaccttcctgctacatcaatatttgcttctatggaggctagtttccccacttagggcatgagaagaattggtaaagtcaacataaaattgccaaacctgtcaccaaaaatgatggcaaatctgtatttttctcttaaaccgtgttataaaagctgtaataaggtataggctgagcatcatggctcatgcctgtattcccagcactttgggaggccagattccttgagaccagtgtggggaacatggcaaaaccttgtctctaggaaaaatagccaggtatggtggcatgtaccttagtcttagtgatgtgggaggattgcttgagcctgggaggcagaagttgcagtgagctaagattgcaacgctgcagtccagcctgggtgatagagtgagaccccatcttaaaaataaaataaagatataaatgacatccaataaagtacacatatttgagctgtaggataagtcttgaattttattataatcccgtgaaaccatcatcagagtcaccataatgaatttatctaatctatcacctttgtatttacttggagcctttataaagtttttctctctgctcttcaaacaaccattgatttactttgctgtatgatggagtactttccattttctggaattttctgactgatgtaataaagtgtttcctcttataatccctgggtgctctcctgcatcatgcttattttgatgtcattgtagatatatgagttgttcattcgttttatgttgctgagaagtatagtctgccgtgaaatgtcattgtatattcattcattcatccatccatttatggatattttagttgctgcatactttttttttttttttttttcaagactctctaccaggttggagtgcagtggtgtgattttggctcattgcaacctccacctcccaggttcaagtgagtctcccacctcagcctcccacgtagctgggattacatgcgtaagccatcatgcccagctgttttttgtatttttagtagagatggggtttcactgtgttaccgggttcatctcaaactctgggcctcaagtgatctgcctgcattggcctacaaaagtgctcagattacaggcctgagccatgagccaccgcacctgtaattgattctgaggccaggcacgatggctcacgcc

SEQ ID NO: 22881 - DNA, 1044 bp, Homo sapiens
gggagacaggagttttattattcaaatcagtctccctgagcattctgggatcagagttttcaaaatttggcgggtaggggcttgggaagtggggagtgctgatcagtctggttggagatggattcatagggggttaaagtgagtttttcatgctgttttctgttctgggtgggatggcagaactgattgacccagattaccggtctgtgtgttgtccgctgatccatccagtgcaggatctgcaaaatgccccaagcactgatcttagatattggggaaaccagccccacaccacccagcagataccccgagtcctgcggagacaaaggagttagaaagagacagaatacgcatttaaaaggcgggtccaggtggccagagcattggaggcttcctggcggcccagagctcttgggctccacccagtttattggtttacaagctctttgttcttatggctgattggagggggaggaagcgatcaggaaaaggattaatcagtaaaggagaactcgtgagtcattccataagatgtaaagcactggccgtttctgtgaatttccttgaacaaaggcgtgtgtctaaactacttaagatctttaacttaactgaaacgggtggctgcgggtttcaggaggagccaagatgtttgattatgctccactgcttcaagggagtgtgatctccctgagcaacccatggaatgctgctgaagagttatgctctcggggcataaagacatgaaggcaataaggagacttttctcctcagaggccgcccatggcttcccatgggtgtctcacacaggggagaccaactcaactagcaccccagaaactcacattaggttttacaatagtaaggttatcttcaggagcaacttggggaggttcagactcttggagccagaagctgcatgacccctaaaccgtaatttctattcttgtagctaatttgttagtcctgcaaagacaggctggtccccaggcaagaaaggggtcttttcaggaaagggctattatcaattttgtttcagagtgaaac

SEQ ID NO: 22882 - DNA, 1053 bp, Homo sapiens
agggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcaatcctcctacctcagcctcctgagtagctgggattatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatagccagacctcctctctacaaaaagaaaaaagaatgacatgcttcttgtttttgtctgttataaatgaaactgctatat

SEQ ID NO: 22883 - DNA, 1928 bp, Homo sapiens
tcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacaggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtctt

SEQ ID NO: 22884 - DNA, 1050 bp, Homo sapiens
gtttaattgtttttttgtagagacagtgtttcaccatgttgcccaggctggtcttgaactcctgagctcaagtgatccatccacctcagcctcccagagtgctgggattccaggcatgagccaccgtgtctgtctggtctgctttattttatttattttttgagatggaatctcactctgttgctcaggctggagtgcagtggtgtgatctcagctccctgcaacctccgcctcctgggttcaagtgattttccagcctcagcctctgcagtagctgggattacaggtgtgcaccatgactccaggctagtttttgtatttttagtaacggacggtttcaccatgttggccatgctgttcttgaactcctgacttcaagtgattcacccaccttggcctcacaaagtgctgggattacaggcatgagccattgtgcccgacctctgctttattcttaacagcttcagtgtggtccacatttgatttttcttcttttggtggacattaaatttactgcagaaaacttccttgcatactttttttttgcacgaacaagttggtttttctgtaggttggatttctaaatatggaactacaagatcagccaatgttgtaaactaaaaatctggtagtgacaaattgccatctcaaatcctttaaggccaggcacagtggctcacacctgtaatcccagcactttgggaggctgaggtgggaggttgtttgagaccctgtctctataaagaaaataaaataggacaggcacggtggctcatggctgtaatcccagcactttgggaggccaaggcaggcagatcatttgaagtcgggagtttgagaccagcctggccaaaatggtgaaaccccatctctactaaaaatacaaaaattagctgggcatggtgggtgcctgtaatcccagctacttgggaggctgaggcaggagaattgcttaaacccaggagatggaggttgcagtgagcagagatcatgccactgcgtgacagagtgagactccatctcaaaaaaaaaaaaaaaatatatatatat

SEQ ID NO: 22885 - DNA, 1316 bp, Homo sapiens
tttggctggagtgcctctctggtctggggatcacctcaggcgctgtccttcactgggcgatccagcatggaccccgaggacgaaggggtagcgggagtgatgtctgtggggccgccggcggcccggcttcaggtaacaataacaacaataacgacggcggcgggctccgggcaagcgtctcccgcgcagactgaccctttcacctcgcggcgcgatgagagcggcaccgctgttaatgcccttgacacgtggggaaactcagacgcgggtcggggcgtggtgaccgtcctggctggtcagagagggggccgggattccaaccaggcgcctggcccccgaatgcgcatgctccacgcggctctgtcctccccagggctggggtcggtcattcccgagagaatcgagcaggcccatctcctgcgttctgctccgccccgccgacacccttgcccattccaggaaggtctgtcctcgtgttgactgataacagtaattgtagcgttggccgggtgcccagatggcaagaatcatcgaatagagatgctttaacgcgtggagtcagcggacacccaccgggaccccagcaccgcggagcccctgccctggggcttgggcacaacctcttgggggcaatgatgggtcaccacgcactgagtgtgatgagagtgaccaccagggtcgtcccctgcgagactgtgggagaactgcagtgcagggcggtcagtgtttgcagggccatctggccatcagagctccactttctagacaaagtggttgcggcctgtgttctccataaagctgcctcgcgtggcaggaaacaacaataattatccttcctcaagctctgcaactttgaaattatacttttttttattttttgtcgttggtttgttcatggggatttgcattatttcagatttggtacacaaagtgagacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctc

SEQ ID NO: 22886 - DNA, 1027 bp, Homo sapiens
caggctggtctcaaactcctgagctcaaacagtcctcctgcctcagccactgaaagtgctgggattacaggtgtgagccactgtacctggtcacatgtctagattctgtaaacttgttccccacacccttctttattctcttatgaggaagaattgtgtttagctataaataccctaaaaccaggttggagcagctcaaaataaagaagcatttttcttgtaaaacaggagccctgagtctgctggtactgtcttggcatctcagaggtgccagggctgattgttctgtgattttcccaggctgtccttgggattacagtgcagctgcagcagctccagccatcacagttgtgctccatgcaggaaggaggggaagaggtaggaagaattctgccagccacatctgtccccttttggcagaactctagatgtcacctgctggggtctctttagccagaactaggtcacctcctcttgcactgaccctagttgctagagaggctggaaagctaggggtgtctagattgtcataattggcttgggcgagtcatggtccccttgctgtggcttgtgtgttggtaccctgaccacattctagagtaaatagcatctggccatgggatgtacaaccagcaatgcctgcagattagcctcccacccaaatacttctgatgccacccagggctttctgattctgcagaaaaacacatatgcccccatgatagcgtatgacctatcaactgggagtcgggtgaatctgctgcagaccctgttttcctgcccctttcatcggttgtcactgctgttacttcagacatgtatgtcggaagcaaattctcatcaccctggacatatgcctgtcactcacaagtcttatgccataaccaaatccaggatctaaaacgtgtgcccataaatactaagcaaaatgttgtgcttgcatggattaggagtatggggtcaaaatcatgatggacagtttcaataacttaatacctagacagttataaatactccagaagcagaa

SEQ ID NO: 22887 - DNA, 1037 bp, Homo sapiens
ccttcagcattcactgagagatatttttgagcttctactacttgtcatttctaggcactggctgtgaacattctagtgcggtgaggtgtacccagaatgaatgaacacatgacctgtattttggtcaggacaagagcagatgagggggcttgaagagggcttggggaaagcgggaagcctggcttataacagagtccctgtcctaatccccagaactggttatcttggatactgggtgagcaagagggtcagaatcagacaaggagatgtgacagcagaagcagaggtgagtgagagagatctgaagatgctgtgctcagctctagaggtgaaggaaagggccaggaatgcaggcagcctctaggaacgggaagatgcaaggattttccccagaacctcccgaagagaaaccagccctgccaacaccttgattttaggacttctgtgttccagaactataagataataagtgtgttttaagttacagcagcaaacagggaactcatataccttgacttcattgccagtgcatggcccacagcaggtgctcaataaatgtttgttgaatgagtggagccgtgtctgagggcacttgatgttaaaataagaggagaatcaggggacttgccagggcagctggttaggaccccatttcaatatcaggcctatggtgttggaggcctgtcccccttccgtttttttctcccaacagctcagagatctttgggttttctttcagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctag

SEQ ID NO: 22888 - DNA, 1056 bp, Homo sapiens
gcgcccgtgggaggggagcattctgtgttggaggcagaaggaatgagggtcgtgaccaactcattataccactggaggctctatgagcaaaccgcaaactgttctcatgaaagcaggatgttggtaaactgacaaactgcgtctgccgccagaaggaatgctgggggcagtcatgtcccaggtcccctgctccttgaggttatctacaggaacatctggaacctgctgaacaaagaaagcagtcatgtgggcctgtgttaaatcaaatagctgaccgtcagttaccctttcctccctattcagtctacctaacaaatatgaagggctgtaaaagctcagggccctgttccctagaatctaggagccccctgaccccttctttcaaacagatccttttgtctttgtcttcatttctgccttcgttctccttcgtttggtccagaagcaaccgtgacaagtggtgcccgaccagggacctgaacgaggaaggtctgccagagcagagaaagtgaaactgatcagacgaactacgaacccctggacgggagagtctgccggcggagaatataaggtcagttccctgagaaggtatcgggagcgggaggtttctgaatcagggtaacatggggcagaatctgtctgttgaggagcaacattatgtgcagctgcttaaagttttacttaaacaatctggtgctcgggttagttctcaaacattaagcttctgcaggaggttattacacataacccatggtttctgcagacaggtactcttgctgtggaaaattgagactgagtaggagaaagattgaaacgagctcatcagaaagttcttaaagtggatccttctattttctctgcttggggtttggtctgtactgtcctcctgccattgtcctcttcttattctgccagacagcaggtgctatgttctgaatctcaaaaattgaaagaatcttttgtctcaccagcagcgcccattgaaaatgataaacaggagagggaggatgagaactggcctgtactgtcccctccagtagcagaaatagagacccc

SEQ ID NO: 22889 - DNA, 1043 bp, Homo sapiens
gaagcacagaatcacagggagacggttaggcctccggataactgtgggcgagcctgactaatgtcaggccctccacaagaggtggaggagcagagtcttctctaacctcccccagggaaagggagaccgccccccaccctttcccggtctgctaagtagcgggtgttgttccttgacacttttcgctaccgctagaccacggtcttcccaaacgctggcgtcaccactagaccaaggagccctctggtggccctgtctgggcataacagaaggctcgcactcttgtcttctggtcacacctcactatgtcccctcagctcctatctctgtatggcctggtttttcctaggctatgattatagagcaaggattattgtaatattggaataaaaagtaattgctacaaactaatgattaatgatattcatatataatcatatctaagatctatatctggtataactattcttgttttatattttattatactggaacagcccgtgtcctctgtctcttgcttcggcgcctggatggcttgccgcccacacaagagcaccttaaaaccagaactgcttaacctatttctgagactccaaaaagctgttcgctctcatgctgccccttttcatatttctcatatccgatctcacacacaacttcctggggccactatctctaggtaatgatagagcagataaattcatcagttctatatttcaacaagcccaagcttcccatgctttactgcatcagaacaacttgcccttactcgtatgtttcatctgcctcgcagccaggcttgagttattgtgcaagcctgccccacttgccagcatgtccctggtgttgcacctgtggaaggatgcaacccacgaggcttggctccaaatgaaatctggcagatggatgttacatatatatagcagcctttggctaactccgctatgttcatgtaatatagacacttactcccatatgttacatgccacatgccaaactggggaaacagctggtcatgtctgacgatactgtctgtcgtcatt

SEQ ID NO: 22890 - DNA, 1083 bp, Homo sapiens
ctgggaggtggaggttgggatgagctgaaatcatgccattgcactccagcctggccaacaagagcgaaactccatctcaaaaaaaaaaaaaaaaaaaactgggctgagcatggtgacgcatgtctgtaatcccagcaacttgggaggctgaggcaggagaattgcttcaacccaggaggtggaggttgcagtgagccaagattgcaacgttgcactccagcctgggtgacagagtgagactccatctcaaaaacaaacaaacaaaaaacccaaaaacaaaaaagttctcagccaggtgcagtggcttatgcctgtaatcccatcactttgggaggctgaggcggacggatcacctgaggtcaagagttcaagaccagcctggccaacatgtccaaaccccagctctactaaaaatacaaaaattagcctggcatggtggcatgcacctgtagtcccagctactcaggaagctgaggcaggagaattgcttgaacctgggaggcggaggtttcagtgagccaagattgcaccactgccctccagcctggaaggcagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcatgcctgtaatcccaacactttgggaggccaagacaggcggatcacaaggccaggagttcaagaccagcctggcca

SEQ ID NO: 22891 - DNA, 1051 bp, Homo sapiens
gggtccagtccacgggttctgcccgcacggtccaatggccggggaggcggaggtgagcagaggatgcctccgaggaatgagggggcccaccaggtggggggcggcgtgtgccagggcagagttggaggagggcaggagatctgcgtatgattccagggggaggtctttgatgcacggctggggcatgcccttggcagtgggagccattggagatgtgccgcaggactgggacaggatggggtcgtagttgctgtgccaggccctctggagacgcatgtgcagaacggcgtgtggaaggccaggcaattgcctatagggtaaactggggacgttgtgctgggggtgtacagttttaggcattctgttgtccagttttgtgcctgttgagcaggaggcaaactggaccctgggaccaggtacttgagacctaagggagaaggatgagcataggtttggttgcgtctgagaggtatgatctctgggactggaattggcaggcaggagatagagtggagcctgtgcccttggccctgcacatagatggcatcagtctggtcaccaacctgatgtcgctttgggctggacacagtttccagtagtaacaccagaagcatcaataacaccagcagctctgatattcctctgggataggagaaggaaggtataagggtatgtgtagggagtaaggtggggaagagtttagagctcatagggaaagataatgtcagggggagatgtgataggaccctgagatacaggtcaagggcctgaatgtgtccatctgtccatattttggttgtttttttctgcccatcattgaccccaaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggtaagtctcttacactgtcccccagcacactgactaccccctcattttccccatgcgaagttctgtccataac

SEQ ID NO: 22892 - DNA, 1036 bp, Homo sapiens
gtagatgagtttatttttcctctgggtaagctctgggccctacggtaactgaaacaggccactatgttcaatccagagcctttcagtctttcccagtctttcacacagcaatgcaaagtaggctacaacaggacagagcaactacccgctcttctactgtgcccttaggcagattttgtgcccccaaaaggcactccccaatctatccattcattttctcaacctaccccaacagaacccctaagattaaaggtgacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtga

SEQ ID NO: 22893 - DNA, 1037 bp, Homo sapiens
caccatcagaatagaggtccagctcctcaggctgccattccaggcctaactattggtttcccttccctgtttccaccagactaaatggagaccggcagtccccagaatgcttccatttcatcaccactaaacaaggtacacatgctggtcactgtccctgggacagccttccagatctcattccacaggattccagaaatgggaatccctcgatataaccccttgcctggattcaggatggtaagggtaagtgactcccagggcagggcccaggacccacgtgtgaggacaggacacgatcaagagtcccaggacaccaacatcccctctatctgggcttcaggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagaca

SEQ ID NO: 22894 - DNA, 1050 bp, Homo sapiens
gttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctaccttgtcttcccaccagccgcctccctccatcaagttcctttccacgtctgcttgtgcccctgttgtccctcagtttgtccaccctcctccaatcttcccctccccaaacccatgactgatcagtggcccccaacctaggctcccacctccatgcaggtcttggcccctcggctgacctccctccaacctccccctctgctcttaattttgaataggtagtgactgtaaaagtatccctgggcttctatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcaca

SEQ ID NO: 22895 - DNA, 1182 bp, Homo sapiens
ctgggcccttggattgtaagagaccctggtgttctcttgtcagggaagagggaggaagttaaccatgaaaggagaagaaaaggaatccagggtggtgtgtaggcagaattctgagtatgtccacttggagaagtgttcagtaaagggaacagtgtggggaagggtcagcgggggtggggggtggggtggggtggtcctctttttctagacgctgttatccttacccttacattgttgttatctctagaagctagaagaaagggatgtgtttctcagctatgttggggcagaggattctgggagcaaggagttgggcttgcaggcctgtgttcttccctggccacaccctctacatcttcccaataaatggcccagtgtcacagaacaggccggaaatgaggccccaactcattctgcttcctgagttgggggtggtgaagggcaaggtccagccttatgattcccactccccagggccagccaagtctcgggatggtgaacgtactgtctattgcaacgtacacaagcatgaaccccttgtgctgttttgtgagagctgtgatactctcacctgccgagactgccagctcaatgcccacaaggaccaccagtgagtcccaaggcatagtggttgggtgggtgggtgccaccccttccgtagcttagtgctcaggaacacatctgtctgctctcaggtaccagttcttagaggatgcagtgaggaaccagcgcaagctcctggcctcactggtgaagcgccttggggacaaacatgcaacattgcagaagagcaccaaggaggttcgcagctcgtaagtgtgggttctggggctgtgggggtggcccagggcagcaagaccctacctagcctgacctgctgtgtcccctagaatccgccaggtgtctgacgtacagaagcgtgtgcaagtggatgtcaagatggccatcctgcagatcatgaaggagctgaataagcggggccgtgtgctggtcaatgatgcccaggtaagccttgtgccggtgagaagggtccctgagccccctctgctgattgatgatgctgtctggggtgaggagtgatcctagtattcttctgccttctctgcttacctcatacaccttctatctgcagaaggtgactgaggggcagcaggagcgcctggagcggcagcactggaccat

SEQ ID NO: 22896 - DNA, 1022 bp, Homo sapiens
cagagacctccagaccagctgagcagtaccccctcaggcccacagggcttccctgccagctaagagaccccaggactggctcagcagtgccctcttctcaggggcctgagttccagctccatgggaaactcattggagcttctaagttgcaatgcttccctttgttcctctagtcctaagggtctagctgcttcctgcaggaactttcccatttctaagacagattgacttaaccttctcactctcccatcaatcacctaacacctagttagctgtgctctgtctcttgatgggactcaatcagatcaggcatggcaccatgctatgcacatatgtactcttggtggatgctcacagagaacatttcttcctctctgggtttgagaaaccgaggtccattgcccagggagagctgaagctggactgcccagggcagttctgccccacctgctgctggtccattccctctgtaaactagaagctgggtatagcggccatcccacacgcggggtaggtgatgctaggagccacctctctcagggtgaagaggggtgttgtggaggtgaaccctcacaggaaccacgtggttacagagggagcacaccagcccagcactcggggggctggagggtggggagtgaaggacgcacaggtagggaggcactgagtgggtggagacccagtttccatctactgtttattggacacctacagtagccaagccctgggcggacctgcttatacttatgtaatcgccagcctcacaataaccaggggaggtaggtgttctgaccatggcggacacagtgcgtcccggctggagctactcggcgctgtggacgcgctggtgctgaatgagcttggtgctctggtggaagcggcggccacagtcctggcaggcgaagggcttctctcgtcggtgggtgcgcagatgctgcgtgagcgtgggccgctggcggaaggccttgccacactcagggcatgcgtagggccgttcacccgtgtggatgcgccggtgctgg

SEQ ID NO: 22897 - DNA, 1041 bp, Homo sapiens
ccacagtccctccagtcactggtgtcacggccctgggtgtcccacagtctcgccagtcactggtgtcacgaccatgggtgacccacagtccctccagtcactggtgtcacggccatgggtgtcccacagtctctccagtcactggtgtcatggccatgggtgacccacagtctctccagtcactaatgttacaaccctcggtgttgcctcacagctctctcttttatttttctctctctctgtgcttctgtttgaataatttcttttttttttttttttttttgggagacggagtcttgctctgtcacccaggctggagtgcagtggcatgatgtcgatgatgtcggctcactgcaacctccatctcctgggttcaagcgattctcctgcctcagccttcccagtagctgggattataggtgtgcgccaccacacccggctaatttttgttttatttttagtagacacggggtttcaccatattggccaggctggtcttgaattcctgacctcgtgagccacctgcctcggcctcccaaagtactgggattacaggcgtgagccagtgtgcccggcctctgaataatttctatcgacatgtctttgatgctaccaatcctcttttctgatattccagatttctatttagtctgtttcacaaaatttttatttcccatattgtatattttaataggtgctcttatgtgtttttaatttttctgctgaaattctccattttctcaccttgcccctatcttttcttctgtaatctttaaccttttaataatagttactttaaatcattgtcatcctattgctttgcttttttttttttttttttttttttgagacgaggtctcgctctatcgcccaggctggagtgcagcggcgtgaactcggcgcacagcaactgccacttcccaggttcaagtgatattgtcctgcctcagcctcccgagtagctgggactacaggcacccaccaccatgcccggctagtttttgtatttttagtagagacgaggtttcaccatgtttgcca

SEQ ID NO: 22898 - DNA, 1035 bp, Homo sapiens
atggagtcttgctctgttgcccaggctggagtgcagtggcataatctcagctcaccacaacctccgcctcctggattcaagcagttctcccactcagcctcccaagtaactgggagtacaggcacccgccaccacgcctggctcatttttgtatttttagcggagatggggtttcaccatgttggccaagctgatctcgaactcccaacctcaggtgatccgcctgccttggcctcccaaagtgccgggattacaggtgtgagcccctgcgcccggcccataaattgattttcaaacgttaagttaacggtgcacggtggaataaacgtgcttcctggccatgaagtgttctctcttgtgtgtatgtatctcatgcactcagtcctcattatttgtgggttctgtgctggtgaattgcctacttggtaaaatttatttgaaaccgcaaatcaaaactcgcaacacctttacggtcaggcgccagcagatgtgtgtagagtgtcagtgaaggcgagttacctgacgtacagttccagctgaggtgggacaagctgctgctctgtcttggctctcagatcttttactgtgagcacgtgcctttcctgccgtgtactgaatgccgtttttcacatccttgtgccttgtgtcggctacttgacggattaaagtggcccctaaatgtagtgccgacgttctgtctggtgttcttaggtggaagaaggctatgatgtccctttcagagaaaattcgagaagctccactcaggcgcaagctctggggctgctggccgtgagttcagtgttagtgaatccacaaggcagatccagtgagacagtggctcccaaccttttttggcaccagggactggtttcgtggaagacaatttttccacggatgttggagtagggggcgtggtttcaggaggaaaccgttccacctcagatcatcaggcattagattctcataaggagtgtgctgcctgcctccctggtgtgtgcagttcacagtgggatttgcgctcctatgagaatctaa

SEQ ID NO: 22899 - DNA, 1045 bp, Homo sapiens
cttcgagtcatctgcgtggttgtgtgtgtcttgtgtattgcattgtgatgacgtctgtgtcattcgagtcgtctgcgtggttgtgtgtgtctttattgcattgtgatgacgcctgtgtcattcgagtcgtctgtgtggttgtgtgtgtcctgtgtattgcattgtgatgacgtctgtgtcattcgagttgtctgcgtggttgtgtgtgtcttgtgtattgcattgtgatgacacctgtgtcattcgagttgtctgcgtggttgtgtgtgtcttgtgtattgcattgtgatgacgtctgtgtcattcgagtcgtctgcgtggttgtgtgtgtcctgtgtattgcattgtgatgacgcctgtgtcattcgagtcgtctgtgtggttgtgtctttattgcattgtgatgacgcctatgtcctttgagtcgtctgcgtggttgtgtgtgtcttgtgtattgcattgtgatgacgcctgtgtccttcgagtcgtctgcgtggttgtgtgtgtcctgtgtgttgcatggtgatgacgtctgtgtcattcgagtcgtctgtgtggttgtgtgtgtctttattgcattgtgatgacgcctatgtccttcgagtcgtctgtgtggttgtgtgtgtcttgtgtattgcattgtgatgacgcctgtgtcattcgagttgtctgtgtggttttgtgtgtcttgtgtattgcattgtgatgacgtctgtgtcattcgagttgtctgtggttgtgtgtgtcctgtgtattgcattgtgatgacgtctgtgtcgtttgagttgtctgtgtggttgcgtgtgtcttgtgtattgcattgtggtccttggtttggatgctgtggtttttgagtcttgtgtgttccattgtggtccttggtttggatgccatggttgtgtgtgtcttgtgtattgcatggtgatgatgtctgtcatttgagtcatctgcatggttgtgtgtgtattgcattgtgatgacgtctgtgtcatttgagtcgtctgtgtggttgtatcctgtgtattgcattgtgatgatgcctgtg

SEQ ID NO: 22900 - DNA, 1118 bp, Homo sapiens
ccggtggacccaccgcgcctccgccgcccgcgagccccccggcggggctgggtcagaccccgggcgggatttgaactcccgacgcggacccgcctggcgcgaactgggcgcagggtgggtgggtctgccggggcctagagagcgtcggggctgatctcagaagagttggaccagcctctcccgggcacgaagttacttctggagcctcctccctcgtccaggaaacaagcccgggaccctttatctgaaatgtttgggaccagctatattttggaatccagaatttttccaatttgaggatctgtgggattttggactgtgatgtttgatcaaacccacctaggactgtctaggataagacaacagatagcttcgtgtcaggtcaaaccaggaaggaagaaactttcgcttttgaagctttttttgattttggagtggtggatgagcctgtgtggacttgctttcaccttggagggccctggtgaagatggaaagagataatgtaggtgaaggtgcggcggctgcgaggtgctcagtcagtgggactcagtgcatgacttctgtgcgcagaagttacgacaggcgggcagactcaagagctgatcctatctctgggatagagcccaaaggaaaaggtgcccacccagccaggcacagccgcctcgtgggaagccgggattggaactgcggcctggccgtggtgccacgttgcgtgtttatgtcttgggcgttgtgggaggcaggactggccattctctccccctggtgacgacctcaggggcagtaacaggccctgtgtttatgccaaagacggtgtaggtgtctcgatactaggccagaccaccggccagttccttcatcgagaattagttcttcttgagacgcttagggagactgagtccccatgcagatggtggctgtcctccagggtcggaggcagaagccgcgtctcccagtggccctgcagcgacgtggtggtcgaatgagttgtgctcctggaatctgggcaacacacgtggcctgacaggtagctctgtgtctgggatggcacaagtcagactcccaagccagcctcccccagagctgccatgtggctgttctgccctgctctaggctga

SEQ ID NO: 22901 - DNA, 1028 bp, Homo sapiens
aaccctcagtgacaggtggggggctgggattcgaactcagatatttcctgctcccccagaagctcaagccgtaaggctttagcccccttgggccctgcctgtgccatggccgttgttgtctgtcccccaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccaggtcagcctctgccctcggggggatggggacagggatgccccagctgctggttccctggacctacctccagctcttctttctgctcctgttctcctcgatcctagaggagggtctctcactcagactcactcactcactcactcatgatttcacttactcacagactcacaatctcactcacaatctcacaggctcacgatctcactcatgatttcactcactcacagactcacgatctcactcacttgctcactatctcacagactcatgatctcactcagtctcactcactatctcactcacagactcacgatctcactcagactcatcatctcactcacgatctcatgatctcactcactcatgatctcactcacagactcatgatctcagtcacgatctcactcactcatgatctcactcactcatgatctcactcatgatctcactcactcatgatctcactcaggatctcactcactcactcaatcacaggctcacaatggggcgccgtgtatctgcccggcctcctctatctctcactcactatctcactcacgatgaagcgccatctgcccggcctcctctaactctcactcacgatctcactcacgatgaagcgccatctatctgcccggcctcctctaactctcactcacgatctcactcacgatgaagcgccatctatctgcccggcctcctctatctctcactcacgatctcactcacgatgaagcgcca

SEQ ID NO: 22902 - DNA, 1031 bp, Homo sapiens
caggacgcagcctcggtgccccccacctccctcccacttcacgccacgtctccgccctgtccccacgccaggtgtcggtcaccgtgccctgcagacctcgatcctctaagatggaaagaacacgccggtcgctcacagggtgctgggcaagtccccgcacggcgtggggtgcagggcctggcgggttccctctgggaccggggcccagtggcgtctccgtgtccctgctctgttttccacacggtgacctcaggatgctatgcggtgtctggaaagcaatcacaggggctgtggatatggccagggcttaagcagggaagagagcgacaccctttttttctgtgaaaactggttgattccattcgtatagacttaaaaaaaccatgtgagacagtttacacgtgcgtatgtgagatataatgtacagtttgagactttaggctcttcacagagtcacacgatcaccactgtctagttccgaacattctcattaccccatcaaaacaccccgtccccatcacagccactccccgtcccctccccagccccggcacccacgcatcccctccctgtctctgtggatcggcctgtcctggacatttcatagcaatgggatcacacgctgcgtggcctcgtgtgtctggcgtctctcactgagcatggcgttcccgaggtgtgtccgcgctgtggcctgggtcagagccttgctccttttttttttttttttttgagatggagtctcactctgttgcccaggctggagtgcagtgacaccgtgtcggctcactgcaacctctgtctcctgggttcaagcatttctcttgcctcagcctccccagtagctgggactacaggcgcccaccaccacacccagctagtttttatgtttttagtagagacggggtttctccatgttggtcagaccggtctcgaacccctgacctcaggtgatccgcccgtctcagcctccccaagtgttgggatgacaggtgggggccgccgcgcctgcatgcatttgtttgtgtcaggcc

SEQ ID NO: 22903 - DNA, 1031 bp, Homo sapiens
gagagacggtggtggtggctgcacagccacgggaatgcgctgagtgccactgaaccgtgcgattaaagacagtcaaaactctaaattttatgttatgtgtgttttaccacaataaaaaagcaagcacacgaaaacgcgccactctcttgcgtcatgggccacgtggagttaggttggaggcgtgtggcagtcatggaaggctttccccacaagatgcctggaggaagctccgaggccctggggacagttcggtgtcattgtgagtcccccccctcctgtagcgccggctgcccagcctcgcgatgatggccaacagggccccacatttccgcggcacccccagggcagcacacacccctcgcccctgtggaaagccatggccaggggcactgacgggggctgtggccagtgggaggggcgtcctcctggccaggggtggagggcggcactggtcagcgtggcgcagggtgtcaaagaaatttgcctttaaatagtttcaaccttagatcaaagaaacaagaacagtagactacgtagagcttttgtaagtttggaattctattgagacgaaaagttccaaagaagactagtacaaagagttcccatgtgtcattcacctagactggccgattattaacatcttgcctcatttattctgtctgtataaattattattattatcattattgagacacggttttgctctcgttgcccaggctggagtgcaatggcgcaatctcggctcattgcaacctccgcctcccgggttcaagcgattctcctaccttaggctcccactgtataaattattattattactgtcgttattattgatgaacaattgagaaagtctgcagccgtgatacccctctaccctcaaacacgctagggtatatagtctaaggacaaggattttctccagcatagctatggtatgattaacaaagtcaggaaatgtaccgttacaatcctgcgatcacattttcagtgcgtattcaaatgtgaccagttttcccaacggtgtcagagca

SEQ ID NO: 22904 - DNA, 1079 bp, Homo sapiens
tggttcatctggagtattttccaatttcccttgccgttttctttttgtttgtttatttatttgttttctgggacatactctccctgttactaggttggagtgcggtggtgcgatctcggctcatggccacctccacctcccaggttcaagtgattatcctgcctcagcctcctaagtagctggagttacaggtgcccgccaccacccccgattaatttttgtattttgagtagagacgggggtttcaccgtgttggccaagctggtctcaaactcctgacctcgtgatctgcccccctgagcctcccgaggagctgagattacaggcgtgagccaccgtatccggccaaagtttctcctcggaactcttggttgttttggagggtgttgtttacacaccctttcaaagcagcaaacgttcccagctttctccccccccatgatccttcagccctaatttgagaaacaacagtaaaagcttctcttaatatttgggtaaacatgggatactattatattaaaatacagatatcgcaatattaagaccaattcgtggtagagaacttgatgtgcttctttattaacgcatcaaacagcgaaattcaggatcaggtggggccagtcttgcggtgaagtccgcagtgctcttaccgcgaggtggaggcggcgtgctgcctggttcctccttgctgcagggggcgccagactccgggaggactgaggatgagggtcgtgtattttcccctccaaggtcacaagccccctggattccctgggcagagagcccacactgtaacagggcgcttttgggatcggcccctacgaaagtgtcccaaacctggcggcttgcacagcagaaacgcactcttagcacgagcccagaagtctggaatcaagatgtctgcagacccgaagtctctccagaggctctagcaggggcccctcctgcctctcccagcgttccggggtggccagcagtcctggatgtcgctggactgcgagctcagcctcccgagcagctgggattacaggcgtgtgccaccacccccggataattgttttaatttttatttttagtag

SEQ ID NO: 22905 - DNA, 1025 bp, Homo sapiens
ggccctcctggtggccgccctctggggtcgcgcgtggcgggccctcctggtggccgccctctggggtcgtgcgtggcgggccctcctcgtggccgccctctggggttgcggagccgagagaagcgttgggacttccatgactgtggccgccagggcagagtgccagccctgagggcgtccacatctcaaccccaggacccgcggactcggctcctcacgaggtaacgtacccggtgccctaagacgaggttgcatggaggacaccgaggtagggaggttacctcggatcgtccttgatctccggactgagagaacaagtgttttaggccccgagtctgcgcgacaggctgggccgcctgctccgggtcacagtcccccggccgagccgttttcctgttggaagatggagttttgagtcaggaggcgttgagggagacaaggctcgggttctgtgtgtccgtggtggttcttgggagttggagttggagctggagaggagggctgggcaggtgaggcttgcagcggcgggacctggagactcggaactggagggcctttgtcagagatgctgccggggtgtgcgcctgcctgtgaggctgggacttccctcgcgtggagtggccagaggagcaggaccgattggttcgccccacccaggcatgagcctcgggggcgctgggcccagaggacaccggcaccctggtgggggctgtgaggccgcattgctcgaggtcagacagcagtaagaagtggccgcccctggtgtcttccctgccccaggagcctgctgcacgacaggacagggccctggtaaggcccgcacccctgcgtccccgggcccctcgcgcctgcagccgccctctccccatccgccctgccgctcaggagtgcttcgtaagcggaagcacagtttgcaacagtttggggttgtcttattttcactgctggcgatttcctggggagccgctggttctgtgcccccaggccgctcctctctgttggggggcccccacctcactgcctga

SEQ ID NO: 22906 - DNA, 1033 bp, Homo sapiens
gctaggattacaggtgtgagccactgtgcccagccctttttttctttgtttctttcttttttttgtttttgtttttgagatgctgcctcactctgttgctgcaatcttggctcactgcagcctccacctcccaggttcaagcgatcctggcacctcagcctccctagcagctgggaccacaggcgcctggcccatttattttaatagctttatctcagtattttcacacaccatataattcacctggtgaaacgtttgtagtatattcataaagttgtgcaaccaccaccacagtctaattccacagcattctcacagctgcaaaaagaacccacctcagccctgccagccgtcactccccgtcccctcccccaggccctggtgctcacacatcccctctctgtctctgtggctcggcctgtcctggacatttcatagacgtgggatcacacgctgcgtggtcttctgtgtctggcatctctcactggacgtgatgtcctcaagatgcaatcccccctcccccccgccgtggcctggtctgggccttgcccctttccatggttgagtcgtgctctgaggtgcgggtggacactggagctgtttgcatctgccgacgacgatgatgaactgtgctgccgtgaactctcacctgccagttctggccatgtgaacatttggtgggcaggtgtcttcgtttctctggggtctgcgcctggagtgaaagttctagctcgtgggtcatggggtagttccatctgggggacttctgggctcccagcaggcctgacggggtcttgcatctcgtcctggctggccctgggaagtggcatctcgctggggctggccggctgcgtttacccagcgtgtttttggaggcatgtcctgtacacgtcctttccccccccacttttctttttttttgagatggagtgtcactctgtcgcccgggctagagtgcagtggcgcgatctcggctcactgcaagctctgcctcccaggttcaagccgttctcctgcctcagcctcccgactt

SEQ ID NO: 22907 - DNA, 1023 bp, Homo sapiens
gcgtcgggagagcgctgcaccgggcagcgggcgggggagagggcgcctggcgagccccaggaacggtggggacagtgggctgaagtaccgtgaggggagacggcgatgaggtagggaagcactgagggacacgaaggcctgggcagcttcgggaggggaggagggcctcggccccgccccgcgcacgccccgcttctcgtctcttccgccgcctgctttggccccgcccccgccggaagccccgcccccgcttggagccccgcccaacggccgggcctagtttgtctctcagcggccaccgtcgcccgggccgctgcccgccgagtacgcagctttcgccgctcccgcgcccccgctccgccccgcgtgccgtgcgtgccgtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggtgaggcccgggccggggcggcgggcggcagggtctgcgccgcaggcctgaggcaaggccggggccggggtgggggtcgcttgcgcccgcctcttgcgcgagctgaccacgacgggaaaactgaggctcggggcagcgccggcccaggctgaatccgcggggagcccgggcggtgcgcgcgcgaaccccgtcctgtacatgcgggagactgaggcccgggcgggaggcagggcctggccggagcggcgcagcgggatcgcggccgggtgaccccacatccgcggcgttcccgacccgagaggccgcgaggatcccaggtgggatccctaagcccggtgagcctggttttgcaaacggagaaactgaggcccggcgagcagagagagggtattgcccggtggcgcggcgcggggcaggggctgggcctggcggggctcggaccccgagaataacgccaggggaccc

SEQ ID NO: 22908 - DNA, 1065 bp, Homo sapiens
gtggaggtaccaggtaccacagtgtctgtctgtgatggacgcgtggaggggcccactgtgtctgtccatgtgtccgtgatggacctgtggagggccccactgtgtctgtctgtgatggacgcgtggaggacccactgtgtctgtccgtgatggacgcatggagggccccactgtgtctgtccgtgatggaggcgtggaggaccaactgtgtctgtccgtgatggaggcgtggagggccccactgtgtctgtccgtgatggaggcgtggaggaccaactgtgtctgtctgtgatggaggcgtggagggccccactgtgtccgtctgtgatggaggcgtggagggccccactgtgtctgtctgtgatggaggcgtggagggccccactgtgtctgtctgtgtgtccgtgatggacgcttgtgctgcttccacccgtggccgtcgtgagttgtgccgccgtgagcacgggtgcaaacttcccagtggacacgttttcgtttctcttgggctcatacccaggagtaggtatgggttgacagcagctgtgaatcgctgttagcagcgtccatatgcaggtccatgtctgtgtgttccaggcatgactgggtctggctggggggtgttgggttcctgctcgaggataaggggcccttgctgctgcagcccaccctctgtgcccagagcctcccgtgggtcccctgctccaggcccagcccagcctcgcggccccacccccaggctctccggcacctgtttctgtgtggggtgagtgtcccccagggcagcccctggtgcctcttctggtctcctccccaccacaccccagcccgagcctccccccaccgcaccccagcccgagcctccccccagcctgagcctccccccactgcaccccagcccgagcctccccccaccgcaccccagcccgagcctccccccaccgcaccccagcccgagcctccccccaccgcaccccagcccgagcctccccccaccgcaccccagcccgagcctccccccagcctgagcctccccccactgcaccccagcccgagcctccccccact

SEQ ID NO: 22909 - DNA, 1059 bp, Homo sapiens
ctctgcctctttctgtgtgttccttctctctttcctttctttctttctttttttttttttttgagacagagttttgctcttgttgctcaggctggagtgcaatggcacgatcttggctcactgcaacctccgcttcccaggttcaagcgattttcctgcctcagcctcccgagcagctgagaccacaggcatgcaccaccatgcctggctaatttttttttttttttttttggtagagacagggtttctccatgttggtcaggctggtctcaaactcctgacctgtggtgatccgcccgcctcagcctcccaaagtgctgggattacaggcgtgagccaccgtgcccggcctgtctctttcttttctctgtctctctctctccctcttccccctgctcctagtctctctctctgtctccctccctctcaatctctctctgcctatctccctctctgtctctgcctccctctctgcctctgtcttcctctctgcctctgtctctctctctgcctctgtctctgtctccctctatgctccatctctctgtctccctctcagtctctgtctctgtctccctctttgtctctgtctccctctctgtctctgtctctctgtctctgtctccatctccgcctctgtctctctgtctccctctctgtctctgtctgtgtctccctctctgcttgtctctgcccctgtctctctgtctccctctctgtctctgtctctctgtctccctctctgtctctgtctctttgtctctgcctctgtctctctgtctccctctccacctgtctctttgtctccctctctgcctctgtgtctgtttccctctctgtctctgtcgccctctctgtcttcgtctgtttccctctctgcctctgtctctgtcgccctctctgtcttcgtctgtttccctctctgcctctgtctctatgtctctatgtctctgcgtctctgtctccctgtctctgtctctctccatgtctctgtctctgtctccgtctccatctctgtctcatgaattctcctgctcctcccctcctgaacaattgctg

SEQ ID NO: 22910 - DNA, 1013 bp, Homo sapiens
tctcacctcccccccccccatctccctccagcccgttcatgagctccgcctccttcctcggcagccagccctgcccagacaccagctatgcccccgtggccaccgcctccagcttgccaccaaagacctgcgactttgctcaggtaggagccccaggagctcaccgcgccgtggggggcagggtggagtctgggccgcccctccagctgccctgcgacctctctcgctcaggcctgcctgggactcagtgacctcggcttggcccctcggccgcagggtttacggtggggcagtaggagcccagagatgtggcttggttttggggaagagccagtgactggcccttcgtgtcagcagtgagccccgcccagcccttggggtccctgcgagcatctgggcaatgccacagagggagttgcggggagggcggtgctgggagagatgcccttggcagcctttgcccccacggccctccctctaggcgggtccagacaccctgcacattggagtcccaaccccttagcagccacctgaaaacggaactcacataccaaaggaacagaactttccacctccttctccccagggtcgcggggaggctcccagcctcccactgcggcatcaggcggaccccacccccaccctcccagcctcccccttcggcatcaggcggaccccacccccaccctcacagcctcccactgcggcatcaggcggaccccacccccaccctcacagccttccccaaggggttcccagtgccccagcttcctctcggcagctctggagcacccagtgccacagagatcggcttccctgggacggttcggataccacagcctccgtgtgggacccggggccaggggctgctgctgggccggaccacatccagggcctgccggggagcgagggtcacctggtgctcagctcccccaagcctccgcttcccctgtgtaatgggcatgtgagatctgcctgggcctcagagctgttggggggatgggcgcaagccg

SEQ ID NO: 22911 - DNA, 1050 bp, Homo sapiens
acctcatggcctggcgctgtgtactgcaggtctgggtcagccccagagaagccaccgtcccccccaccccctggagccgtgggtgtggtgcctcccggggcacaggggctctgcagaggggtcgtcctggattcctcgggtcccggcatcgtcacaaatgtcctcatgcgtgggacccttctccagctggaggaggggaggtcaggtcagaagcctaagagggaccttgccctgctggcttttaggagggagggatggcgtgatgggggacgtggctccccgaaagcagggaagtggggcctcagcccagtggccacagggagcagaatcccgcccccggccgagctcaggcgcggactctcccggagaacccagaccagggcccaggacagcagtgccttgaccttggccttggagccgtggccgtggagcagccagcccacctggacctctgacctgctgggcccagagagggcgcgtgggtgtcgttgtcagcagctacgtttgagggaaggtggatcaggccgcactggcgaacctggagttcctgcttctgtgatttcgggccctcagttccctcctccaggcgtggagcagcgcctaactgtgcggccattgtcaggacagggtgcgtagctccagcagtcagcgctgaagtctcgctctaagcggtcttggagctgccgtcctcaagcccagcccgaagccagaagggactcttcctcctcctccaggacctgatgccctcagggctcggatgcaggtccttgtgacatttttgtcaccaaggctggacttaagctcaaggacagtggtgaccggtcgagccacttgtctgggatcagcatagcccggctgctggcaacgcttggcactccccaaggagccaggtggggagaccttgtggcctgaggccgctgatgtgaggcagtgacagtagcaggtgtgggatgggccagactaccctccacatggattgaagacacacaagggcacctccatttcaaaggaccggaagtctggagtgagtggggatttagcttaacgtct

SEQ ID NO: 22912 - DNA, 1084 bp, Homo sapiens
aaccccgccccaggccctgaccctacctctgccttctccctgatccagccctgccagctccctaagccccgcctcctaagatatgaccccacccactgtctaaaccccgcctttagtccatcccaggctctgactcctcccacttcccatttgggctccacccagaacctagacctcgtccttctaggccccacccacctgctgatctggccctgcccacaggccatgccaccttccactgtcgcaccccaccgcccttgtgctcaggctctgagcctcctgactccacccaccaacacctccagcttctggccccgcctcctgaaccagaacccgcgccccccaacccaggaggcataagactcctcccattaccccagaccccgcccataatatctgcactctgatttgcccactggcgcagggccccgcctaccgccgcgccaccccgcccaccgccgcacctgtgcccgctgcaccatctcgtccgaggtgccgaagcgctcctccatcagcgagcggatgtgctgggcctcgaactcaagctgctgccggatcaggtccatctgcatcgagaactgctggcaaaggcaggcgggcgggccacggtgaggggcgcccgggccaggccccgttcctcccccacgccgcttcccgcaccctgagtggggcgggcgcgctgccccctggctccccggccggctcaccgtctccacgtgcggcagctcgtccaggcgcttggacaggccctgcagctgagagtagtaccagagcttctccttctcctccttctcaatctcattcagcaggaaacacctggggagcaagtcagcgggggcgggctcagagggcggcgccgtgtgtgtttattttgatatttgtaatcacttgttagcgcttactgtatgccaaggttaacaggcaacatggcaaggtctctcccgtggcactccccgagctagggtaagggggggggggtgggtattgaaattaactgggggatgcaaaaaaattaaaggagagaaaacagtctgggcaacatagcgagaccccctctctaaaaaggaaaaaataaaaataaaaa

SEQ ID NO: 22913 - DNA, 1022 bp, Homo sapiens
cctggtcacgggcgctgcgggccgacaggttccagagcgtgccgcacgcgttgctcacgatggtcaggctgtgcgaagtcagatgctgcagcagcgtctgcagacagttgtgatcccggagcacctgcctgtaggcacagggcgggttagcctgggccaccccccaccctcccctgcccaccgaaggatgggggggccagatgtggcaggtaaaagtaaacgcatctggttaggtttggatcttggaaagactaatttttggtataagtatatcccaaagattgcatgacagagactaaattattttatttttatttttttgagatggagttaaaaaaaaaaaaaaggtaggccgggtgcagtggatcacacctgtaatcccagtactttggtaggccaagtggggtggatcccctgaggtcaggagatcgagaccatcctggccaacatggtgaaaccctctctctcttaaaaatacaaaaattagctgggtgtggtggcgagcacctgtaatcccagccacccgggaggccgaggcacgagcactgcttgaacccgggaggtagaggctgcagtgagccgagatcgcgccactgcactccagcctggcaagagaccaagaatccatctcaaaaaaaaaaaaaaaaaaaggaaaaaacagcatgcacatatcctatgtggtatctggggtatacttagatagattctgtctatatctatcttttctgagagaaagtttcgctctgtcgtacagcctggagtgcagtggtgcaatcatggctcactgcagcctccaactcctgggctcaagcaatctaaccgcctcagcctcccaaagggctgggattacaggcgtgagccacgatgaccaggtaaaaataatattttgtgttttcataaataacatgtaaatatttttattttaatatttcttatttaacaacatttttattttaataatttttttttttctgagatggagtttcactcttgttacccaggctggagtgcagtggcatgat

SEQ ID NO: 22914 - DNA, 1071 bp, Homo sapiens
tgctgctgtgtcctgtctcagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggccca

SEQ ID NO: 22915 - DNA, 1069 bp, Homo sapiens
gcttgagcccaggagttcgagaccagcctggccaacatggtgaaaccccgtctctgctaaaaatgaaaaaacaaaacaaaaacaaaaacaaaaacaaaacagagttagctgggcatagtggcaggcgcctgtaatctcagctactcgggaggctgaggcaggagaatcgcttgaacccgggatgcagagtttgcagtgagccgagatcgcaccactgcactccagcccaggtgacagtgcgagactgtctcaaaaaaaaaaaaaaattactgggtgtggtggtggacacttgtagccccagcttcttggaggctaaagtgggaggatacagcctaggcaacacagccagactgtgtctcaaaaataaataagtggccggtgcggtggctcacgcctataatcccagcactttgggaggccgaggtgggtggatcacttgaggtcagaggttggacaccagcctggccaacatggtggaaccttgtctctactaaaaatacaaaaattagccgggtgtggtggcatgggcctgtaatcccagccactcaggagactgaggcaggagaatcacttgaacctgggagtcggaggttgcagtgagctgagatcacgcaactgcactccagcctggaccacagtgagactctgtttcaataattataataataattaataaatagaaataaataaagtaaaacagaggtggtaagctagggccccccaaaccctgcccctggctgtttttttaaggtctgggagctatgaatggacttcacatttttaaatgggggtgggtgaaaaagaacatttctgacacctgaaagaggtatgaaattcagatttcagtgttggtaagtaaaggtttacggcacacagccaaatgattcacatacggttagtggctgctctcacaccagaagggcagagttgagtagtgggagcagagactccagcctttggcaggaaagcttgtccactcctgatttacgaggtggaagctagtcagagaccaaaggattcagcagtgcagttgggtgaattttgtgttctggatgaggctcattcattc

SEQ ID NO: 22916 - DNA, 2035 bp, Homo sapiens
ctttcgactttccgagcccacctaacggtagtctttgcgtggatgttactggtggtggaaggctttcagagacccccccgtccccaaattggaacaaggcgctgctctgaaaggtcgcagggaaccccctccgtggaacaaagacttagtcgcctgctgcagccaagtcccagacagtcggccacctgctgtttgtcctcttttttttttttttcctggctcgggaaagatgcttttgattctgggccagctttgattgcgccctccccttggttcagtgtcccgtggcgccttcaggtcccccaggaggggaaagcggaggacgcctgccatgtgccgagcacctgggtaaaggggggtgtgcggctggtccccctttttcccacagctcggggtcgtgggcaggagaccgcccaggtgagggcgggtggtttccacgagccaaggaggggcagaacgaccgctccgtccactgtgcacttcggtcctctgtggttcttgactgtcccggtttggggagataaagtgagaaaagtgagcggggaaaggatggctgtgatcagaagcaatgtgtggggcctcgtcctgcaggaggagctcagggactggttcctggaaagttggaggacagcaagagaggggaaacttggtccccaaatgtgtacccttatgagctggaaccctgtacacgtcctgagatctgcagtgacacatgctgaaatctgggagggcagatgacggggcctgaatgagactggggtcagggagggcttctctgaggacgtgacattgagtgacagggagaggcgtccaggcagcaggaaccccctaagaggtggctgcagcttgggagctagaaccaaggccagcttgagcggagtatcctgaggctgtcatcaccccacctctctcattcccactctgggccctggccctgagcatgagggtctagcagtggagaaaagcagggagaagctcctctacaggctagagatttcaggtttctctgcagagggtgaagccaggcagcccagagccgccctctgcaggtctggggcctcaacccagcccttcatctgaggctgcaggctcccagactgcgttttctgttgggggtgcctggggagagttcaggccatgttgcccacttttttctatacgtgtggttttatcaaggctgttcttttttcattgaataaaatctcagggacatcattttgtgtcaatagatgggcataacctttatttaaaattgagatataattcacattccacaaaagctaccttttttgttttttttctttgagacagggtctcacccaggctggagtgcagtggtacaatcacggcttacgcattcttgacctcccaggctcaggcgaccctctcagctcagcctcccaagtagtgggaattacaggcacgtgccaccatacctggcttatttttatagagatggggttttgctgtgttgcctagactagactggtctcgaattcctggactcaagcagttaacccgcctcagcctcccaaagtgctgggattacaggcatgagccactgcctggccaaagccactttttagaaatgtacaattcagtggggtttttttttggagatggagtttcactcttggcccaggccacagtgcagtgacgcaatcccagcccactgcaacctccacctcccgggttcaagcgattcttctgcctcagcctcccgagtagctgggattacaggcgtctgccaccatgcccggctaatttttgtatttttagtagagaaggggtttcgccatgttggccagactggtctcgaactcctgaccccagcacctcagcctcccaaagtgctgggattacaggcctgagccaccacacccggcccccagtggtttttagtacattgacaaagttgtgcaaccatcaccgctatctaattccagaacattctcatcaccctgaaaagcagctctgtcctcattagcagtcactccccacttgttactcccccagcccctggtaaccactaacc

SEQ ID NO: 22917 - DNA, 1043 bp, Homo sapiens
cgtgagccaccatgcccggccctcatttccttcttagctggaggctgccgtcagttctctgccacatgggtcccttcatagggcatctcacagcatggcagctggcttctccagaggcagctagaggttgcacaaaggtgcccaggatggaagccagtctttttcttttttttgagacggagtctcactttgtcacccaggctagagagcaatggtgcaatcttggctcactgcaacctccacctcctgggttcaagccattctcccgcctcagcctcccaagtagctgggattacaggcacccaccaccatgcccggctaatttttgtatttttagtagagatggggtttcaccatgtttcccaggctggtcttgaactcctgacctcaggtgatctgcccgcctcagcctctcaaagtgctgggattacaggcgtgagccaccacgcccagcctctttttcttttttaattttttttgagatatggtctcatatttaccgaggctggaaggcagttggtgtagccacagcctctgcttcctgggctcaagagatcctcctgccccagctttcctagtagctgagactactggcatgtgccaccacacccggctaatttttcttaattttgtgtagagatggggtctcactctgttgtctaggctggtctcaaactcctaggctcaagtgagcctcctgcctcaacctcccaaagtgctgggattccccttgtgagcctccatgtctgaagccagtcttttgtcacttgacctcggcagtgatgccccattgctcatgctgcgttctactcattagaagcctgtgcccggccgggcgcggtggctcacgcctgtaatcccagcactttgggaggccgaggcgggcggatcacgaggtcaggagattgagaccatcctggctaacacggtgaaaccccatctctactaaaaatgcaaaaaattagccaggcgcagtgacgggcgcctgtagtcccagctactcgggaggctgaggcaggagaattgcttgaacccgggaggtg

SEQ ID NO: 22918 - DNA, 1045 bp, Homo sapiens
cactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccagg

SEQ ID NO: 22919 - DNA, 1031 bp, Homo sapiens
caccaggctgtctcggtcatcctgaacttggagcagcaagtgcgaggtcagtgggggcgcgggccaccagcgtccctgcagcgccaccctccctcgtgttcctgccctcgttctccttccccgcccgccttcctggagccagccctccctctgcagcagttgcctccttgcagtgactgtgcccttcacccctctgaccgcattgccatgactgtccactcctgactgccagcccttctccctgcctgcctcagcatcccctccacagtgggaggactggactctttctggacccctagtccttcaggcctgggctctgtggctcagaactgtatctcccagctccacggggctcccactcgccgtggtcctcctttcttgggaagcccagaacccagctcacagaggccagtgtcccccgatcccagagacaggagctggtgtgcaaaccaccctggccccttcccgtcaggcagatgccacgcaaggccacatgagcccatcccctgtctctgactcagtttccctatctgaaggtgatagggaaacttcctatcacccccatttcccagggccagggggaggaaggatacagacagaccctgtccccacccgcagatgtgagctgactccttccccccgctggcgctggcggctgcttccttaactccttcctttcctcgcctgcaccccgttaaccctttctctcctgcagcactgttgctgggaccggagccagagccccggcccggcccacacgctatcccctcagctctaaggtttccgagtctctgcagccgtgtgtggcacgcctcgcgccccccaagcccgcctctctgctgtctgccttccgccctcccctccatcccgcccgtccgtccctctgcttcccgtggcagcccctcctcacctcgcacttgctgcccgagcaccgggagcggctgggctgcaacctcagggcgtttcctcccccaaagccccccgtcagggcttgcgggaagaaaccagacccgggagcacgcagcccctgg

SEQ ID NO: 22920 - DNA, 1027 bp, Homo sapiens
gagggagaagagccaagttttgcttctaaaggctccatccggctgcctgaggatgtcagcagacttggaaggaagctgctgcagggactgggcttaacccgctgctgtagctatggggcaagctgctgttctttgggaggagggaaggtgaggaggactcccaggactttagcctgagcacctgagtgggggcacattgcagagctggggctataggatgaagtccccaggcccatctgaagccagaccacctggtggtgtgcctgagggtttggcaggggcggtacacagggctgtgttcagggcccgtgtccaccaatagttttgcctgcccggcatggtaaccccactcctggtactgaagtctgtcgattgggtttcttgtgcagaggcagctgaaggcacttggacagtctttttctgtatcaaggtcagccagccttctccggaaaggaccaaggagtgaatattgttggctgtgcaggacagatggtctctattggaattgattcaactctactgttgcagcaaaagcagccgttgatagtacatggacaaacgggcatagtgtgtgccaataaaactttatttaaaaagcagcttaggggccagacttggtccttgtgtactgtttgcagatccctgctgcagaccaatctcagtcctacccggtatttactaagcgccttttgaagcctccctctcccatttgccaacgagccaccaggcaaagaccagtccccggtccctctcaggaggggacccaacagggaccgggactgggaaaccaccagcctggagcattccttggctacggatggcctctctgaagcagcatctttcattgttatcctcacggcagcccaggcaggtgggcggcttccacaccccgtgactggaattggaactgaagcccaaggggtgggccgctcctggggccctctccccagcgcccctgcgccgtccactcgcaggcctctcccgaggcagccaggctggcccagggcaggaaggtgcccttcccggg

SEQ ID NO: 22921 - DNA, 1045 bp, Homo sapiens
ttgcggctctgccagtggttcttttctagttttgaataacacgtttaaggccgtgattgaatagcggttagtattctgcgttgtgaagaacacgtttaaacacgccgtttctcgcgctctcaacgtccgaagtgaaatcgcatctgcccccttctgtgagaaggtgaaaattgagcctgtatatttctcttccctgctggtatttgctaccaataaattgctacttttaaaaaacattgtccgaggccagcggatcatgaggtcaggagatcgagaccatcctggttaacacggtgaaatgccgtatctgttaaaaatacaaaaaaattagccgggcgcggtggtgggcgcctgtagtccagcctgggcgacagagccagactcagtctcaaacaaacaaacaaaaaaaacaaaaaaacattgtatctgttcataattgtgtatttgcatcttactaggaaacatttgtatcattaaatagtgactttgctacttactgtgagggcttgagcaaatggcatctatcttttgcgtcagtttccttatctgtagggtaggggtaatgtagccactgcaaggattcagtgaaatgagagagaactcacaaagtgcccccagagggctttccttgtgtgcctgtcttgttacggcttctaggaatctcttgattcgtaattaaatgtgctcactgtctacttcattccatagaacccccaggctctgccatttctttgaggatccatggggcttacaggcttaagacagtcttctcgttttttagggtaaatcattgaacttcttgaacttcatcctttttgttccatgttgggttccctcttgtgtctctttttctttttcttttttttttgaggtggagtctcgctctattgcccaggctggagtgcagtggcacgatctcggctcactgcaagctctgcctcccgggttcgcgccattctcctgcctcagcctcccgagtagctggtactacaggtgcccaccaccacgcccagctaatttttgtatttttagtagagacgggggt

SEQ ID NO: 22922 - DNA, 1051 bp, Homo sapiens
acagccccaggaaccggacatgctaatgcttccctgtgtgaggcagagggtcaggccctgggggcttcctggaggaggaagcgcaactcccaaggccgtccacccccattctcctgggcctctgggtgggcttacagcagggcctggtggggagggtggggtgggaggtgtcttccctcgtcccctgtcgcctctcaccccctcagccctggcacggaccactgtgagattggtccctgggtaaccagagctgtggtgtgtaggccgtgtggacctgagaatgctccctctgggttgcctctccctggacgcccagcccggtcccagcaggaacctgccaatgtttgcagatgtattttctgtggttcccacagagtctcgccctgtgctccggccctgccccaatgctgcaggttgggagggtctcgccttgtcccctcacacgttagggcggaggctttggagggcccagtgaggcccagtatgttgcattttttgcccttgagggacgtgatgtggctgctccagcctgggaccccccagctcctggacacagaggggtgaccccctccccgttcagtccatgcagttaacgcccgcctgagcccgggggtggtggaggatgcagagctccaaggcctgagttggtggcaccctcctcattgcctccactcccccaggcccctgcaggctgtggcgctggccccaggtgtggccctcccgaagctcccgcaagatgggcacctgctctcttccatcgtcaggttcagcgagtcgatgggtgcgaggggcggagggatcccggcagggcccaggagctgcagtagctcatttccccgcttcctgcttctcctctccgaggacccaggaagaggggagtttggggctcatcagcaggatggagccccggagctgtgggatcccttcccaaacctcggcttcttcctggaacagtgggtgcagcttccttccaggcggggcctagttggcttcggggacgccacccttcgccaggagtccccaacgctgatggctgatggggtaccccagc

SEQ ID NO: 22923 - DNA, 1031 bp, Homo sapiens
tgtccgggagccagggcctttccctcagacatcgacgccttgggcttggggtcagaacacgtggcagaggcctggaccaccccaccggtgacgtgtcctcagcggcctccgcagcctgacctgtgtcctctgcctcgatggacttgcctgaaggcagctagagcctgatgccattgcgcagccccagcccctcaccctggcccggccccctgcacgcggagatgcacgtgctgctggcgctgagcggccgcggctgcctggtgctccgccacgtggtgatgggcagccactcgccctgtgcccacaccccctgtgccccgccagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacaggtagcccctcccatctcggccaggaccaccacccccaagaccacgccctgaggcccggccacatgggacctgcggagggccagcctcgcccctgccctgcgggccttcgtgctccacaccgcagtacagccttcaccttccctccccatgccttggtgttttttttttttttttgagatggagtctcgctctgtcgcccaggctggagtgcagtggcacgatcttggctcactgcaagctctgcttcctgggttcacgccattctctggcctcagcctcctgagtagctgggactacaggcgcccgccaccacgcctggctgtttttgtatttttagtagaaacggggtttcaccatgttagccaggatggtctcgatcttctgacctcgtgatccacccgcctcggcctcccaaagtgctgggattacaggcgtgagccaccatgcccgaccgccctggcggtgtttttttgttttgtcttgttttgtttttttggttggttggtgttttttttttttgtttagagacagggtctctgttgc

SEQ ID NO: 22924 - DNA, 1034 bp, Homo sapiens
cttgaaagccatgcaagtttcgtcacaacgcacgttttccatgagctttttgaagacaccttatctttgacgctgcccgagttccagagggagctggccctgccccttcctgttagattgccacggtgctggggcgagggacagagcaggtcagcagccccagggtgacctcccccagagtgcggcagacggcctgctgcgccgtgtgcggcctgggcctgggccggttgtccagctctgagctccagtgtcctctgtagcccggagacagtagcgcttgtcaggcccctgtgcagacgtggcgaggtagtgcaggacaagcagagagcctggctccggggtcagcagccaggagagtcccagttgctccagtcccagagcctccccagaggaggggctttgaggaagattaggcgtagtgggattggattggagtgccagtgtaatcggggtagtcccgcccacccgtgccttatcagggctgaggacatagcctgggcaccgggagacactgggagtgggggagcctggagccacatggcattgaggaccactgccccctgctgcttccccccagtgtgcccagcagctcagaaggcagccagggaggtggtgcctccggcccccgagctccagccaccctctcccaagcctgcccggggtcgcctgctccaggtgcccccgctgtgctgccaggccttagcatttgtggtgacgcaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcaggtgagtcctggcccagggggcctgtgccggggggccgtgggcatgtgggcaggagaggtggcaccctgaggtctctgagctcacctgaaccacatggtgc

SEQ ID NO: 22925 - DNA, 1357 bp, Homo sapiens
ccgggcagaagaggaggatctcccacctttccaagcaaggccaggaggtaaggtccgcagaggccaggccagcaggagccttttttttttttttttttaaagacgaggttggcctggtttggtggctcacgcctgtaatcccagcactttgggaggccaaggcgggtggatcacctgaggccaggagttcgagaccagcctggccagcatggcaaaaccccatctgtactaaaaatacaaaaattagctgggcatggtgatgggtgcctgtaataccagctactagagaggctgaggcaggagaatcgcttgaactcaggaggcagaggttacagtgagccaagattgcaccactgcactccagcctgggtgatagagcaagactctgtctcaaaaaaaaaaaattataaaaaaagggggtcttgctttgtcacccaggctggtcttccaactcctgacctcaagtgatcctcctgcctcggcttcccagcgttgggattacaggcgtgagccactgctcccagcttcatccctctgttttctgtttgtttgttttttggttgtttttttttttttttttttttttgagacggagtctcgctctgttacccaggctggagtgcagtggcacgatctctgctcactgcaacttccgcctcccgggcttaagtgattttcctgcttcagcctcccgagtacctgggattacaggtgcccaccaccacaccaggctaatttttgtatctttagtagagacggggtttcaccatgttggccagactggtctcgtgatctgcctacctcggcctcccaaaatgctgggattacaagcatgaggcactgcgcccagaggtgggcagatcacgaggtcaggagttcgagaccagcctggccaacatggtgaaaccccgtctctactaaagatacaaaatattagctgggcgcggtggcacgcacctgtaatcccagctactcgggaggctgaggcaggagaattgcttgaacccgggaggtggaggattcaatgagccaagatcgtgccattgcgctccagcctgggcgacaaggcaagactctgtctcaaaaagataaatacataaaatgagttatccattcataaacttctgatttctttgggacattgttcctgtaaatctgtgacgctttttgtaaagcatcagtgatttccccattcgttcttccacccaagttttaccataaatttgatgcttaacatttgcttcaattttagcagaactcctgttgctctgactggggctctgttctaactgatgtcttacttttttttagtgcctcaaactccgtctggttcagacatgttatgacaagttagtat

SEQ ID NO: 22926 - DNA, 1031 bp, Homo sapiens
gggcagctgtcacttggagttgcagggagtggaggggtgacgtggggcgggcccgggtgtcactcagagttgcaggggggtggggcgagtgtttccaaacacaggattactgggctgggttttggaggatgaataggagtttgcctgtggctggaagtgggattagggctgtgggctctggggatggagacagctcgaggaaagcctgggatgttctcctgctctgggcttggggctgcttgggagcttgccgccgatggggctcactgttgatatgctgtctcatctgtccccagcctgggagcgctcctgcggttgggcagtctgcgattctcagctttctggagtctcttcctgttcccacagagactcatgtctggagagtcggtgtgctgcaggtgtggaggggcccgtgcctctgggtcagtgtttccttccccttcccactttccttccttcctcagatctctgcagacacctgccctgggccagctccgtcgacgctggggtgctcagaagagcctggcagggggcagggccaggaaggtggcagagagcgtgtgcttgggggtgtgggcctggcgtgcactccaggcgtatccccgccctgtggcttcccagcctgtccatttgtcctggcgacaggtccatccccaccctgttaacggtcacgggtcacagtccatttttctgagacccctccctcctcctctcacagtggctcagaggccctcagagaccaaaagggagccagcactgcctcaggagcaggccctagggagacaggatctggaagccatggaagtgggcctgcgcagtcctgagttggccaccgccccgtgcaccacggccgaggaggtggagtgaggtgagggctccaccatgccttccacctctgtatcccaggcactatgccaggcactgctgcttctgcagggaggacttcggagggctgcctggaggaagtggactttggggaagtggatgagacagagagggagggccctgccctttgtgccctgcaggctgcg

SEQ ID NO: 22927 - DNA, 1049 bp, Homo sapiens
ccaggattgagagtggacagaggttcaggtgaaaagccctcagctagccctggagcacctgtggggccatgctctgtgctggacacgcgctgcatggtgaccctgtgagctatttgctgccggtggggaaacggaggcttatcgaggaacgtgttttgcccatactaccacctggccagggcagggctggagcctccagggcctctgggagaaggagagggcatctgatgagggcaccaaggcaggcagggttgggaggcttggcggagctgcgacgggaacaggaaggtggctggtgctcctgggccctgggtcacaggctcagcgggtcattggcgaccttgagcagcactgctgaaggactcaggtttccttctgggctcttatccctggacctgctcagccattttatttaatgaattaatttttgagacagggtctcactttatcacccaggctggagtgcagtggtgcgatcacagcttactgcagcctcgacctcctggactcaagggatccacctggctcagcctcctgactagctgagaccacaggcatgtgacatcacacctcgctaatgtttaaaatttttgccgagacggggtctcactttgttgcccatgctggtcttgagctcctggactcaagcgatcctctctcctcagcctcctgaagtgctgggatgacaggcgtgaagcaccgcgctgggctgcacagccatttcagagccggctggacctgcccagggtggcttggagggatggtccagcagcccttacggcgggcaccgtgtagccctgggacgcagggatgtgcatccccggcctagaggggcacgttctatcccagccttgtgagttgggaatgagcgttactatccccccagtggccgctctctgctgcctgggccttggctgcagcctggtggtaggtgaggggcctcggttgtctatgtggagtgggcagggctagatcccaccttcctcccatctgacctcagaacccaggcctctgcccactgccccgcactccctgtggtgtctcaggga

SEQ ID NO: 22928 - DNA, 1618 bp, Homo sapiens
cgcccacactgccctcccgcgttgtccccacccaccgcatcctcagggcgctgcgtctcggccaggtagcgcggagcagctgggtggctgtgcacctgggggcccggctggctaggagcagcgcgctctgggcccccacaagttcaccccaccctcctccctgcgagtggattgtgtgcgaggcagggcctggcatttcgcagaggcgcttcgcccagcgcagcgtgggtgggtagcccgtgcaccccctgccccgccacccacgtgcgcatgtgcgcgcctcagtctccaagcgcggggcggggctggcaggcacccaggccggagaggcgaccctggcccgggccccctggccccggcgggagtgggaccacgtgagcggggccggctggggctgcggatgtccccgccgccgccgccgagctacgtgcggcagctgtgttcccagcggctgcgcgcccctgccccggtcgccccccccaccccggcaacctgctcctccttgcaaagtggaactgggggagagggagtggagaccagccccgccgccctgaaaggggaagtgaaccaactgactgtccggcacccagccgtgggatgttcccccttccctcctgccgcctccccgcctgtgccttgcaagatggcgacacggcggcatgttccctggaggggcgcgagccccaatcccgtggtctgctccagccgcgctcccacagccagaccccgtccccagactgaggcccttgggagctgtcagggcccagtggttgagatgggagtggggtcccttccagggctgctctgcgcctcttgcttgggttgtagacggcccccagctggggcggacccgcgaccccagctgcatcctgggttgcttgggggagacttggggtgtggagcaggcagccccagggatttgaggctactgttggtcttggtgacagctggtctctccccctctccagctgcctggattcacaacctcttggggaggggggctgctggtctctgtctgcagtcttgttttgctgagggtgtcggggtgtggcagggaggaaggatgagatgagaagggaaggttttttcttccagctcttcttgggtcacgggtgatcgctggtgcccctcagtgggcagacccctccaccctcccgtgcccctcctcagctgggctccccagggcagcccctgatcttagagcagagatgtcactcggtcaccctgagcatggccgtgcccctcccgccgtctctgtacccctcaccatggtccctgctgtgggtccttctaggcccctggctggctgcagttcttcatggaccggtgggagtgctcccagggccagagcaacctccagtgctgggcgtgggctgcccagtttgtaacccaccgggtgactaccctcctggccctgctgtggcttccttgagaataggctttggggccactcaggggagttggttctgacgtctcttttgctactcagggctccaaccagtgccacgaggggcatgcacatccggtctccatccacacaacccaccctggggtgtcacgggaataacgtcccggaatgccagggtccagggtacctggtgcagggcccgaaagggtg

SEQ ID NO: 22929 - DNA, 1037 bp, Homo sapiens
cctttagtgagtggcaggtcatggtcctgctctcatagagtttctggtttggaggtggggggagatctggccaaacgtgtgaaaaatacaagctgtggaaagagcgtgtaaggggtcctgtcccagctttgaggactctgagagcgttggcagtgaggtgcaaagggtggttgggttgggcaaggctgtctagtgaggttggggaagggagttcctggcagaggagcagaggcaggaaggggcaatttggcttgtcttgagggagccaggagtggcagggtgtgagatgagtgagtctggagaggtcggcctgagccggaatgcggacctggcaggctgtggggagggctttgatctctatccagggaataatgggaggcccccaggacaccccaagagggaagcggctccattgcatttgtgtcgtgaaagattgtttggctgctgggggagaatgtcctggagcaggtgatcagcaaggagggaggctgttgctgtggctctggtgaaaggtgatggaggcagggaccgggcggtggctgatgggagacaggcagagccaccgggctggtgatggaccggctcagatccagtgggtggaaggaggtgtcaaggataacatctttgtttctggcctggatagtggggccctggccacctcggtgtgccccttcgtctccggggtctccaggggcctgctgctgtccactgggctctcaggacccagctgcatgatgccacctaaactgcagggccctccaagtccccagcaccagcggggcagcaccggtagggcctggacctctttgagaatatgttgaaaagctgacatcaacctcgacgctgtggatgttgggcctgatcattctttggggtgggtctgtcctgggcactgcagggtgctaagcagcctccacccagtccccagtggtgacacccaaaactgtgtccagacattgacaggtgtctccaggagggagactcgcctccatctgagaagcagaaccagcctgacagtccacctcccggctgaaaag

SEQ ID NO: 22930 - DNA, 1030 bp, Homo sapiens
atcccacttcgcgagcgtctgtgaacccgccccaccagcgtctgtgcccctgctgagtgtctgtgacccccctatgctgtgtgtgctctcagccccctgggaggccatcgtgtgggcaggccctggggactgtacatggacagcacagagtggcgtcttgagcctgggagccgtggagttctccccaccccatacagacctggccaaacgcgggttcatagccggctcttggggaggcaccagcagcctttctctgctcaccgcaccctcctgcctgtggcgatatcgaagatctgagccactgagtgggccccataggcagcctgagcttcacacggggcagaacccccagcgtcctcacagccaccgctttcccagctggggccacccctgctgcctcctaacgctcctcccacgctcctgctgttcctgggcctccatgcccttccccatggacgtggcggctcagatgaccccacagggcttccctgggccttgcgttcctgatgggaccacgctcctctctcttctctcactcagtgggggctgttcggccatttggtcctcgtctgtctccctcagtgaggccaggccctgtgcctgtagctgactccctgggaaagcttgtgctgatgagggaatgcgtgagcaggagagtgatagagagtagacgagtgtgaatgaatgagtgaataatgagactaagtggatgagtgcatgtgggaatgaacgaatgtgtgtgtgtgtgaatgggtgagtgaatgagtgtgcgatgaatgagaaagtgaatgaatgcatgtgtcataaatgagcaagtgaatgcatgcccacgggaatgaatcagtggatcaatgaatgcatgtgtggatgaatgaatgagtgcatgtgtatgagttgagtgaatgtacatggaaattagttaatgaatgaatatgtgaatgaatgagtgaatgaacgcctgtgtgaatgaatgcatgtgaatgagcgagtgaatgcatgcatgaatgaacgtatgtgtgaatgcatgtgt

SEQ ID NO: 22931 - DNA, 1040 bp, Homo sapiens
tgatcagacggctgcctgcatccctgagagttgctgaatttagggagttgtggggcagaaagagcggtggcttcacccacagagtccagggttcgagacccggccgatccacccacagagtccagggttcgagccccagccgatccacccactagctctgtggcgtgagacactgctgtagaatcagtcataatcatctgagccacgatctcacccagggcgatctaatcttaacccaaagggacactgggtgatgtctgggcacatctgtggttgtcataacttgggggagctcctggcagggaggggcggcggccagggatgccgctcagcaccttgcagtgcccctgacggccccaccccagagaacgatccaaccccgatgtccacagagccaggggttagaggcctggttttctgggccctggttttctcatctgtaaagtggagacagggtttttgtcccaggcagatgaaaagttcaagttcctagttgggtgttaaccctggtggcaggaagtgacgatggtggctaagggccccaggatgggctggggaagttcaggcctttctggtcactgcagcgtgggtgggactcaagtcctcctgccacctgtgcccaggctgccctgagcagtgtcccccagccggtcctcaccaggggctcccttgtgacaaaccattgaccctggaccttcttatggtgcagactctgtcgtcactgcgttcacagtgggcaccgtgttgtgttgtgttgtgtttttgagacagagtcttgctctctcacccaggctggagtacagaggcccgaccttggctcactgcaacctctgcctcccaggttcaagcgattctcctgcctcagcctcccaagtagccggaatttcaggcatgcaccatcacgcctggctaatttttgtatttttagtagagacagggtttcatcatgttggtcaggctggtcttgaactcctgacctcgtgatccgcccgcctcagcctctcaaagtgctgggattacaggcgtgggccaccgcgcca

SEQ ID NO: 22932 - DNA, 1065 bp, Homo sapiens
tagctgggaatacaagcgcccgccaccacatccggctaattttttgtatttttagtagagacagggtttcaccatgttagccaggatggtctcaatcttctgacctcatgatctgtctgcctcggcctcccaaagtgctgggattacaggtgtgagccactgcgtccggcctgtcattgctgttcttttcattcctaatgttcagttttctcctgattcactgcctcccatgaaacactcactccccgttgcctccccagcccctggcaccatgtattctactttgtgtctttgtgaatctgatggctctagggacctcctaggagtggaaccacacggaatgtatccttctgtgtctggctgctgttattacacctcatgtccttaaggtgcatccacatcgcagcctctgtcaggattcccttccttttcacagcagaatcatattttgttgtacagatggaccatgctgtgtgtccactcatccatcgctgctcccaccttctggctgttgtgaattgtgctgctatcaacattgttgttaaacaaataactgttggagtccctgccttcagtacttttgtttttttttatttttttgttttggaaacagagtcttgttctgttacccaggctagagtacagtggagccaagggctcaccacaacctccgcctcccaggttcaagcagttcttctgcctcagcctcctgagtagctgggattacaggcacatgccacctcgccccactaatttttgtatttttagtagagatggggttttgccaggttggccagactgatgtggaactcctgaccccgggtgatctgcctgcctcggcctcccaaagtgctgggattgcaggagtgagcccatttgttctgaatatacacccgggagtgtgattgctgggtcctgtggtaatgccacgtttgaggttttgaggagctgccagactgtcttccccagtgctgcactttgtttcccgcctgctgccgtgcaggaggccctgtttcttcacctgtcgtcatcgtgctgacagcagccattctttttttttgagat

SEQ ID NO: 22933 - DNA, 1033 bp, Homo sapiens
ctgttagatgggagggctcccgctggggaatttgagcagtcgcagggcacagccgtgaggagctgggctgtaggctgtgttcccagcacaccctcgttccctgtgtgactttcctctccagccttcctcccactgtgggacccaggaccctggggcaggaaggccacaagggaagagggctctctctggagggcaggcctgagtcaggggcacagtgaggctggcttccatgccatccaagatgctggtctgtggcccctgggactggtgtgcagccacagcgtcgggctggagggcatctcctctctgtggaggaggcggctgggaggggcgagagcagggatgaggcgcagaaagcccgcgcaggctgaagcccgctgccccgcagatgtcacacaccaagccctacatcaggaagaaggctgtgctgatcatgtacaaggtgttcctgaagtaccccgagtcgctgcgccctgcctttccccggctgaaggagaagctggaggaccccgaccccggtttgtggatttgagttaagcctcagggttgagggtgggggctcagccggtgccctgggaagaggtggtggcgtgttttggggggtgctgcggggagtggtgaagggctcagtccaggaacatgcctgttggaggtggctgggcctccccttgctggggcagccaggagggaggtgctggtggtgggggcagtaagatccaatgtggcagctggcggtgagtctggcgtgtccctgagcagaggtgtacccacccccgccagcccctcttaggaccagtgccaccaggaggcaccttccacagggcaggggatggtctagaccatatgtcccgtgcaggagctgcctccacctagtgtagctgttgtgtatttgtggtgtggtgactgcgggacgcggctgcagattcagtttcactgagtttccctgggctggtgtgtgaagcctctggcgtgtggcaggcgtgggtcggtggaccccaaagccagcccacaggaatcccaaggccctgtgtgc

SEQ ID NO: 22934 - DNA, 1049 bp, Homo sapiens
ggcaacagagcgagactttgtctccaagaaaaaaaaaaaaacacatacatattccaaactgggaatttcctcatggaattttgaagaaatctgcgttggttttcaaatgcgggttggttcccacttgctggtggccccagcgtccaggctgcagggtgttgcttctgggctggcgctgcctggtgtggtcgctgcagagcagagctggagctcctggaggctgcgggtgtcctgcctctgatgtgctcatctgttctctcccagcgaattggctacctcgctgcttcccagagctttcacgaaggcaccgacgtcatcatgctgaccaccaatcagatccgtaaggtgggtgttcccgggccggggccgctctgtgctgagtgcagtctgcccttgccggagcgtctggttcccacacgcgtcttcctgtgggcagcaggtgcctgtggcccccttgagtgcgagcggggcttccggagccacagtcctcccagcagacgcagagaggaggcccggcgggtctgagcctgcgctccctggtgggcttgtgaggtggagggatgctgagtggtgcggtgcccccttccctcgctcaccacctggaggggccggcgaatggggctccagggtccactcgcagctggcctctgcggtcacccactttcttcccttctcccctcatggtagtgcctggtgtagctgtgggcccttccctgcccatgtggggtgcttcctgcccgcggctttttttgagtcccacgaggtgcatttttcagcaccatgtaaatgttgcattttgaaatggtcacggaggccactgggtagtagtaaaggtccttattggccccgagctctgaacacctttggttcccgcctctcaatagaggggttggggtgttggagaatcaggcccacccttttcatgggcagctggcccctttctggccccagaccgcacgtcagaggccacggtcccggctctccaatgtccatgtgcaagggcgggaccctgtggctgtgttgtcgaccccacagtgtgacctgaagtc

SEQ ID NO: 22935 - DNA, 1031 bp, Homo sapiens
tcagggtggccgcggccgctctgctcctgggtgcagagggcgttgagcctgtccacaacaagagaataaagcaggacggtgtcccgggctgttgaaagagcagagcgctccgcaggagaagctcctttcatgctgcttctggggttctggggtttggtggcttttctgtttgaattcgaagtgatggtgattgtggatagtaacttatcctgggcaggatggaccacttcgccggcgcgtcccctttcctgactcagttactgttgggacttggaattctttttttttttttttgagacggagtttcactcttgttgcccaggctgaagtgcaatggcgcgatctcggctcaccgcaacgtctgcctcccgggtgcaagcgattctcttgcctcagcctcccgagtagctgggattacaggtgcgagccaccaccccggctaattttgtatttttagcggagatggggtttctccacgttggtcagactggtctcgaactcccaacctcaggcgatgcacccgcctcggcctcccaaagtgctgggattacaggcgtgagccaccgcacctggccgaggcagcactttcatttatttccttttttattttttttttgaggcagtcttgctctgttgcccaggctggagtgcagtggtgcgatcgcggccccctacagcattgacttcctgggcttaatcaatcctcttacctcaaccttgcaagtagctgtgactacacgatgtgccaccacgcccagctaattttttattttttgatttttttgaaacagggcttcaaaaacctcctctctacacaaaaatacaaaaattaggcaggcttggcctggcacggtggctcacgcctgtaatcccagcactttgagaggccaaggtgggcggatcacaaggtcaggagatcgagaccatcctggctaacacggcgaaatcccgtctctactaaaaatacaaaaaattagccaggcatggtcgcgggcgcctgtagtcccagctacttgggaggctgaggcagg

SEQ ID NO: 22936 - DNA, 2042 bp, Homo sapiens
cagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcggtgagcgggacccgggagaccgagacagtgccaggggcgggaggccggggccggggtctgggcgggggtgccggaggccggagtccgggtcggggcgccggggacgggaggccggggtccgggcgggggctgcctgcgcccctgagtgcgcgctgtgcccgcagtgctgaagcggcggctggtgaagctggtggtgaatttcctcttctactttcggacagacgaggccgaggtaggggcgtcccgggcgcgcgggcgggtcccaggctgggcccctcggaggccgggtgctcactgccccgtcccggcgcccgtgtctcctccagcccgtcggagccctgctgctggagcgctgcagagtcgtccgggaagagcccggcaccttctccatcagtgagtggggctagggaagccagcggcgcttcccgcagcccggggcacccgcagcgccgcactttcccctccccgggcgcccaaggtctcctctgtgtccccagcctggcgccaccctcctcaaacacaagagtgcattgtccacgggcagctcaaggtcaagttctcctggcgggcaccacccttcccacctgccgagtccacttaagcttgggtccctcccagactctgctctttgttccctgtgggcccaggctgtacttacagggcaggtgggccagccccacccaaagcgtttccccagctgccaagagtagcatgggtctagcattgttatatggccccgggctggaaatcccaggtgggggtaggaggagtgagaggggggtgttctcctgggtcttaagagattcccttctgcggggaaagatggagtccctgctagtttgcccagagtggctgtcaaaattccacaggccaggtggcttaaatatcagaaacattctctacagttctggaggccagaaatcctagatgaaggtgtgggtggggccgaatccttctgaggccgaggggaatctcccagttcctagtggtggccagtatcctccaggttccttggcttgtggaagcgtcaccttgtcctccttgcatcacgtctgtgcccacatttccccttctacacagacgccaagcagaatttagggcccaccctgacaacccctttttacttcactttattattttatttgcttattttttgagacagggtcttggtatgtcgcccaggctggagtgcagtggtgcaatctcggctccctgtaacttccccctctcgggttcaagtgattctcctgcctcagcctcccgagtagctggtactacaggcacgcgccaccatgcccagctaatttttgtatttttagtagagacggggtttcgccatattggccaggctgctctcgaactcctgacctcaggtgatcctcccacctcggcctcccaaagtgctgggattacggtcttgagccaccgtacccggccctctttatttttgagacaggatcttttgtttccgaggctggagtgcagtggcgtgatcacagctcactgcagcctcaacccccttggctcaagcagtcctcccacttctgactccggagtggctgggcctacaaggccccaccaccacacctggctaatttttgtttttgtagagatggggattttgccatgtcacccaggctggtctcgaactcctgagctcaagcaatcctcccaccttggcctctcaaagcgctgggattataggcatgagccaccgcacctggcgacaacctcattttgactagtttatatgcaaagaccctgtttatatacagggccatactcatgggttctggggggtcaggacatgaacacatctttgtgggggccagagaagggacagtttatgggcaatggcaagaggaagctgcttgtggctgtgggtag

SEQ ID NO: 22937 - DNA, 1334 bp, Homo sapiens
tccctctcaaaaaaaaaaataaataaataacaacaataacagccatgaatagtcccaccatctagaagtagcccctgaccactagctgccaagcttatttcttttcttgaggcagagtctcgctcttgttgcccaggccagagtgcagtgggatgatctcggctcactgcaacctccacctcctgggttcaagtgattctcctgcctcagcctcccgagtagctggaactacaggcataagccacaacgcccggctaatttttgtatttttagtagagatgggggcttcaccacgtcggccaggctggtctccaactcctgacctcagatgatccacccgccttggcctcctaaagtgctgggattacagatgtgagccacctggcctggcctcaacattcttttcaagataaaaagctaactattgtgaatcgcccatttatatagagaataaatagtataataatagatactataaatacctattattctatttttattgtcagatataaagaacaaatataatgaatatataggaagaaaagactatgcaagacaccgatctcacaacactcctagaagacaggcattgctatgcttcccactttacatatggggatcagagtcccagagaggttaaggcacttgcctggggtcacacagtagttgaagcaggatttgaactcagaagtctgattgaagaacttgggctgggtaggttcccattgcaggttatttaccaccttccttttaactactgtgtgtgaatgggcatttacactgtcattgatattttgtattgattagtaataatggcatctaactttgagagttactattgaaatctgatgccatttttttttttttttttttgaggtggagtctcactctgttgcccgggctggagtgcagtgacatgatctcggctcactgtgacctccgcctcctgggctcaagcaattctcctgcctcagcctccggagtagctagaattaccagcacccgccaccatgcctggctaaattcttgtagttttttagtagagacagggtttcgccatgttggccaggccagtcttgaactgcctacctcaggtgatctgcctgcctcggcctcccaaaatgcatgccactgcacccgcccttcgttttttgagatagggtcttgctgtgtcgcccaggatggagtgcagctgtgtgatcacagtttactgcagcctagacacctggcctcaagagatcctcccagttcagctgcccaaggagctgggaccacaggcacctgccactctgcctgacaaattttttttttaaatttttgtagagacggggtct

SEQ ID NO: 22938 - DNA, 1047 bp, Homo sapiens
gtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcaggtgcggggctggccggggacgggcgctgggggcgacagggccacccctgggggccgacgtcgcggctaaagcctcgcgtgtctccacagaggatgacggacaagtgtttccggaagtgtatagggaaacctgggggctccctggacaactccgagcaggtgagacccgcggaggttcggggcaagggtcgcgagggcctagattcgaggggggaggtgtctgcgcgtgcgcagactaacggggaggtgcgacggagtggtcactgcacgtgcgtagtctgcagcccgggcgtcctggagccggggtcagggcggtccccggggccgcgaagtcccgagctgagccgtgcgcccctccgctcccgcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcc

SEQ ID NO: 22939 - DNA, 1051 bp, Homo sapiens
ccaagcgctggtgcctgtcacttgctggactcctgacagtgcagggcagatgatgagggcacgtgtgcctttgcctgggcgcgtggggccgcgtcgtctgcaggacgggaaggtctggggctcggaggcctcggtgaccttgtctttgggcttgcctgacgccccctgaggtgctccctgtggccccatggaccttgcccctccccactcacttgccctcttgactttcagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggtaggtgccaggagccacgggacgccccagcagggtatatgcaacagacagattgtcacaccagctcgctgtcctgtgtctcccaggccgaggacggtcatgcagtggccaaaaagcagctggagaaggagacgctgatgcgtgtggacctggagaaccgctgccagagcctgcaggaggagctggacttccggaagagtgtgttcgaggaggtgagtgagtggcctggcctccagcctggcacagcggaaacgcaaagtccaccctcatggctgtggagggcggaagcctgagggcaccgtgtggccggggtccctcccacggctctagggaggctccttcctgcctcttagggtgcccttggcttcggctgcgtctccccagtgtctgcctctgtcttcccgcggctgcctcccctgtgtccatactctgtgtatcctacaaggacacttgtcattggatttggggcctgcctggatcatccagagtgacctaatggcatctgcagagaccccatttccaaataaggtccattcacagctgctggggatcgggatgtgggcacgtctttttttgagatggagtttcactctgtcacccatgctggagtgcggtggcacgatcttggctcactgcaacctccgcctcccaggttcaagcaat

SEQ ID NO: 22940 - DNA, 1080 bp, Homo sapiens
ttctggttctgaaaccgagagtgtgaaaaatgcatctaatggccaggcatcgtgtcgctatgacagcggccaaggggctgcatgtccaggtgtggctggtcctccggggaaggggacaggctccatccagctgctgtgctggtccaggcccagggcctttggtctccagcactgggcgccgctgttctgggagctggagctcgtggagagacgatcattccagagggggccgcagcagaggaggaggctcctgggatggctgggacccagggtcgcctggcttcctcctggttaccggaccctccccgacagggggctccctttgctgtgtctgtgagatgggcaacacagggtgtcccagtgtccccaggctgccatcctctctctctgcgtgccagtccctgggaatctgagcagggccagtggccgggccccctgactgctgtagtccaaggggaagggtccctctcgcttcaccctgtcctgggtctccccaggtgagtggcatcaaggcgctgtacgagtcggagctggccgatgcccggagagtcctggatgagacggctcgagagcgtgcccggctgcagatagagattgggaagctgagggcagagttggacgaggtcaacaagaggtgagtggtcacggctgggcacgacgtcaccctgatcctggcaccacggggtggacgggggcaggtgggcgctgggctcgtgcggggcatgctctgatacgggcacagcctggagctcacagctcccatcctctctcccccaccagtggctgccacgtcactttttctgttctgaggaaagtgatagatgctcacatcggacagcaggaagcgcagggcagcttaagctcacaagtaaaatctcccgcgagcctccccagagagggcttcctggtcagcctggcctgtctccttagtgtgcacacgcgcttgcacatgcttacctagaccccgggcggcacccagtggacaccgtgagacgcgtttgacctcaggccccatcgtaggcatttccctgtggttggatgttcttggtgccggggttttgtcccagctgttgggacgct

SEQ ID NO: 22941 - DNA, 1042 bp, Homo sapiens
tctacaatgaacaaactattaattcaagtcaggtgtcgtttagtgacagggataccttgtggaaagcgtgtcgttaggagacgtgccccttgtgtgggcatggtagagtgcactcccacactcccggatggtggaagccaccacacacccaggcttgggcgtggcctcctaggccacagacccacaccgcccgctcctctgtggaatgctgtgggcaccggttacacaatggtaagtatgtgagcatttaaacacgagaaagggctgggtgcggtggctcccgcctataatcccagtactttgggaggctggggcaggcagattgcttgagtccaggagtttgagaccagcctgggcaacatagcaagaccccatctcttaaaaaaaaagttagaaactaattaggcaggcatagtagtatgtgtgcctatagtcccagctattggggcagctgagacaggaggattgcttgagcccagagtttgaggctgcagtgagctgtgattgcggcattgctctccaggctgggtgtggctctgtctcaaaataagtaaataaacacaagaaaggtgcagtaagaatatggtattagattctttttctttttattttttgaagtggagtctggctgtcgccaggctggagtgcaatggcccaatcttggctcacagcaacccctgcctcctgggttcaagcaattttcctgcctcagcctcctgagtagctggtattacaggtgcacgccaccatgcccggctaatttttttgtatttttagtagagacagggtttcaccgtgttaacaaggatggtcttgatctcctaacctcgtaatccgcccacctcagcctcccaaagtgctgggatgacaggggtgagcccccatgccaggtttgcattagagtcttacaggaccgccgtgcacatggtctgggggtgctcagcatgcctctgtgcgtgtggctgccattgcagagttgctgttttttctcaccttgaacgggctcctgtgtgtcccggcgctgatcttgtctttgttggaa

SEQ ID NO: 22942 - DNA, 1095 bp, Homo sapiens
gggtgtagacctggcgttgaaggccactcctagctctgagagctgggaccccttgagagaagtagttaccaggctggggcttggcagaatcagggttggaggtgatgatcttggaggcgctgcctgctgcccaggaccctccgagactggacaccttatctgattcttctccctgtgttgtggatggggaaactgaaaccgtatgcatttattaccccatcccaggatttggttcctccacccataataggtgactgagttcaaagagccaagtgtgacctgtgtacagtgggtgtgacccacctgcccactgtgtggcaaccatgtcatccctggaagtttgcattccgtggcttttcctctgttacttttttgactccgtgcccaagcccagcagcttctgaatccaaagccttgctatgccacaatacctactatatttcagaaaattctggaagtttccagaagcttctggaagattccagaacattctacaagtcacctttcacttcttgtatatctcgctccccccaggttttacttcctcaatgtagcatgtgccctgagatggaagtgaccacagtcacacccactctcttgtttcttgctgtgacagtgttggcgtcggccaccgccacctcctcttccactcagggccacagtggaaggtctggatgcctggtgttctgttttcctaaggctgctgaaccctaactaacatccacacagaggccactggtggtcagcacaggtggcagggttagaaaggttgggactggctttgtcctttgagtcagagggacagtcacactcatgtttgtgtgaccatatgcatgtggctatggtcagtcctatagattatggcagcggttatcactctctgtcactgtggaccttggggccagatcgttctctgaggtggggccatcctgggcactgtagggtgctgagcagcgtccctggcctccacccactctatgccagggacaccccgagttgtgacaaccaaagatgtccccagacattgcccagtgccccatggggggcagaatcacccccaggtgagacccccgggggttaggggattccacagat

SEQ ID NO: 22943 - DNA, 1047 bp, Homo sapiens
aacctctgactccctggttcaagcaattctcctgcctcagccttctgagtagctgggactacagaagcctaccaccacgcccggctaatttttgtatttctagtagagacaggtttcactgtgttggccaggatggtcttggtctcctgatcttgcgatccgcctgcgtcggcctcccaaagtgctgggattataagcatgagccaccgcgcccgggcttatatttttaaagcgtaagctttgtggcatgtaaattatatctcaataaaactgtttagggaaacacacgctgatacccatcttccccccacgccctcctgaattgggatctcgggggcgggagtgggtttctgtcttcagggctctcagttctaggatagcagctggggtttttaccgtcctaccagctgggacccatgcctcagatagaagccccattgcctatgaaatgagaaggtatcacatgagtattccaaaatacaggcctccacttgggctctttccaaaagcaatagcgaaagggacagtttccgtccccgggccggtgagctgtattaactgttctgctcccggggtcgccatccaggcagtgacagccaccgtcgccaggcacaggccaggccaggccctgccgcccccacctccatcccccttagtggatgtagatatgattgtttgcgactagcgaaccccctatagatgcagatgcctcctgagccggcatctgtgttgagtcctggctgcccagaagagccaagtgtgacgccccctcgggtctgtgtggacaccaggccggtgttttcctctctccctgacaccccctccggtctgtgtggacaccgggccggtgttttcctctctccctgtaggaaacgagcagatgaaagtggaaaactttgaagctgccgtgcatttctacggaaaagccatcgagctcaacccagccaacgccgtctatttctgcaacaggtaccagctcagggcctgcccagggcaggggcggccgggtgcgggggcgtcctccgggatgcttagcagggacctgag

SEQ ID NO: 22944 - DNA, 1071 bp, Homo sapiens
cgcagggcgccaagcgctgggctgacagcttccgggttattttttccccgacccctgacagcagccacaatggagctccccattttacagacatggaggcggaggctcaggccgaacaacccgtccgagctcacaggctttgcaggccacgatccgggaaccgcctggcctctccctcacaacccggctggcttaaaacaaccaagattgatttccctcgcagttctggaggccagaagtctgagatgaaggtgcaggctgggccacgttccctctgaaggccccaagggaggctccgtcctgcctcttccagctgctgggggccagcgagcctcacctctcttcgtgtggccacatggcctcagcctctgcctccgtcttcacgcggccgtctccgtgcggccatgttcaatccctgcattagggccaccacagcgacctcatctccacttgtttccatctgcaaagacacagacaaggtcccgtgctcaggtcccaggtggacgtgactagcccagaacttggctgctccagcggcgggggcgggggcggctgcttctccacgcagcttgttacatctgaatgtttagagtcaccatcgccagccttcgggggaaatggaggcacagtgaggccaagccttcctgagctggcgcctcaaggcagccggccagcctgccccgggggaagctcacgtcggggcttcctgctcagagccgtgaaggtcactgtggccgaggcccctccaagttggcccaggcacccaggaaacctgtgtgaaaggtcttgtactaaaaaaagacctgtccatagactacagctccagattccagaacagcctctcctgatgtcaccatctggcaccctttagagctttggcaggaaactgcagggaccacagacatgagcagaagcagctgtcaagtcctgggaatgaggaacaagacagggtatccgaggggggaccaggcggatgtccgagggggaaccaggagggtttctgagagggaaccaggagggtgtccgagggggcatccaggagggtatccgggggggaaccaggcgggtgtc

SEQ ID NO: 22945 - DNA, 1058 bp, Homo sapiens
agctcaagcgattgtccctcctcaccctcctaagtagccgggactacaggtgtgtaccaccatggctggttaatttattgtattttattttttttgtagagacgggatctcactatgcagcccaggctggtcgccaactcctggccctaagcaatcctcgcacctgagcctctcaaagtactgggattgcaggcatgagccaccagccttagcttaatgatgttttcagatttttcagtgtttccccaccctcatacctgccgtttctcagtaattctttgtaagtctctggcagaggccgtcattgcgctttgctccctgttgggaaggtactcacggcattgagtgtactgcactttttcatactgttggtcacctctcacaaggacataagctctgtgtggctcagttccccaggctgtcagcctcacccctcttcctgcgcacatgggggaggcggtgcctttgctgaagtgggatgtgtggaatgttttaggactgcgtgatctttgaggaagtggctgtgaacttcaccccagaagagtgggcattgctggatcatgctcagaggagcctctacagagatgtgatgctggagacctgcaggaaccttgcctccttgggtaagggtggtgtcattccctcactgcctccttgggtaagggtggcgtcattccctcactgcctccttgggtaagggtggcgtcattccctcactgcctccttgggtaagggtggcgtcattccctcactgcctccttgggtaagggtggcgtcattccctcactgcctccttgggtaagggtggcgtcattccctcactgcctccttgggtaaggatggcgtcattccctcactgcctccttgggtaagggtggcatcattccctcactgcgtcctggagagcaaagagaccttggttttctttttttttttttttatttttttgagacggagtcttgctctctcgcccaagctggagtgcagtggcacgatctcggctcactgcaagctccgcctcccgggttcatgccattctcctgcctcagcctcctgaa

SEQ ID NO: 22946 - DNA, 1013 bp, Homo sapiens
ggctgaggggggagaatcgcttgagcccacgagtttgaggctgtaccactccactccagcctgggcaacagagctagaccctgtctggaaaaaaaaaaaaaaaaaaaaagagccgggcgcggtggctcacacctgtaatcctagcactttgagtggctgaggtgggcggatcacaaggtcaggaattcaagaccaccctgattgacatggggaaaccccgtctctactaaaaatatcaaaattagccaggtgtgatggcaagtgcctgcaatcccagctacttgggagtctgaggcaggagaatcgcttgaaccggggaggcggaggttgcagcgagctgagattgtttcactgcactccagcctgggagacggagcaagaccctgtctcaaaaaaaaaaaaaagaataaatgctttttgccttttttttcttgtccttagtgagggcagtcattgtcttggatgtgttctttgccttctgccactgcctggtgttataccatggcttagcccgagaaggctgctgtggaaaactctcaaactcggaagacgttgcatcttccattaggatgaggggaaaggcgcacacacagccccatgccatattgtgaggtgggcgaaggtgtggattgaaaacattcatgaaactagcactgacttaggcagggtgcagagtttgtgacagtgggggaccctgctccgtctcctgttagtatctgcgcatcagacagatgcgcattctgtaatatacgacccacagtacagagaagcggcaattccgattaggggactgacgaacaatttatcatgaggataatcattaactgatacctgttttctgcatgagaccctaatcattaactgatacctgttttctgcatgggaccctttgtgggacagaaaaacttctagatcttctagaatccaccactcacccctttgtcctttaacacgggctgaaagtggtgatttggctgtgttcttacttatttttattttttttttgagacagt

SEQ ID NO: 22947 - DNA, 1086 bp, Homo sapiens
gctaatttttgcatttttagtagagatgggttttcgccatgttggccaggctggtcatgaacttctgacctcagatgatccgcccgcctcggcctcccacagtgttgggattacaggcctgagccacagagcccggccaaggcctggtctttcatagtcttgctctgtgaccttgaggggacactgcctcagcttccatcatctgcttaaggggagtgattgtccttgcctggctgttcccttctctgtccctcctccctcctctctccctcctccctgtgctgttgtgcgctcagagcagataatggatgtgcagccctagggttctgtgtaattctgattaatattaatgattcgacatgcagttgtctgctgtgttcccagtcctgggccagctgcctttctctaggggggtgctgaagagggagaatgttggactccacccccgcaacccctgatggtgctgggcaccccccaatatccaaaggggctcgtaggctgacatggtggctcacacctgtagtcccagcactttgggaggccgaggcgggcagatcacttgaggttggcagtttgagaccagcctggccaatacggtgaaacgccgtctttactaaaaatacaaaaattacccgggcgtactagcaggtacctgtaatcccagctactttggaggctgaggcaggagaatcccttgaacctgggaggcagaggctgcagtgagctgagactgcaacattgcactccagcctgggtgacacagtgagactctgtctcaaaaaaaaaaaaagattatccagcgtgatggtgcatgcctgtagtctcagcttctggtgctgaggcaggaggatctcttgagccctggaggtcaaggctgcagtgagccatgattgtgccactgcactccagcctgggtgacggagtgagaccctgtctcaacacaaaacaaagaggggctcgtgaccccatctcttccctctttacccccagattttctccctgggccactgccctaaccaggactggctggcggtcggaatggagagtagcaacgtggagatcctgcacgtccgcaagccggagaaa

SEQ ID NO: 22948 - DNA, 1031 bp, Homo sapiens
ggatcaggaggaatcactgcctctcctctcccccgacccccttccagcaccagcagcaggtcttgggagccattgagagggccaagcaggtcaccgctcccgagctgaactctatcatccgagtatgtatggggacctgggcgggtgggcgggggacaggtgggccccaggcagctaatgttcccctcccccgccctgcagcagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggt

SEQ ID NO: 22949 - DNA, 1055 bp, Homo sapiens
gaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagcatccgcctgtttgcctttctgtgggttccggaggtctggttgggagtctgaggagtgactttgttctgtgttttttgttttctgtttttgtttgtttgtttgttttctttttaagagatggagtctcgctctccacccaggctggagtgcagtggcgcaatctcagctcactgcaagctccgtctcctgggttcacaccattctcctgcctcagcctcctgagtagctgggactacaggcgcccgccaccacgcccagctaattttttatttttagtagaggcagggtttcaccatgttagccaggatggtctcgatctcctgacctcgtgatccgcccacctcggcctcccaaagtgctgggattacaggtgtgagccaccgcacccagcctgtgttttgtt

SEQ ID NO: 22950 - DNA, 1062 bp, Homo sapiens
gcgctgaggcctcggctcccctgggagcctgggagaccacacggtttagtcaaaatccagatccccaagctctcaaggaggtccccctgggacgccacatgggccccacgtagctgtgagatcctcagggcctgctgttgtcattatgaccaataagcaaggggcccagagagcctaagagacctgcccagcaccgcacagccagaacggggcgcagacccaaagcaggagtgtcccctcgagacaaagcctccgccgaggccgccgtgactccccgcccatcagcaaacctctccgagcacctctgtgtgccaggcactgtggagtgaccccaagaggtggagaccacttccccggctgctctaggcagctccgtcccacggagccagcgggaagccagccaccgcgaagccgtgccccggagatcgtccaggagctgcccagaggggcctgctgggaggaggagcactggagagacccagcggccctgctggccaccccaccataggcagggagcagttcgcagaggccgcctacggaggggggtgcttggactttgaaaaacacctgacttgaaggggcagacgtggggagggtggtctcggcagcaggcacagcagaagcggaagtgtgggggccagaagggaggcagggcagccattgaaagcaccccaaggcctgagtgctgaagaggctgtgcccttggttctggtcttcctggggtcacccggttctgggtcccagctgctactgccccccacttcccctgtctgcccagctgctggctgagggtgtccctctctgtccccccaactcctgcaggacaaggaagccacctgtcctgccctttcttttttttcattttttgagacggagtcttgctctgtcgcccaggctggagtgcaatggcatgatctcagctcactgcaacctccaccccccaggtacaagcaattatcctgcctcagcctcctgagtagctgagattacaggcgcctgccaccatgcctggctaattttgagttttttgtttgtttgttttttgagacagagtctcgttct

SEQ ID NO: 22951 - DNA, 1024 bp, Homo sapiens
tatctctgcaggcggcgcacacagtcgtctggacaggatggcaggtgagacccaacccccttccttccctgggtctcaccagctcctcctgcacagctcccagctccgtttcccgccccccagcccctctgctctctgcccattctctcctggggacagatttaagattgtagcactcggccctagcaccgcacacaatcttccagccactttgtttttcttacagccagagccagggcagctctggtctgtggatccttccttatttcttcttctattaagttttttttttaacttaaaacaagatacaagagggaatatcgtgaaatgcgccccctcctgcccacggcctgtcccctccccaggagcaaccactgggactgtgggttttgtctcttggaagatactttctgggaacacagcagacgtgcaccaggcttgtggttcccttttattttgacacaaatgggcacacccgtgcacgccgcccacaccttgctgttgtcactcgactgacggggatctcaggggtgggtgcgcgccgttcctgtcacgcctgcgtgccgtccttccatcccatggactgcacctggctttaagtgcccagccctcggggacatttgcgaggtccctggggtctcactcttgtgaacactggggcagtggcgcggtgttgcttttcttaaccgtgttttaatcgctgccgcctggtgaaagaaaccccttggtgccctgggtgggatgtgaccctccctgcagtctagcgtgccatttggagagacatgttacatggccaggcccggcggccgggacactgagtcacttgtgtcagggcctcggctgccaggtgcaggcactgcctggagggtgggcagggtctgtggcacccacaccggtcggggctgccatttgctcatatgcccccagagcccgctacaccccaggccctgctggcaccacagtcaccaagggacccaggtggacagtccccgggctgggagtgacagccagaaagaacagaccc

SEQ ID NO: 22952 - DNA, 1054 bp, Homo sapiens
cctcctgccaccgtggacaggcagcagtgatttgtgtctcggagggacactccggctgcttggggtgtcccctgctccgggtgacctgaggacagcggcccagggcttggcggggtcccctggcctcccagggagggcgccagccccaggagagacccgccttcgctctgcgctgctgcgcctgtgtctgggaggctggagggcgtcctgccgtggcggggaaggcggaggagccgcgtgggctctgtgtttcctgtggatatttgtggctcgtggctgtgggcagaaaaaggcaggcagatggctgggctgggcgacagcagtggcctggacagatctccctccagcctcagagtccaccccacacggctctctcaccctgcaccatcactcccagccaggccatggcagaagcagcgcatgcaggaggaaggaccctcgctgttctgagctgccaaggttggcagggctgttgctgactccgcaaaatccagcctgtgttgaccgacgtgtgataactgatggcgccgttccctggcccgagagcacctcgggcagtgcagggcgggggtggtgacttgagcccaaggagggactggggcattcccaggccctgggcctgatgtgacctcatgtttccggcgtcctctggtccccaaacatattcacagatcagagtgtgtgtggcgctggggacccaactcacgcctcaagcccctggctcttccagcattttccaaaggtggttcccctcacttgttggggtgtttttttaaacactcttgctctgttgcccaggttggagggcagtggcgctgtcacagctcacagcagccttgacctcctgggctcaagtgatcctcccacctcagcctcccaagtagctgggaccacagatgggcatcaccatgcctgtttttgttttctttcttttttttttttagtacagatgaggcctcgctctgttgcccaggctggtcttgaactcctgggctcaaatgatcctcctcagcctcccaaggtgttgggattacagagtgctgggtgagccgcc

SEQ ID NO: 22953 - DNA, 1051 bp, Homo sapiens
ggccccactgtttgctgtccttgccgggcggccgggcagcatgttctgtggctcagcctggctgcaacgcctgcccggctctgagtccctgaaacctcgggcagagcctgggctctcggccctggtgagggagaggggttatggaccccaccaccacctcgggcagtggatgggacactctgaggctggcctggctcacaccgtgttggtaggaagcctgacccccactctgttcccacccccacctagggcctgttttttcaaaagtaaccgttttactgagatgtgattcatatactgtacaattcagcctttaaagtgtgcagtaaatgacttttagtacatatgcagagttgtgcagccgtcacctctaattccagaacattgcatcagctcaaatagcaactctgtccctgttagcagtcacccccatcccgactcccagccctggcacccacatccctttcctgcgtctgtggatcagcctgtcctggacgtgtcatagaagtggaatcacacactgtgtggctttctgtgtctggcgtctctcactgagtgtagcgtcctcagggttcattcgcactggggcccgtgtcagagccttgctcctgttcatggctgagtcgtgttctggtgcgtggggcgcccgtgctgcacttgtcctttgctgcgtcatggacgctcgggtgcttcacactcctggccattgtgaattgtgctgctgaggacacgtgtgtgtgagtctgtgtggatacatgtgttcgtttgtctcgggcagacacccaggagtggaattgccaagtcacgtgtaactcggtgtcatcttttgagaaactcgcaaactgttctccatagcagcggtaccgttttcacacccagcaacagtgaatgaggcccagcgtccccgtgtcctcaccagcactcgtgattgttgtctctgattctggcgtcctcatgggtgtgaggtggtgtctcttcgaggtgtctttttgtttgttttggtagagacaggggtttcaccatgttgcccaggctggtcttgaactcccag

SEQ ID NO: 22954 - DNA, 1035 bp, Homo sapiens
actgtggtataccagcccctgctttagacagtctttgtaggaccttatgagttccatataatcagcgagactcctgtctttttacctgtgccgaagttgtctaggagaaagttctagaattgaagttgctgccaagggcacacacattagaaatgctgccaggctgccccctaggggagaatctattgacacgggcatcacccccagccgtgtgaggaccccctgagtccccaacccattgctggcaggctggtttcatatcatgtcttttatcattagaggggtctgggcgtctttttcagatgttcacactgtttgttttcttttcctctgcctgttttacaagttgagtgagttaatgctttgagaaaagcctcatttctataaataaaaatgacaaaatatgtatttcagacggcaccaaaggatggaagttgcaaattaagagaccctcccccatcccacacccagaaataacttggaaccttctaagattcacgtgtctggccctgactgctgagtgacgtgtctacagtggtggaagccatgtggcactaagagcttgagttctcctggtgggtcacagggaaccagatcctggtgctcagagggagagagccgcccggggctttgctgcctgggccctacgtgccgggtgaccttcagcaggtggtggtcccgctctgggtgcgtctgtggtgggattcgtggattatgcaacaaaccactgccacactgagaggcttcacgctgcagtgcttttgctgtcagtttcccagtattggctgggcttggctgggctcagcaggtcggttctgctgcggcatctggcttgtgccagcacaccctggtggcctcctgtcccaggcctctctccgcattgctgccaccctccagcctggccccagcatcgtactggagggattccaagagagcagaggctgatggaagaattccccccatgtcacttctgcatcatgtgattggccaaagcagggcttgagacccgcccactttcaaggggaaggaattcgg

SEQ ID NO: 22955 - DNA, 1021 bp, Homo sapiens
tttgccctctcgtccaggctggagtgcagtggcgcgatctcagctcaccgaaacctctgtcttccggtttcaagcaattctgctgcctcagcctcccaagtagctgggattacaggcgcccgccaccacacccggctaatttttgtatttttagtagagacagggtttcaccatgttggccaggtgggtctcgaactcctgaccttgtgatccagccacctcagcctcccaaagtgctggggttacaggcatgagccactgcgccaggcctgtttgtggtagttcctttgtgaagctgctgcagacacttcaggcgcacactgagccctggctccaggggaaacccaaggtcgggttcctgtgagcctctgggcatgatgtttccatcagccagtcgatacgtgaccttgttgtatgttcgtttttatttcaaggcgtgttattttagggctgggtgcggtggctcacacctgtaatcccagcactttgggaggctgaggtgggagaataactggattactgagcccaggagtttgaggctgcagtgagccgtgattgcaccactgcactccagcctgggcgacagagtgagatcctaagaaaattttaaagacacccgtgttgttgatttatccacagggagctcacagaccataggccgcgtgcgccaagccccccccaccccccagccccatcccgggcactctcccaggcccccgcccatttgcaggctgtgttggggacaaggctggaagggggaccgggggcatgtattcggctgtgtgggggctcaaaaacggggtggggggccatggcgacgtgggtgtgggtccccctcccccggcccaccagctcggtgtgtctctcgctctcgttctccccccactctcctctctctctctctctttccgctctcagtcctgtttgagcaaagcttctctcactacgggtttctccatggggctcatccgggtctctagccctgagggacacgaaaccacctgaggacaatgcctggggg

SEQ ID NO: 22956 - DNA, 1016 bp, Homo sapiens
ctctatgcttctgtaacccagaaaggtggtacgtgtattcagatgcactctgattggtttaaatcaggcctggtgaggccaagagagcaggaggtgactgctattgaaaagctcttgtgttacagttcccgaggctttggttggaagggacgggccaggcggggtagatgggctgggtgtgcctaggatgggctggtttgactcccgactgtttgcggctcttggctgttggggtggtccctgttctgggagctggccctggggtgattcagggcagggaacctgggcgtggcgcgtgagagtttgatcaggtgcgtgggctcgcggttggttgctctgcacgtcacagtgtgctcgcaggcgggccgtttgcaacgtttaggaatccgcttaccctggaaggggccgtcatccccagattagcgaggcccccaagatgtcgtaaaatccagaaaacaaaacgcagcatcagcactgtaccagaccgggcgctccgtgttccggcagcggaggacgcgtccatctctcccatcctcagcagccatatgggtgcaaggcgacttcttccctcactgcgtcattgcagcgtatattcgtcttcttgtgactcagagaaaaagtccttgtggctcttcgcagcatttcctctttgttttcttggaactgcgtttccacaaggggagcagagaccactagaggcgaagggactcgccacacaggagctccctcccactcctcccgacggtcacctgtgtttctatcaagagctggaaaatggagtgtccccaccagggagacggggtcaccaccgaggctggctctgagctgcctcagctcctgcaagctccgtggccccgacctccaccctccccggcccattttccttgcacagttccttcttgtaagcacacacgtcaggttgaactctgacctcattttctgggacctgtatgattgtgtctttcccagtctacagttatctgtcaccattttgttgattcgtaggagctctttat

SEQ ID NO: 22957 - DNA, 1004 bp, Homo sapiens
gctgcatccctgcccctgccccacttccacggctgatctggcagcaaatgatggcagcttcaccttcagaactggcccagaacccactgactccttccctgtcctctgcctctcccgggtccagcttggtcctcccgggtccagcttggtcctccctggtccagctcggtcctccccggtccagctcggtcctcctcggtccagctcggtcctcctccgtacagctcggtcctcctccgtctggctgagtactccccggtccagctcagtcctcctccgtctggctcagtcctcctctgtctggctcggtcctccccggtccagctcggtcctcctccgtccggcccagtcctcctccatccggctcggtcctctatccggcttggtcctcctccatctggctcggtcctcccgggtccagctcggtcctccccggtccagcttagtcctcctccatccggctcagtcctccccagtccagcttggtcctcctctgtccggctcggttctccttcgtccggctcagtcctccttcgtctggctcggtcctccttggtcctcctcggtccagctcggtcctccttggtccagctcggtcctccccggtccagctcagtcctcctttgtccagctcggtcctcctcggtccagctcgatcctcctccgtccagctcagtcctcctcggtccagctcagtcctcctttgccccctgagccaggcctggcgcccctgctcttcctctgctccctgtcccacattccaggaggaccccattaaaaaccagcggcccgagtcccgaccctcctctgctcgcagccctccatggctcccacctcccttggggtcaaagacatagtcctctttgaagcccatcaggccctgcacagcctgccccgggccctccctgccctccctgccctcccctccgcactctgccctccctgccctcccgtctgcactctgctgtaggcccatgggccccttgctgttcctccagcatgca

SEQ ID NO: 22958 - DNA, 1679 bp, Homo sapiens
ttgtgggttgcagggttccagaaggctgagctgcactggaataaagcttgcgggttttctctgtccctcaggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcaggtgggcacggagtgcacctgctgggagcagacaccctgaggggggacggcttgtgtcctgagttgtggctgtgtgggttgctgtggttggtggattggggtgactggtcatgaaaggaggggttcttggctgtggctgtaaatggagactcctgcccaggcagccaccaccctctcctaggctgctctgcgcgtgttcactgtagcttgtgggacttaacatttcttcaggagtttgtgctggtcccagtttcccagcaccttccctgaaatcttgttctggcggggtccctagctaaagggaagctgggagcctggtcccgcctgttccgagccgcctacccctttggtgctgacccgcatccctttcagtgcatcatcgaggagtcgggagagcatatcatcgcgggcgccggcgagctgcacctggagatctgcctgaaggacctggaggaggaccacgcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggct

SEQ ID NO: 22959 - DNA, 1070 bp, Homo sapiens
ggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtaggtgtttgatgcgatcatgaatttcaagaaagaggagacagcaaaactgatagagaaactggacatcaaactggacagcgaggacaaggacaaagaaggcaaacccctgctgaaggtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcaggctgtgatgcgccgctggctgcctgccggagacgccttgttgcagatgatcaccatccacctgccctcccctgtgacggcccagaagtaccgctgcgagctcctgtacgaggggcccccgga

SEQ ID NO: 22960 - DNA, 3168 bp, Homo sapiens
cgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccaggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaacgtgagctccctgtgccctctgtacccaggcagggaggtgctggcctggcagctggaggccactgggccagggtgcgcggggagagacttggcaacgtctctttcccctggtttcttaattcatgggagaatgagtgaggttcagtccagcgagacaggatggagaggcacagggattcggggtactgcgagctggaaggttttcttgaggagggggcttaactccgtggttctccctccctgggggacttgcccccactcctacaatatctggagaggtttggctgtcacacctgggaggggagggtgttctagtgcttgggacgctgggaagctcctgtgttgcactggatgatgttcattccatgtcagtttctggccccgatatgagtagggggagcgcagagtacggtgaccccaactgctttttgtcctgggttggtacattggtgagggactctggctaaggctcttcatttcccctggagcaggggcagaagtgaggaggggagggtcggagtctctggaggcttttgccgtcctgctgggtcttttagttgctactttgagtcaggtgtgatgaatcttgggaccaagtcggtggggcaggatgtctggtcaggagggctctgaggatctggctatggggctggtaccaggagttccctgtcatgggggtggcatgtctcggacagaggcaaaggacaagggtgggttggctcttgtgggagcctctccagggatgagtcatggagggaggagcagcctggcttctgacagcatcccagactccctgggccaggtgtgtggctcctgtccccctgacgagtccctccctccatcagtgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggtaagcagtgggtccccctgaggcacggcctggaaccgggggccatccttgcttgaggatgacagcgccgccctgtcccccgtgtccccaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatggtacggccctccctagctgggtggtgggcttgccgcagcgggatctgcaggagccggtggggagtggagttgagctgagggggactggaagtgtgtttttgccaggaatgttgggtgacagagaagggggctggaatgttttcatccgacttgacccagcccttgatctttgggcagctggaagagacgagctcagggaacgctgccctgggtggtggaggggctggcccccctattcgtgatgactgatcatttcttcactttgaccagatgtctactgaagaaagcctgcgtctgaggcccatgcccaaggcgcccagcccgtagcttcaggctctgcgcaggggccctcacggctgcttctcgtttctcacacttccagatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtgagccccgcgggatatggtgggggattcctgacacctgggggtagtggcagcgacgtaggggcgtggtgtgctattcacagcgtggctcaagcccaccaggtcttgcccaagcatgtccccttggcgaccaccctccccaagtcatcccctggagaccctaacttgatttggcttggcctctccttgccaggtactttgacccagccaacggcaagttcagcaagtcagccaccagc

SEQ ID NO: 22961 - DNA, 1109 bp, Homo sapiens
acaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgccccccgacgccccccgccttttgagattaaggaaaaaaaaaaaaagtcaaaaaagtttttaaaaatgaaaaaaaaaaattataaaccagtgaatgtaaaatgccggagcaggcccggcctggcatgggtgtgg

SEQ ID NO: 22962 - DNA, 1038 bp, Homo sapiens
atcaggctggtctcgaactcctggcctcaagtgatccgcccgcctcggcctcccaaagtgctgggatttcaggcctgagcctccgcgcctggcctagactttgtctcttaaaaagttaaaaaaggaaaggaaacggggttcagagaggcatagcgttttcccaaggccacacagcactcagggtccgaggccctctttagatgttcagaatgcgaaatcgcccccactcgtctcgtttttcgagggaccgtccccatcggggcaccgaaacctctggtgcacggtccgtgttctgcaagggtgatgatccagggcctgccgtgtccgtgagggtccctgggcggggatcgggggtccccggccccactgaccgtgcccgccccgtgccccgtccacaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatat

SEQ ID NO: 22963 - DNA, 1041 bp, Homo sapiens
gaggccatgaaaggcccagctcaggccctctccccaggggccttgcccaggggctctggcccgagagccaccggccggcctggaggaatgtgagctgtgctgggtgactcggggccgccaggggctcccaggagagggcggaggggtggggacaggggccagagggttgcacaagctccgagtgggtggatgagtcacagccgaggggaaggcggaaaaaagggagggggagaaaggggtgggacagacacagtccccccagggcccggcgctgcccgaaacctctgcccatttgacagatagggagactgaggcccagagagggccaaggccttggctggggctgaacagctcagctggggtggctgagagttggggaggggctgccaggcagtcctgtgggcaggcaggaggtggacaggggttcccccggctccctgctcctcctgggctgtagcccggtctctgttactcacagccagggctgagccctatgctgggggctctgaggggcaggaaggggtttagcctgcggagtcactggccctgtccggacggggcacacccacggtggccttgacctcagctgggtttcggcactgggtccccgtgcctgggctgccacaccccttcctgctgactcagagcccccctgaaaagaaccaggcctgaccaggaggcaggagtcagggttggggaggccaaggggtcggctcttaggtccactctgggtttgagtttggacgcaactgtgtcctcatggtggggcctcgggcaagtggcctcagctcacgacggagtgggtgctgccggtggggttcgggtggaactggcgggaagtaggtgttatgtgttgttgttattgtttttttttttttttttggagacgagtctcgctctgtcaccagactggagtgctgtggcgtgatctaggtggctcactgcagcctccacctcctggttcaagtgattctcctgcctcagcctcccgagtagctgggactataggcccgcgccaccaggcccagctaattttttgtt

SEQ ID NO: 22964 - DNA, 1049 bp, Homo sapiens
ccaagctgtcggtttggttggaaaccccagcaggtcccgagacacgccctgcactccccctgcgtccgcagcaggcccagcccagggcgggtggttctgtcacctctcctcgcccaacaaatcagaagtgaccaccagggcatgtgacactttcgggcctttgaactgttccgccgcagtgggctgcagatgaaacggtgagggcttgtcctggggtcttcggggttcccggaggcccatcgcctgcttctccggttgtccgagatccaaagcccagcctttctaccttcgggactgtgtgctcggatagaggaggccacctctgggctaggtgtggtgggcagctgggctgttctagggtccctctgagctctctaaagctcttgaggctgtgagcctcccccttcagtacttcctggagactaccagcaagctgatattatctgcgggcgaattgtaggggaagggtggctggcaactgtgtttctggaggaaacaaagcagaaggtgggggcttgtggttctgtgggaactgctggattgtccttttcttcttagggtgacccttctagtcttgtgtggctttttttttttttttttttctgcagacaccaaagaagagatgagttgacacctcctgcaaacagctccccaggctgctctcctttatgttttgccctaaagtctcacatgacttaaaaaaaaaaaaaaaaaagccaggcttggtggcttacacctgtaatctaaacacttcgggagtccgaggcaagaagatcacttgagcccaggagttcaagaccagcccgagcaacatagtaaaaccctatctctacaaaaaaaaaaaaaaaaaaaaaaaaaaattggccgggcatggtagtgcacaactgtagtcccagctactcaggaggctgaggcaggagaatcacctgagcctggggaggtggaggttgcagtgagccaagatctcaccatcacactccagcctgggcgacggagtgtggccccaaaaaataaaaaataggagaaaaaaaaaagtgttgaaggtgccg

SEQ ID NO: 22965 - DNA, 1028 bp, Homo sapiens
aaggtagattgataaaaactgagaatagaagcagcttccacctggccctggctcactggagctcccgtcctggcacctcctcctgggctgtctgagccctggccatacctgccctctcaccctgtgtgtctgcgtcttcagcctggagctggtggatggagtcacgtgtatgctttagaggtctcaaagcgtgttgggttttctagaactgccttcggcctttctctccaagcctagctgggcagaagtggccagagagcggcaacccgggcacccctgagtcccaggatttctcccccggctcctcccacccatgtgaatgaaagccatcccagggaaggctgggcttttgcaggagtcctggagcagcatggtggggaaatccaggctccccagccagcctctccaggctcctccagcccgccctctctagcctcagttccactttcctctctgctgagcacagaagagacgcacgccagacggtggcagtgggaacttggcctgtcacccctgctgtcctgggggtggcctggcaggtgtgtccggagcctctgcctctgaagaggcaccttgggtggctcccagtgcctggggttttggcatttgggggttttggtccccaggtttgttgccaggcagccttgggcaagacatggaatttctgtttcatcatttatgacatggatgtggggccacacccggggaccagcctacccatgatgactcgtttccaggccctccgcaggatgcccggcacagtggcgaggagaccacaggctgtggggaggggccgaggttaccgtcacctgggctggcgtcactgggatccctcctgcagtccatgcaccccctggcccctggtcctactcggcctggcctttctgccctaggtggcagggacaggcgcagggcagacgcccagcagtggagccgcagggcttggcgagggagccccctgggggtctggacgggcacacagcgacccgccgcctcctcccacgcggggcagcacccgcgtctcctcc

SEQ ID NO: 22966 - DNA, 1081 bp, Homo sapiens
tttccttctttttttgtggggggtagggggtacaaggtctctctctgtcacccaggttggagtgcagtggcatgatcctagctcactgcagcctccacctcttgggctcaaacgatcctcctgcctcaaccttccaggtagccgggactacaggtgcaccagcacgcttgagtagctttttaagtttgtttttttttttttttttttttttgagacggagtctagctctgtcgcccaggctggagtgcagtggcacaatcttggctcactgcaagctccacctcccaggttcacgccattctcccgcctcagcctcccgagtagctgggactacaggcgcccgccaccacagccggctaattttttgtatttttagtagagacggggtttcgctgtgttagccaggatggtctcgatctcctgacctcgtgatccgcctgcctctgcctcccaaaagtgctgggattacaggcgtgagccaccgcgcccggcaagtttttttgtagatatgggatggcactatgtttcccaggctaatcttgaactcctgggctcaaacgattctcccgcctcagcctcccaaagtgctgggattacaggggtgagccaccgtgcccagtgatgtatttatataaaatggcaagcacttgttggtgactggaacttaggaacagtggggctggctgcttccctggggtctgaacctattactggataactcggggcaagaacccagtggacagtggggcctcatgggatggggaaaggagagccagtggcttacggacctcgtagaggtgccccttggcctttctgggggtctcgtcctatctgctgaagaatgcccgtcttgttctactgtaatggaaactggacatgtccatcagtaagggagtgattaaagaatgatatttggctgctttgcagtggcaaagtgaaatccacaatggtgtactgaatgggagtatccccacagtacaacactattcatgtagtggaggggtggttgtagaaaataaacatagcatgggctgggtgcagtggctcacgtttgtaatcctagcactttgggaggccaagg

SEQ ID NO: 22967 - DNA, 1083 bp, Homo sapiens
cagtgagccaagatcacaccactgtactccagcctgggcgacagaatgagactttgtctcagaaaataataataataataaaaattaattaattaaaaagagccagacatgatggctcacacctgtgatcctagctactaggaaggctgaggtgggaggatcacttgaggacaggagttggaggctgcagtgagctgtaatcgtgccgctgcaccccagcttgggaggtagagcaggaccctgtctctaaataaatgaagtgagttcacctgttctttttaaacatgggtactagaagattttaatttgtgcgcatggtttacattccattgcttgtgcacagcaatgggttcctgtgtgcattgcgcttagttgtctgttactccaggatctggttctgagtcaaggcatttgtgaaaatagcttactgtcgaaatttcctctgaagattccttgaatcacccaataaagtgcaatgtacttgcttgtttaaattgttagaaattttttattgtgtagaaacaaggtcttgctctgtcacccaggctggagtacattgtcacgatcatggctcactgcagtctcgacctcctgggctcagcctcctgagtaactagaactacaggcatgagccactgtgctcggctataggtctcactttgttgcccaggctggtcatgcttattttttgttttttttgttttttggtttgttttgttttgagacagagcctccctctgctgcccaggctggagtgcagtggcaagatctcagttcactgcaatctccccctcccgggttcaagcagttctcgtgtctcagcctcccaagtagctgggactgcaaacgtgcaccaccgtgcctacctgatgcagcttttgtgctgagccttctgccctctactcttggttctcattctgtgctctgaggctgctcagaacgcttgttcctctatctcctgcaaagacagacatcttggcccgggctccgttcacccgatcccagcttcctcgtctcctcccgacatggtccggagctcgtgcgttaggaaggaggtctcccggccgcgtgcaatggctcacg

SEQ ID NO: 22968 - DNA, 1053 bp, Homo sapiens
atcggaatgaggggtgtccccaaggagagaacaggatgaggctccccaagcagtgagatcggggtgaggggtatctctaagaggagagaacacagtgtggggtccttgagtagtgaaatgagggtgaagagttcctaagaggaaaggacggagtaaaggttgccgtagtcatgagatgagggtgaggggagaccctgagtagggaaatcggggtgcagggcattcctgagaggagaggatggggtgtggggaggtcaggcagcccctgaggaggaaatctgggcaagggggctccagaggggagaggatggggtgaggggtccctgagtaatgagactgagatggggtagggtccctggtaggaaaagacggggtaagggtccctcaataatgagatagggccaagggaggtccctgtgggaaaagacagggcatggagtcactgagtagcagaatggtggtaggtctctgagtagtgaaatggggtgaacggtccctgaatagtgaaatcggggagatggtggggtccctgagtaatgagattggagtgaggggagatccctttgggaaaagatggggtttggaatccctaagtcgtgagatcaggccaaggagatgtccttgcagagagaagatggggtgcagggcccctgaattgtgagatggggttgagggggtccctgggaggagaggatgtgtcggtgggggcctgtgggggaaggataggcaaggggtgttctgcatattgaaatgatagtgaagcgagtcccttgggggagagatggggtgagggggtccctatgggggaaagatggggtgggagggttcctatgggggagagatggggtgagggggtccctatgggggagagatggggtgggagggtccctatgggggagagatggggtgagggggtccctatgggggagagatggggtgagggggtccctgtgggggagagatggggtgggagggtccctatgggggagagatggggtgggagggtccctatgggggagagatggggtgggagggtccctatgggggagagat

SEQ ID NO: 22969 - DNA, 1035 bp, Homo sapiens
gtcccgctctgtcatccaggctggagtacagtggggcaatctcggctcactgcaacctccgcctcccgggttcaggcaattattctgcctcagccatccaagtagctgcaactgcaggcgcccgccaccacacctggctaatatttgtatttttagtagagacggggtttcaccatattggccaggctggtgtcgaactcctgaccttgtgatctgcccgcctcagcctcccaaagtgctgggatgacaggcgtgagccaccacgcccggcccagtataacgattaaagtcaggaaaagtaaagtggacatcgccttctctaatcccgaatccagactcggcctgtcgcccccatgctccaattgttcctgtttctcctggtccgggatcccatgctgggtcttgtctctcgagccccttcgtctgtctgggacagtttcctgctttgttttctgtgctccgggcaccgagcagcatcccagcccgttattcatggaaggctactcgttccgtgtcgctgggtgctagttctggtcacctgtccaccccccacctccctgggagaacgtcaccctagaaacagtgcgagagtcacccatgggagctcacctggtcccatcctcccccttcctccctgacacaggcagtacgtccgagacacagtcgtgggcaccatgggcctgaaggccacgggccggctctgcaccgtggctaaggcaagggggctgcgagcctgcaggtgagccacccccacccatgccctgggctccaggggaggctgcgaggcccctgaggactctcctcagcttcctcattgcaggggagagctgagggacaccatcctagactgggaggactccctgcccgaccgggacctggcactcgccgatgaggccagcaggtctgaccccccacccccagggagcccatggtggggcggggcgggacgacagcagaaacacagccagctccagcatgggacagtggctgaggctcacaggcagtgaggggaggcttcctggagcaggtgggcca

SEQ ID NO: 22970 - DNA, 1050 bp, Homo sapiens
cattctctcaaagtgctgggattacaggcgtgagcctctgtgcttggccctgacctttttttagtttatttatgatggtgtttttttttgtttgtttgttttgttatttttgttttttttgtttttgagacggagtctcacaccattgcccaggctggaatgcagtggcgcaatctcacctcactgcaacctccgcctcctgggttcaagcaattctcctgcctcagcctcccaagtagctgggattacaggcatgtgccaccacgcccagctgatttttgtatctttagtagagatgaggttttgctgtgttgaccaggctggtctcgaactcctgacctcaggtggtgatcctcctgcctcagcctctcaaagggctgggattgcaggtgtgagctaccacgcccgggttgttatgattttttaaaattttacgtatttgagatgcagtcttgttctgtccccactcccaaggtggtgtgcagtggcacgatcttgtctcactgcaacctctgctgcccagttcaagcgattctcctgccccagcctcctgagtagctgggattacaggtgcctgccaccatgcccagctaatttttgtatttttagtagaaacggggtttcgccttgttggccaggctggttttgaactcctcaggtgatccgcccgccttggcctcccattgtgctgggattacaggcctgagccacgtgcccggccctgacctcttttttaaaacctcactttgtggggccactcttggttttcctaccaaagtgcttgacttgttaagccataaacatggaatgatcttttgtgtgtgtgtgtgtgtgtgtgtgtgtgtgtgtgtgtgtgtgtgtgtgtgtgacggagtcttgctctgtcccaggctggagtgcagcgggccgatctcaggtcactgcaacctccgcttcctgggtccaagtaattctcctgcctcagcctcctgagtagctgggaatacaggcgtgcgccaccacagctggccaatttttgtatttttagtggacacagggtttcatcatgtt

SEQ ID NO: 22971 - DNA, 1044 bp, Homo sapiens
gtgggcaccaacgatgcccgtggagggcggctcgggttggtagggggccctgggccccacccgctctgactcccccactccccaggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgagtgtcggcccgcaggagcaccgctgacccgatgcctctgcaggttctcctgggaccggcacagacacccccaggagggagcctccttgttctcagagcagggggcctgggcaggtccctgggtttgaatcctgctttcccacttactggcagcagggcctcgagcaagttcataactactccacgcctcagtttccccatcaaatgggagcggtgacgtgcgttagctagtgcagtaggtttaggcttaggtcctggagtcccggagggagagggcaggaggcctgggtgcgagccacagcctccaccagctgagatggcttccaggccggggcatccccgcgcccaggttgcccgctgagttccctgccgcggcaagggccgactctcggtctcagagtgacggcctacccctaccgcaggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgctt

SEQ ID NO: 22972 - DNA, 1050 bp, Homo sapiens
cagcaggtcgcggcactcgagcagcccggcggccagcacgcgccggtcgaaggtgaagtccacctggtggaagctgacggccgtcatggccaggcagcgcgcccggtggcggaagcgccgcagcagcgccagctcctcaccgcccagctggtccccacgcagcagcagtcccagcttcagggccaccttgaccaggttcttgagcatcttctgggcctccttgcggctgcgcgtgaactccctggtggcgcggtacagctcatccagcacctcactgctggtgtcatccaccagcacggccaccactgccttggacgccatcttactcaggagcttcttctgcgcctgcagagccaggctcttggtgctgaaggtgtccatggcctgcgggggacacagaccagccctcagttttgcacgttggggcactcctcacacagaagaggtgacaacaccacagaccccagagggcctaacggaatttgtttctttaaaaagtgtcatgccggacgcagtggctcacgcctgtaatcccagcaatttgggatgcctaggcaggcggatcgcctgagatcgaggttaggagtgcgagaccagcctggcaaacatggtgaaacccatgtttctctctactaaaaatacaaaaattagccaggcttggtgatgggtgcccgcaatccccgctacttgggaggctgaggcaggagaatcccttgagcccgggaggcggaggttgcagtgagctaagaccatgccaccgcactgcagcctataattcaagcctgtggttcatgcctgtggtcccagtgctctgggaggctgaggcaggagaattgcgaggccaggagtttgagaccagcctgggcaacataacaagaccctatctctaaaaaaaaaaaatcaaaaattttattttgtatttattattatgattattattataaacaaacagagaaggcccttctgaaccccactatctgtagggtctgatgccagccctcaaacccatcatatccttgctatgagctgagaaggggctcaaggtgattg

SEQ ID NO: 22973 - DNA, 1099 bp, Homo sapiens
tgcattcctgtttctagaacagagtaggtgctcaataaatatccgtggaagctgggcgcggtggctcacgtctgtaatcccagcaatttgggaggctgaaatgggcggatcacctgaggtcaggagttcgagaccagcctgaccaacatggagaaacctcgtctctactaaaaatacaaaaattaaccaggcgtgacagcgcatgcctgtaatcccagctactcgggaggctgaggcacaagaatcgcttgaacccgggagggagaggttgtggtgggccgagatcgcgccattgcactccagtctgggcaacaggagcaaaactccatttcaaataataacaataataataataataataataataataataaatatctgtggaatgaataaagtcatcaccccaggaagcacattgtaaccacagcaccactctgactactattctgtggggcgggcaccttctggaggtctccactgctttattttctttcatctgatttttaatttttttcctgcagccccgccggtttccaaggatgcaactatgaagagacacagtgggggctacgattgggtcgtgactgtggcccacgccaggcgagcgtccccgccccagcccctctgccatctgcgtgcctgttctcccgctacctgcccccgcgccaggatccaggcttgcaaacgtccccatgccatgcgcaggcacatctcgggcggccagccaggcacacgctgcggggtgtcattagctgcagtgccgcctaaacgcggcggcccgtgcagaaccacggccaggccacctgcacgggccagggaggtgatggggacagcgagagacatgccaaaccccactggggggttgggaggggaggcgctttcatcctaaggtgacttccgtttttttttctaataaaaaaatattttaaacatggggataaatagagaaaaagacaaaatagaccccatcatagcaatgccaaagatgagacagatttatttattccataaatatctactgagaggatattgcgtgtctgcaccgattccggagctgagctagaccagggagcaaaataaaacaaaacggacccttaaa

SEQ ID NO: 22974 - DNA, 1096 bp, Homo sapiens
cctctgcccacagccctccatggaccccacctcccctggggtcaaagcccaagtcctcgtcacagcccacaaggtcctgcacaacctcccctgtcctctccccgccctcctcctcttcccccttcgccactccgctcctgcataaatacgtgactaaacttgagatctcactgaactgtgacaacaatgctggtgttcccgccaggccagacatcccactccagtcatctcggtcacatattcgcactccctgcactgtttatttgatattcttctttaattaatttatttatttatttagagacagagtctcgccctgtcacctaggctggagtgcaatggcgtgatctcagctcactgcaacctctgcctcctgggttcaagcgagtctcctgcctcatcctcctgagtagctgggattacaggcacctgccaccacacagctaattttttgtatttttagtagaaacggggtttcactatgttggccaggctggtctcgaactcctgaccttgtgatctgcccacctcggcctccccaagtactgggattacaggtgtgagccaccatgcccggcccttttttatttatttgttttagagatagagtctcactctcttgcccaggctgaagtgcagtggtgcgatcatagctcaatgcagcctccaactcctgggttgaggcgagcctcccatctcagcctccgagtagctgggactacaagcacacaccatcacgcccaactaatttttctttatttaatttttggtaaagacggggtctccctctgtcatcccagctgatccagaactccttggctggagtgatcctactgctttagccccccaaagtgcggggattgggatttttgcaaataagtagcttaggatataggcagggcgcggtggctcagcctgtaatcccagcactttggtgggccgaggtgggcagatcacctgaagtcaagagtttgagacaagcctggccaacatggtgaaacccggtctctactaaaaatacaaaaattaggccgggcacggtgggtcacgcctgtaatcccagcactttgggaggccaaggccgggcggatcacag

SEQ ID NO: 22975 - DNA, 1076 bp, Homo sapiens
cggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgttt

SEQ ID NO: 22976 - DNA, 1033 bp, Homo sapiens
ccctacatggatctgggcttggaactcataggttggttctgcttacaaccaagtgaggcttttttttttttaaagttaacatttaaccaatggctgctgtcctcttcaggagcctaaagacgatgtttaaaaaatggagaaaacacaaataaacccctcatttctttgggcagaaagagctattcttctgtttatgtctctggttttaatgttcctcggtggtgggagttgaggtttgccctcagccattttccacactcccttgggatatatccctagcaaggtacagaaattatacctgcccaatgccctgtacctcttcccaccatggctgccagggttcatgcctctttatagttccctgtagattaaagtcacctgacagtccaggagaactgaatcaaggccttatccttgatcattttcatgtatgattcacaaactctaccatctcctccctcttcatgggctcatgccagctgcttctaaccaaataaggaatttttcattttactgatggctgctattctccttatgggttcacagccaagttacatctgtccttccaactgtacccggtctccacttcgtatctctgaactggttcatatcaactctattttccaaccaaatgaagattttaaacatttgtatttcactgatgtctttagtcctccttaaagcctcatgcatagcctcacatgccattcctgatgtactttctttttttttgtctctggactggcttgtgtcacttctgttttcatccaaatgaggagtttgaccattagtatttaactgatggctgctgtcctcataaagggatcatgcagggcctcatgtatcacccctcgtgtattctcttccctttctttcctctgtactgattcgtgttgctttggtttttcagccaaatgagaattttaaatgtgcatgtaactgacggctgcagtctcctgaagggatcatgcagagtctcacaattcaccgctaatgtgctcccatctcatttctgtctctggactagctgatg

SEQ ID NO: 22977 - DNA, 1002 bp, Homo sapiens
ttttcatgtatacagcccagctttcccccttctttgcctgatcccagaacctctctcggcacattgattactacccaggctgtgcgaaacaaagagcaggggcggattttggatttctttatgtcccatgggtattggtcaggtgcctgcattgagcaagggccaaatcaacaaggcaggagatggttgccttattaatggaaggaggaggggttctctgagtcctcacttccttgctgtgctttatgcgcccctagcccagtgccggctctacacctttgcatgggccgttccctcttcctggagcacgattcccccagatcttctcgtggttccctctctttcttctttcaagtctttgcttcttaagtgaggctttcttgagacctacttttatttttaagacggagtcttgctctgttgcccgggctggagtgcagtggcacgatcttggctccctgcaacctctgcctcctgggttcaagtgattttcctgccacagcctcctgagtagctgggattacaggcgtgcaccaccacccccggctcatttttgtatttttagtagagacagggtttcaccatgttggccaggctggtctcgaactcctgacctgaaatgatctgcccatctcagcctcccaaagtgctgggattacttacagatgtgagccaccacacccagccttgagatccacttttaaaaatcacaaccccaggctgggcacggtggctcacacctgtaatcccagcactttgggaggctgaggcgggtggatcacctgaggtcaggagttcaagaccagcctggccaatatggcgaaaccccatctctactaaaaatacaaaattacccaggcgtggtggtgtgtacctgtaatcccagctgctcgggaggctgaggcaggagaatcccttgaacccgggaggcagagcttgtagtgagccgagatggggctactgcacttcagcctgggcaacagagcaagattctgtctcaaa

SEQ ID NO: 22978 - DNA, 1069 bp, Homo sapiens
ttcatgtctattatatattgatatatctctctatatattgtttgtgaagtaccttcctttgaagttttggtttctttgtgttggaatttggttttttaatttggttcttttgttttcttttcatttgggggaaaaaaatcaacagagggaaaagaaccagccctgtttatatttaaatggttttcctttttttttctttttttctttctttccttctttctttcttccttcctgcttttctttttctcctccgcatcctgtcttcccctcccaacctcaccccacctcacccctcgcatctccctcccgccgccactgccgccccctccccagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatgtgagcagggcccatggggctcgtaggtggaggggcaggctggagtcgatccccgacttcaggcacaggtgggaggcagcgtgggagcacctccgagttaccctcttggcttcagtcattcatggctaggaaggggacggttgttctttgaacaggtattatttattggttataaatgatcctggctgggcgcagtgattcacgcctgtaatcccagcactttgggaggccaaggcaggaggtttgcttgagcccaggactttgagaccagcctgggcaacatagccaggccccttctctaccacaaaaaaatgaaacatttagccaagtgcagtggtgcatgcctttagtcccagctactcaggaggctgaggcaggaggactgcttgagcccaggagttcaaggctgcagtgagctatgatcgcactactgcagtccagcctgggcaacagagccggaccctgt

SEQ ID NO: 22979 - DNA, 1075 bp, Homo sapiens
ctaatttttgtatttttagtagagatgggattttgccatgttggccaggctggtctccaactcttgatctcaggtgatccacctgccacagcctcccaaagtgctgggatcacaggcatgagccactgcgcctgcctccatttcctttttataattcatccctgaactcccttaaggtagagaagctgtttgatcgtcccagcccctgggaggctgaaaggtaacttcaccagctccatgcctgagtttagcacctgctgtgccaggcactgcccgagtcaggttaatgcctttctcggcaggatacccaattccctccattttacagatgaggaaactgaggctccaggaggatgggggaccttcccaaggccactgggctcattcagccacatcagctcctccacgtctgcctggagaggtttactatgggattcagagaccttgaggagttcaccttgctttgtgatttcagctttgggacctccaacttgctcagccctaagagaggcagggtgtcgagaagtggactgagaggggctttagagagagagacttgagtcgggctgggttggtttgttccgaaggatttttgtccacgaggctcccacccctgtggccgccccaaacccgtggccaagactcttgggtgctggatggggaggccggatcctgtgttctgccagggggagggcgtctccctggggaagccacagtcctcctcctttcagaccccgattttcagccccacacccattccatgatttttttttttttcttcttgcttttgggtgttgtgttttgttttggagggagttttttcgtttgtttgttttttagattctctctttctttttttaaattgcttttgctttgttatttcatttgttcttcctggttttgttttggacgtcgataccgtttttctgtccttgaataattagctccccccacgctcatttccccattgtgttctgtttccatgacaactcagccttggcatcttacctgtgcctcgctgtgggtgccggcggctggcctggaccgcgtccgctggctggccggaccccattct

SEQ ID NO: 22980 - DNA, 1035 bp, Homo sapiens
caggggtgatcagagaaagcagtaaaggaacaaaggggactcgggagggaggcatgagggttgtcatttttaatggggctgtagggacggcttcattgaggaggtgatgtttgagcaaagccctgatggaggtgaggaggaaccaagcagataacgtgggggaagagcattccaggcagacggcacagcgtgtgccaaggccccggggcaggaccacgcctggcgtgttggaggaacagcgaggaggcctgtgtggctggagcccagtgagtgatggggaggggagaggaggcaataggtcatgtagggtcttgtgggctgcagggagaaccctgggctttgagccctagagaggtgggagctatggagggctgtgggcagaggagggacaggacctgactcagatactcatggttgatgccagggatggaccaggtgaaggcaaaggtgggtggtggggagaagaagcaagtggatttgggatagctttttaaaaaaaaaaaaaaaaaaaagacaaggtctggctctgtcgtccaggctggactgcagtggtgcagtgcaatcttagctcactgcaacctccacctcctgggctcaagtgatccttctacctcagcctcccaagtagctggaactacaggcgcacaccaccacgcatggctaattttttaatttttagtagtgatgggttttgccatgttggtcaggctggtctcgagctcctgacctcgggtgatctgcccaccttggcttcccaaagtgctgggatcccagatgtgagccactgcgcccggccttgggatggcttttgaaggtagagtatccctcctttttttctttccatgtctggggttagtggccaggctgagctgatgctttctcttcgatccttccattagaagtttccagaactcagaatttcagggacaaatatggaggggagggcaggccaggcccttgccctccagggactcactgtctgttaaatggagaatacaaacagatcaagagattgcagtgtgggcctctcactta

SEQ ID NO: 22981 - DNA, 1059 bp, Homo sapiens
tgagcctattaaaaactatttattttccctgacagttgtttactgaggagaaggagatgaattggccggtgtcctcggcaggcaggaaggaggctgaatgggggtgcttggtggctcagccccagtgcttggggagcacagattgccggtgggggcctgtccttggggacgccttgggcagagcctgtgcttgggtcgtggccactgcttctgaccttggagtcttttgggaggtggatgttggaatgagtgaaaccgtcgtggtgtggaggcagggggccggccccgatgacgtctctcttctctttccaggttaaaatgtctcagatgcgctggtttgagacccaagacctggccccatggcccacatgagatattgtggcgggatctcccaatatcccatcatatcccccgactccgtagcagttgaactttacaatttttatctgggcacatggccacctgggggaaagaaaacatttctcagtgcaccttgcagctgtctgtgccatatgattcaatgctgacccatggcgtaaataagcaggattttctggaaatgcctttcaagagaagtggcacatgctcctctctacctgtcagctggaatatggagatgatggcaggtgctcaggcagccattttggaccatgaggcaggtgtcatagataagaatgggggatcaaagaggtggaaggggcctgggccccagtgattgtcggggaggggaaaataaccctgaatggccaacctggcagcttcccttaggtgaaaagagaaatcattccttatttgtgctttttctggcatttgcaattcaactggatccaaacggtggcagaacatgaaccttgggacaccttctggggatgtggctctcctggggatgtggctcttcttgcccctgtgctccagagaccccagactcgaagttttgcaaacagtgtgaggatggggatgatggtgaacgaccaagcatgatgggtgctgacacggatcccacctctagctgagtgcctcgtggtcctgttgaatctgcacagccctgtgagaagcctg

SEQ ID NO: 22982 - DNA, 1029 bp, Homo sapiens
tctctgtctctctccatttctgtctctgctctttttctctctgtgtgtctcttttgtctctctgtttctctgcgtgtctctgtccatttctgtctcttcccgctgtgtatttctctctctgtgtctctgtctctgttattttggtctctgctctttttctcgctgtgtctcaacatgtgtgtctgtgtctctttatctctctggtgtctctgcatttttctctgctgtttttctctgtctctgaagctctgtctctctcttccttctctggtctctccctaccgccttatctttcccacagccccactccagtgtccgttacccacactcacacttggatatctgggtccccaaagaggtcccctggccaagacgaccctcaagtggggcgtcttctggcccaaggaggggtctgcagagaagggcgctggggccacgggaacagctcactgccggcctggggcagctctgggaaatgggtcgaggatggccgagaggtggtgaagatggtggggcctcgtctcagagcctgggaccacctccttggaagcattgaacaggagagggacgggggccatgtgaattaccctggattttatgggggtcacattcaccagccctctagaggcttgagtcaccgagcctgggttgatgttttgagggcaggagcctcagatgccaccccgttgcaggagtctggggctgcaatgggggcaggagaggccccctccccaggccctcttgagggaagatcttagcggggacggggaggctgagaggatgatgagggatggaggttcagagcttggggctaggagagggtgttctcggcagcgtaccttctatgaggtctgggggctggacgaccctcagacgtccagactgtaattatgcagtacagagtcagcatttattgtgtgcctactgtgtgccagactccatgctggacactgaaattcagcagtgacccagagagaccagatttcgccttcacagagcctagagccaaataatagcacaggagaatgt

SEQ ID NO: 22983 - DNA, 1031 bp, Homo sapiens
cccttggtagccacaggtccctttctggctctggatttgccgtcttgagtcatttcttggcctgcgcggtgtgcctgctgggcctggcttctccctaagccttgggtattcagggctcatctccacatgctgcctgggccagcgcttccttcctagttagggctgaacattccatggtccagacacactacatagtgttatctgctcatcagttcatgggtgttggggtccttctccctttggctgttaggaatcctgccgctaggaacattcatgcacagatgtctttggccatgttttcatttctggcaggtaggaatgggtttgctgggtcatggtaattctgcgcttaactttttgaagaaccaccaaacttttccacagtggccacaccattttacatttccaccagcagtggacaagggttcttccctttcctcgcaccctccacggtgtgtgttattgtgtgattctagcatcccagccagggggaggtagcatctcggtgtggctcggattggcatttctgggtggcgttgagcaccttctcacgtgcttactagcacatctgtctttggggaaatgtcccttcccttgatttgcccacttgacatgcagcccttgttgtgtggcatgacccaccatgcagctgaggtcagggtgggtgcgcctgctgccgacacaaccctggaggctcattagatggctgcatgtctttttcttttggcaaaggggtggccgtgactggggagagcacaaccagcggctagaggagcaccaggcacgcgcctggcagggtgccatggacgcaggcgcggctagccgggagcacgccaggtggcaaggtacggggctggctccagggacgagggtggctgtggcccccacatgtgtccaggggcttccccaggaacggagtgtttgcagacccttcttctcttctaggtggcgagaggggcctgtctgggccctcggggccggggcacatggcaagccgcggtggagtggcggggtaaggtgtgtcgtccgtg

SEQ ID NO: 22984 - DNA, 1023 bp, Homo sapiens
gacatggtcagtgtcaccctgttcctctcctgccttccagcactatggagatgaccgccatggccacggaggacccccagagcgccacggccgggactcccgtgatggctgggggggctacggctccgacaagaggctgagtgaaggccgggggctgccccctccccccaggttagtgggtgagccccagccgggtggggagcatctgtcctaacctgggaaaaggttggtgcctggccaggcacgtccccaaggtttgattcagctaggggagctttaggatgggctaccaggggtcctgccatttgaaacccctgactcagaaagtccaggttctcaagaagaaagcatagaacaggctttcagggatggagctgtccaggtcgcccagaatggcccatccccattcttgagctgggggtcgcctgcagttgtgaatgtctcgatcatgggctgcgtacacactgggagagacagcgctgaagctcttagtcctgccccgtccgtggtagagcagcctcgcccctgcctccacgttgcctcttgacacgtgtcttcctcgggttttttctctgacccccagttggtctggggtggatcttctcaaccctatcctgcctattagaatcacttaggaggaccctccacccaggactcagggctgaggacactgggccaggtcctccacaggtgtccaaagccaccttcaccagcactgcagtgggggtgctgttctgagccttgtcagcattggtggggggcagggcttgtctgggaggactctgggtgcctctctagtttctttggccagctgcagtcacccctgcctgtttgtcctgttgccgtctgggctggccgtgaggaggctggtggcaggactgctttgcggctgctgccctgctttcctctgtgagccgagtgtcctgtcttgtctccagccctggcccagggctgcctcggaccctgcccagcgccacagggtgggttttggccccctgtgctcccccgttccatccctccctc

SEQ ID NO: 22985 - DNA, 1055 bp, Homo sapiens
cgtgcaaaatttctcatgaggcctgttttgtatttcgagggtctgggtgggttttttagccttttaaaatgaggaatacatctagtttattaaaaaggcagcccttggttttccagtgtaagaatcctgtctttgggctcccctcggctgcacatctctgacccatttccccattcattggctccttcagtcggaatgtcagagcggggagaacaggaaagggaggctgagaggccacactcttaattctgctggagtttggggtggagttggtgtgaattttgatgagtcccacgcattgggtcagaccaaagatgagggatcattggaggcctctgtttgtccctgttcccctaactgagagctccccgaggaattttagttcagtgagatctttattcctacctctttaggatccaacttcgtttctgcccccggggaaaagcctttcgatttgagctagctttttccttttttcccaggccagttatagtttttatgtgatgggatggaaaaagtatcccagtcgcgaaacttgcctgacctgcagaaatgtgtagtcgtgcctggtgctgtttgaacgggatcttttccttttgcaggcgggagggttcgaggccaatgatgggagaccaccgggatgggcaggtgagtagagccccgatgccaagccctggggccactgtactgctgtgcaggcatagcggaccatttctagccaggcggccgcttgatcccagagaggtggcaaccaagtcagcacgtgtggcgggtatgcaagtgtgggttctggccagcgactagaagtacaaatatttagtcggacgtggtggctcatgcctgtaatcccagcactttgggaagctgaggtgggtggatcacaaggtcaggagttcaagaccagcctggccgacatggtgaaaccctgtctctactaaaaatacaaaaaattagccaggcatggtggcgagtgcctgtagtcccagctactcgggaggctgaggcaggagaatcgcttgaacccgggaggcggaggttgcagtgagtcgaggtcg

SEQ ID NO: 22986 - DNA, 1065 bp, Homo sapiens
aacttgatggctgccacttgctgaagggtttgtgatgcttttcctctccacttacccgtggagcatagctgttctctgtcttgcgagacaaccgaacgcccgttaggcccaagttggccaccgctgactctgccggtctcatgtgtccttgtagacagagaggcagagcaggcgctgtggaaaaggaaattgcctctgatttagaaagtaggtttattggtctctagctaccccaggcggcttaattgacagtcacccttcaccccgctctccgtgagcctagttttctggtaaaaatcaggaagaagataattggatgccgtccagagctgtgtgtagttcactatcaccccatctaattctctttgcttttgcaagaaactcagagggagattcaggctcccgtggaaggcagggaaagtaaaagtgtggcaactcgaatgctattccagaagaatcaaatatttcttttcagttgctcatgaggggggatcaaggtaataacagcctcacgagacaatgagctcacagcagtgctccttttgggactgttggatgagaacacaagtgtgcctctcggctgttaatggcggttttaatttatcagatcaaagcaatgatgatcgaatgtttagagattagccctgcaggacattttaaacgatactgggtctggggagagagctcccctccccacctccacctcctccttttttcctcctcctctctcattaatggaatttgtattcttttaaaataaaaaccaacagacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggtcagtggtcttgtcccctcctttagctacagtcattgtgggcaccggggcatccagctgacctcgttctcagcccagtgcaggggttcctgtgtgctctgaagcctcgtttacttctgagatccacagtggatgactctggccttgcacagaa

SEQ ID NO: 22987 - DNA, 1163 bp, Homo sapiens
cactgcaagctctgcctcctgggttcatgccattctcctgcctcagcctcccaagtagctggaactacaggtgcccgccaccaggcctggctaattttttgtattttaagtagagatggggtttcactgtgttagtcaggatggtcttgatctcctgacctcgtgatcctcccacctcggcctcccaaagtgctgagattacaggcgtgagccaccacgcccagccaaacagttatattttaaagagacccagaaatgacaggaaaaaatcatgttcacctcaccaggtgctcttcgttgctttttgttgtatatccaagttcccatcggagatcatcttcctccctcctgaaggaattgaatgtttcctgtagtgcaggtttgctggtgatacgttcttgtttcttttgcatgtcagaaaaagtctttactttgtcttcattttgaaataaattttcactgggtatagaattctaggttaatttaatctttgttccttcagttaccaatttgtgtcttttctctctctttttctgtggctgcttttaagtttcttctggtttttttgttttgttttgttttcccttagagacaggatctcactgtgtcacccaggctggagtacagtggtgctcactgcagcctcgagctcccgggctcaagcgatcctctcacctcagcctcctgagtagctgagaccacaggcatgtaccactacacccagctaatttttaaaatttttggtacagatgtggtttctctgtgttgcccaggctggttttgaacacctggcctcaagtgatctacctgccttggcctcacaaagtgctgggattacaggcatgagccactgtgcccagcctgtgcctggtaattttttactggatgttgtgaattgtattttttgggtgctagttatacttgtatctctacaaatacccttgagcttttttctgggacacagctgaggtactggacacacactaaggcagggccaaagtagccttcagtttgggctgattttgtctcaccactgggcagtgccctctgagtagtgggtctgatggcccgtgaattaccagcctttccaccctggctattgggaagagcaaaccatttgtggccctgagtgcccctccagtggttgttccctctgctcctga

SEQ ID NO: 22988 - DNA, 1071 bp, Homo sapiens
gtactgataagagaaacacgacagttatggtttgaaagttttcacactattattttaaagctgtctatattttaagctgtgttatgatcttgtaaattgctctaatggtggacaatccagatcatacaaggatcagagattggaaacccattcgtatcaccagatctgtggaagagccattctggcttcttgaggtcaaatacatttggtgcaatgtagtagtgattcttttcatgtctaaccacgtagagtggcatttaattcccccgtccccgtgattcctccatgtgtttctacacatgaaacagatcttgtgatattttgctgcagtcattttgattaacgcagttaaggcaggataaagctgttgtcagggcacttaccacctgagaagtgactggattccagaagaggaaacagagtttctccgtgaaaattttcaacatattattccccttccggactgcgtttatctcccaccgtcagaagagattctgattttcatattggattgttctgttaaaagaaattcaaagaaatttggaagttgagctgtcattgaatggtgattgcattcggttcagcaccttggacattggaaaatcagtcagaagacccagacttgaacaaaaactcgaagaagactattgagaaccagccgcgtggttgtaggtgtttaaatctgtgggggccttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccgg

SEQ ID NO: 22989 - DNA, 1059 bp, Homo sapiens
ccctcctcgccagcctctgtagacagcggttctttggaaaccgtagcctcagtgagagccgagtgtgaggcatctgctgagtccaccacgtgtttccatcctgcaaggcattcacttgagtccaggtttaaagtgaacatttctgccttctctaaaaacatccccagctcccgacctcccggctcaggccttcctagcatctgcccgcccgctgcaagggtgacagcatgctggcccgcgcagtgtccagtccccagggggcggccactctgaccagccgggagttgggaggagctggaggaggtggggccagtgcagctttggggagtcccagattgactagggggtggggggtgtgagggggaggacaggggacctgttctgcaggcccttggttgggctggggtctgagcaggaaggagcagctgggtgaaggtggaggggtgggggtggggggcacccagtccttcctgggcaagcggtttgaagtggtcgcgaagcctcttggagcctggttcagggatggctggaggtgcgggccggaggagagaccctggcggggttctgaacaagcctgggtcacctctggccttgggagggagtcaccaggtagcggggctgcggggagggcaggcgtctgctgacgtctctgggttcctgagacaaggacaaggacaggagactggctgcggggcgatggatcgttgttattaacagcagcaaaaccctcctttgcccccagctctccagggctcccacgttcctcggtcaaagcccaagttctcactgcagcccacaggaccccgcatgacctgccccaccccctcctctctctccctctcttcttcctccccctccctctacccccttccctctccatctcctccctcttccccctctcctccctcttctctccccccctcctccctctgcctcagcctcatggcctcctcactgttcttctaacacaccaggcgtggtcctgtttcagggcctttgcacgggctgtgtcctgggcctggaacacatctctcagaccctcacgtggctctctcctca

SEQ ID NO: 22990 - DNA, 1028 bp, Homo sapiens
gagggagaccatggaaagagggaaaggggagaccgtggaaaggggagaggcagagggcagaggcagaggcagaagcattttttgtatttttagtagagacagggtttcaccgtgctagccaggatggtctcgatctcctgaccttgtgatccgcctgcctcggcctcccaaaattctgggattacaggcgtgagccactgtgcctggcctgtaaattgttttatagagatggggtcttgctgagttgctcaggctggtcttgaactcctgggctcaagtgatcctcccacctgggcctcccaaagagctgggattacaggcgtgagccaccgcgctcagccccacacatgggtttcaagccccttgcaaccacccagccaagtccagcagagagacaggcagctcgtgagctccactcagcatctctccatctgtcccctggcagtgtcacccgcaactacctagactggctcacgtccatcccttggggcaagtacagcaacgagaacctggacctggcgcgggcacaggcagtgctggaggaagaccactacggcatggaggacgtcaagaaacgcatcctggtgagcccagtgtctggcctgttgtggatttgcatgtgggtgcccgggcccaggactcttgtgtgctgtgggttgagatttcaaaggagccccctggtgaattcgtaggcctgggggtgctggtcggggggatcccggcggaggtagcatcctgccctgcccccgagggctcgaggatttcccaggtggactgaagtcatgcctgacgggccgggcatggtggggctgcttgtagtcccagttactcaggaggctgaggcgggaggatcacttgagcccaggaagttgaggctgtggtgagctgtgatcatgccactgcacatcaggttgggtgacagagtgagacccccatctctacaaaaaattttaaaattgcggctgggcgctgtggctcatgcctgtaatcccagcactttgggaggctgaggcatgcagatcacctga

SEQ ID NO: 22991 - DNA, 1033 bp, Homo sapiens
actacaggcgcccgccatcacgcccgcctaatttttgtattttttggtagagacggggtttcactgtgttagccaggagggtctcgatctcctgacctcatgatccacccgcctcggcctcccaaagtgcttggattacaggcgtgagccaccacgcccggccaagacttggtctcttaaaaaatggaggaaagaaaacacagtctctttttttcccctgagatagcttatcctaaggacaaggctctgaggggtaaggagacagggtttggttttagttttgactctcttggtcctgtgtccctgggactggtgagtccaccagggactgcactcctccatctcccaggccgtccgtggccagggccagttggcggaggggagggagttgatggagctggtgggtggggctcccagggccatgctcccacccagcccaccccctgctggagcactgctgggccccagcgaccctgccccatacttggcaggccctgactgcagagatcgtgaagaccatccgggacatcattgccttgaaccctctctacaggtgggcctctgtgcgggcagctggccaggcgggggcatctctgcagctctttctgcagctgggtgggtagggggcttcctcagcgtcctcctgggaggaaaccttgcctgccccaaggagtggcctgtgtggaggagcccgttgcccactggggcatggggcaggtgggaggcccggggccgactcagcaggcccagtttctttgtccccttctgctgaggccggaagctgttggtggcattggctgggggagtggggagcagactgctgaggtgaggtcactgcacggctcccgtggtggctgcacgtgaggatgctgcatgcctttccagcccaggacgggtgggccctgaactctggagaacaagcagcagagctggctcccagcgagcacccctagaccgtgcccatagctacaggggacagggaccctgaggaccgggtccccgtttgggggctgcactgcagcagagcgtgagg

SEQ ID NO: 22992 - DNA, 1020 bp, Homo sapiens
agattgaggctgcagtgagctgtgatcgcatcactgcactccagcctgggcaacagagtgagaccctgtatctaaaaattaaaataaaaaaattcaggccgggcacggtgggctcacgcctgtaatcccagcactttgggaggccgaggtgggcggatcacctgaggtcaggagtttgagaccagcctgaccaacatggagaaaccccgtgtctactaaaaatacaaaaaaaaattagccaggtgtggtggcttatgcctgtaatcccagctactcgggattactgaggcgggagaattgcttgaacctgggaggcagaggttgcggtgagccgagattgcactattgcattccagcctgggcaacaagagcaaaactctgtctcaaaaaaaaaaaaaaaaaattcagacagccaccagcggctacactgtcctgggcagctcagcattggggcattccctgtgagaatcttgcaacagggggaagacagcgaccaaacttacaaatgtgattagaactggcaagaccccttaggggcagcgaacttgttctttttttttttttttttttttttttttgagatggagcctctgtcgcccaggctggagtgcagtggcgtgatctcggctcaccgcaagctccacctcccgggttcacaccattctcctgcctcagcctccccagtagctgggactacaggtgcccgccaccacacccggctaattttttgtgtattttttagtagagacggggtttcaccgtgttagccaggatggtctggatctcctgacctcgtgatccgcccgccttagcatcccaaagtgctggggttacaggcgtgagccactgtgcccagctgaacttattcttaaagcaagtgccccggacctccagtgggcctgttctggtgccttctaccagggtcagctcagacagttcagcgtcaaagccaaagactagagaccaggtgattacggtttctttggagacagagtctcaccctgtcactcagactggagt

SEQ ID NO: 22993 - DNA, 1085 bp, Homo sapiens
agagccttgggggtggggagggagcaggatgatgtaatagagagaaagcagtgagtgtaaggaacttgagcttttacagtaggaaggccccaaaagccttctcccccagctccccttcccttaaaaaaaaaaactactgatgtggaaagtggcatctatgggaaggttatctcctaactggcagagcaaggtcacgcagtgagtcagcctctgcgctcactctccagactcttctaaacaaatctcaaggatctgttgggaagggaaaggccatttcagaggggcagcagccagtagagaggggacagagggagcttctccaacgctgctccaagatttttttttttttttttttgagaccaagttgcactctgtcatctaggctaaagtgcagtggcgcgatttcagctcactgcaacctctgcctcccgggttcaagtgattctcctgcctcagccccctgagtagctgggattacaggcgcccgccaccgtggctggctaatttttctatttttagaagagacagggtttcaccatgttgcccacgctcgtctcgaactcctgacctcaagtgattcacccgcctcagcctcccaaagtgctgggattgcaggtgcgagtcactgcgcccggccccaaggcctttccttgatgttgagtactggttactgatgcaggcccccagagcaagaccttgtggggtcctatcctagctccataaccttcagcaagttattcctttggcttccctcttctcatctgtgacctggacatattagtgtcttattagagttgttgtgggatttaaatgaggccatgtgggctgggcacggtgtctcacatgtttaatcccagcactttgggaggctgaggcaggagcataatttgaaaccagtatggtcaacatagaccctgtctctacaaaaaaaaaaaaaaaaagaaagaaagaaaagccgggcacagtggcatgcacctgtcttcccagctacttggaaggctgaggcaggaggatcacttgaaactgggagatcaaggctgcagtgagccatggtgtcaccactgcactgcagcctgggcaacaga

SEQ ID NO: 22994 - DNA, 1026 bp, Homo sapiens
tagcggccctggacgtgtgcctcggtttccccatctgggcagggaggcactgacccagccggcgatgtctcggtggagggtcaggggtttgggctcaagtgtggccctggagtccctgcctttcctgcaggtcggcgtctcctggtgggggcctccgggcagcaggggtgaggggtcttgggtcagcccacgtcctgccctccctccacccgcctgtctcttccagggtgggggctgtgccctcatgaatcgctccaccaagttccagcagatcgtccgtggcatgaaccaggtacggccagccacatcctcgcactggctcccaaacaactcccccgggccctgtctcccaccacctcccaccgtctcccaccacctcccaccatctcccaccacctcccaccaccgtcctgtaggtgctggatgtgccgctgactgtgaagatccgcacaggcgtccaggagcgtgtgaacctggcgcaccgcctgctgcccgagctgcgggactggggcgtggcactcgtcacggtgggtcttgggacgcctcgggcattggggcctcgcggtcgaccccgcgtcccttcctaatggctcctctcctcccatccctccctcttcacctccacacctccctctgtctccgcctgtgtctctctctgtctctctcagcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggtgggtgttccgggaagccacctccctctcccctaccacccttggtcactcacacctctgggctgttcgccttcccacttgggaccccctcgtaccaccctgatgggagccactgggtcagccaaaactcctgaagggctggtgagcagaactccagggtcccacctgcccatgtctccctgagacc

SEQ ID NO: 22995 - DNA, 1051 bp, Homo sapiens
gcagctgctgtcggggccgtgtttggcctcaccacctgcatcagcgcccatgtccgcgagaagcccgacgaccccctgaactacttcctcggtggctgcgccggaggcctgactctgggagcacgcagtgagtggccccctccccacccccaccctcctcccagcctggcagaatgacccctgacctctgctcatcctccaccctctctgttccatcccggacaagaagtaaagcagccttcttgaacaccagccatttcagtcatagcgacagctgctgctgctgcttaagcacctactgtggccctccctgacctgccctgtcccctccccaccctcccctcctcactctgctccagccacacgggcctcctcactgctcctcccacatgccaggtacagtcctgccccagggcctttgcatgggcagtgcactgcgtggaatgctgttcccctcactgtcctgaccaccctgtgtacaagccagcatccccgccgccctcgctctgtgccgccttccttctgtgtgccttgtcagaggacacaggtcaccaaggtcaccccctgtctctgccactggcctgtgagtcagagaggaggatggatggagtctcgccctgccatctctctccctgcacctggagccctgcaggggagctgcccccgcaaccttcactttacagaaaagggtattagggctcagggagggaattaagtggcccgaggtcacctggaggagcaagtggccttctttgcagccatcagagggtgcagccctggtggagaaggccacgcttggcacaggggagcccgtctggagcatgagccagacatcactcctgccctcccatgggcccgggctcagcgtcagtgcccgcctgtgcccctggcctacccccagcccgccaaggctcgggccctcagggccagcgggaggagtgaacgagccctcttgcagctcagccgctctggcctggcatgttgggagtgatgaatggcaggttccaggcaggcagagagggagggtgcgagggcagggcgtacgccgtca

SEQ ID NO: 22996 - DNA, 1029 bp, Homo sapiens
gactgaccacagggcatgaccactcgctatgcagattctgacactgggtgtggccacatccccgccatgccccgccccccagtcattgtttcgtcatgtcttgctcctatcaactggagtcccgcccgtcccagtctgagcccggcccctcccctagtagatagtccccgcctctagtagtccctaacctaggactccctgagctgggactagcgaaatctgtctgcactgatcgcagtcgtcctcagtttcaccctctaggaatcggcctggggatgcacgtgctactctcttcctccaggccggtccccggcgcgtgcgcgcgatccatgtccatgtccgcgcctatcaataaagttgctcacttgttgccggcccgctagcccgaaaggttgcgcgcgcagcccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggtgagcgccggccgggccccgagggtggagggccgaggccgcagggaggtcgtggggttactgggggctgtttggatcgaacgggtctgggagtctcgcgggtacgcacgtggttgtcatcggggtgtcttgggcggtcgtagggggggatcttgtgtgaaatggatgttggtagggggtccagcagggttggggagcactgggaggtcgtgacatgcgacaagctagtccctggggtcatctgaggcggtcccaagctatcgccaggctcggggaaattgtggagtgagacagggctattatcaggtccaaggagctaagggaccacgagactttccaacggggtagagattgttagaggggatcatgagtcatgattggggcatctgagggcggtacagatgtttgagaaagttttggggtgggatgaggtctttctg

SEQ ID NO: 22997 - DNA, 1051 bp, Homo sapiens
ggaatgagggagctccacttcctgctcgttgattttattccttccccctcactgcccactgctgaaccatgcttgctgtatcgaaaaccagcatagagaagaggaggtgtttgggctgtgaatgtaggctaaagaggcgagggaccaccattcttctccccggccctcttcaaatcacctcccgtccagcgcagcagcccccaagagacactcagctctccagggtaactggaggcgtgaggggcaccaataatttgaacagtgttgtctttggttccattctgcgtagagtgagttcttcccctacgaattccacttcatttgtggaaacctgttggctggcccacaccctgggaagcagttgccctggtgaaggaagatcttaggtgggggagggggaaccccatggacaagccttgacaggtgaggaggagtcagggcctccaatgtggcctggagcatctgatatctcccctgccggctgcccctgcagaggtgcagggacaagggggtgcccccagttgaccagagttgactgtagtcatcagacagatcaaggccgtcgggctggagaccctcgtagtgctgtaaagagtcttggggtttgctgttctcgggaaagactgaatgccctgtttgcgtgctgttccgtctcctcccgtgggacgtgagaatccacccctcaggtgggagaggtgatctctgagcgtccaccccacccattcatgctgtttttcctcttgttccctcccccgcctgcacctccttgtcaacagtttcaaaaaacaatgtttttatgccatcaagcttctgcgagccatctgcaggcaattccgactcagagccaagtgagccccggcccctctgccttcccgcccggcctgggggttctcctgggaggaaaagcaattggtgtgggaaaatcagatcttcagcgggcatttaaagtcagttcttcttcagctgttaaaatttttcccccaactcttcagctcatagtctggggatctggcgtgagatgaggcttcataagccctcatgtttgtttctg

SEQ ID NO: 22998 - DNA, 1031 bp, Homo sapiens
tgttacggccccgagagttgctcggctgccgtgagcctgatgccctctgaccccggctgtgtgctccttgtttcagaggtcagctggcggctccagtcctgaaggcggagaaggtaaggagctctctaacacctttgaccatcttcagttttaaagacagaagcaacctgatttttctcctcctcttctcatcattttctgtagattctgacagagaagatggaaattactgccctcctgtcaagcgagaaagaacatcctctttaacccagttcccaccctcacagtcaggtaaaatatgcaaacttacggaatggtgaaagcgtttatgcttacaaacccgccattcccctcagtgccgcgcatccgtctgctgtgtccttcctgcccagctccggttagagtcgatctgaggctcgggctctgtcaggagtgaggtgagagcttgtccagagtgcagcatcaggggtcctcgtctcgaatcagtgacactgacggcatggtgagacttggtggcctgaggaagactgtgaagagatcgtccctctgaaatggaggaaaggggttgactactgagagccctgttggggcctctgcctgttaattacatctcctctttccaaggctggacacagactgggggtttaggggtggggtgttctcccaacccctcagctgcatgcccagcacgggcagtccagtgcagtagcccagacacacacacgcatgtacacacaagcatgcacacacacacggtaaccagcaagccaggaggccccagcagaggcccgtgtgtgatgctgtgaactcccagaggagaggagcttgcgggggcctggaagggtgggccaggctcggactgtggagcagggcaggctaaagggcttgaaggccctggacgtgaggcctggtctgagcacaggcctggaggtcggcctggggactcatgcaggctggtacaggagagaggttcctgaggcagataatgccgtcagcactacttaatataacactcagaaagcccggcctcc

SEQ ID NO: 22999 - DNA, 1024 bp, Homo sapiens
aggcactctccaacacagattgctttgcaagactgattgtgtttggactgtggttaaggcagtgaactgattgtcttcaatcaaagcaggaagaagaaaagactcttcctttgaacccagaaggaatcccctgagccctttatctttgtattaagaagccttttgaagattataggtggagaagattgtgaactctcaagaacaagaaatgtcttgggtttttgaagtttgataaattgggaaaggtaaacattatcctacattcaggattgaaaactccatcctgtaggtaactcatgacagaagacccctattctcaggacagggaaaaaggactcttaacaagaaaagaagggacccagctctaccgcctgagcaccaggcagccttccaggctggtacggtcccaaaccttatcccggacctcagcgttctttctagcacacaacagtccccggtttttaaggaaactgttaacattcagctacagccaccaaacctcaggacacttaggaagcactgttcagccaggggtgggttggagtcctgtgttaacattttggaggagtcagtgtgtgatggaaaaagaagcaacagtctttacttgtgccataggctatgggtgtgggggaggtaacggcagtagtggccttcgtggcacaaaagtgggtttggggtagtgagacacgggagccgcgggaaggagtccagccaggaggcacttgacccacagtgcactgggagtacagccctcccatgagcgcacgtgactgccgccagagcaagaattaggaggtggctgcgtccttcttttgttggcagagtggctgccggaaacttctcctgagtcaggtatggtgagttactgcacctctggtctttgagagcacaggaaatggtgttctcaggtttccgtcttcagctgtctgggaacagatggtctttagggtcccccccagaggccttctgcaggtgcctgggtttgaaaaatgcagcccacataggactctccagctgcagaggt

SEQ ID NO: 23000 - DNA, 1029 bp, Homo sapiens
tgaagtggggaggctttgaggttgtactagcagaataatggccatttggtaaaaagaaggcagttacagaaatgctatttagcagaaagtacagtatcactgaaaatgtggtcgtagggtgtttagacctgcttttgaggcttaccgttggtgtgatgagcttagccctggtgcacgtggtttttgccagccatgtgtattttaggatgaggtcaaaggctggcaaactcttgatgtctgattttaccagacatgttgaaaaactccaggcttcaccttagttctttagagcttacgattcctgcccaggagaaatgctaggacctgagtagaaaatgctggaatgacattgttaattctcccatctgagagaggaagtgatgtaatacttctcaacacttatacaaatcattcatcttaaccaaagatgacgaatttgatcctgttttgatgtcttggtttccatgtttatgacttacttcttggtcctcctgtttagcattttgaattaccatgaggatgtttgaatatttacatttcaaaagcagggattacaaaaaattcaagtggttctaattagagataggcagtcccccacagagctctgggtttaatttttctcttgtgaggtgttaagtctctcaccatcaagtagcaacagacatgggtggctggacgaaccacggtgccctgtgcaggtttagagagccaggtttagagagcggctggtccgtggctctgccctggatacgaagaggcgacagtgtccccttgattacttttgagtgaagattgcttttgctttcctaggaatttgtgtacattctcttacatcctctttctgtagctcctttcctcctcccggatcactgctttttaagtagtgcccaaaccccgtctaaagaggtcagccacttcacacccaagaagaagcacagccacgtccacggggagacggggcagccctgtagtcatgtaggtcaccgagtgcgagaaatggctccatgtcgttggacgatgccaagaggg

SEQ ID NO: 23001 - DNA, 1050 bp, Homo sapiens
gttactctaatttgttctctctttactgagagtctcttttccaggtcgcattgccaaggccacttctgcccacagacggggagacctaagcagaggcctttacactttcacgttgagcttggagggaaaaggcttggtggctttaggttaccgtggagagaggttaggatgggtctgttgtggaaagggctcagagagtacagtttgttgaaacggtattagaaagcttcttcctaattcctgatgatttgtttgagaaatgccactgtaccttaggaaaaccaacagcagagggacagtagggggcaaagggaggagggaaggtggggagggagtcagggagggagggagggaggggaaggaggagagcaatggtggttacaggggaaacaagacctttaagcctggatttattggccctaacgagctgggcgtacgtgcatttagagtaattgttcatttgtttgcattatatatttatcccgtgtccatgaggctgcttctcccttggattcagggtgtctgggtcgcagtgtggttggaagtacctcgcctgattcatggcgatgagctggcagcctgtggaaggtctgattggtgtggcaacagggttctgtgataagacaacgatgggtgctatttaccttgaagccatcggcttctctccctgacagatcggtgtggatggtcagagttttgtcagaagttagttggtgctgtgtggcagtgactcctcagcttgcatggggaccctcactgtttatccagaaataatgtgtggtccctccccactgatgcccagcgacggcactccccacctcatacccgctgcaacagtcccactgatgcccagcggcggcactccccacctcatacccgctgcagcagtcccactgatgcccagcggcggcactccccacctcatacccgctgcaacattttagagtgaccaagtgttgtgctgaattcggtgcattttgaggatgtctgcatcttgttggtaataacaggatttgagaatctcatcaactccattctcctgtggcttct

SEQ ID NO: 23002 - DNA, 1093 bp, Homo sapiens
ccggcagctcctcagaaggggcctctgtccagaagtgccgctgttttcccttggaattcctgcctgcctcggattagtgtcttagctcagtgcgtggcctccaccctcaacaacccctgcgcctcccacaacccctgcgcctcccgcccacggtcccatctgaggcaggggcagccaatcttccaggcgctcggcccccaaccccactgcgtcctcgcctccttgctcctctcatgcccacccccagatgctcttcaacctcaccttcaagaaagatccagaaccaggtggcaccccccacctcctccacttcgactacttcccgagccgccactgtccctgtggattctttcggccacctcctagccagccgtcagcacccacccctacccagcctccagccccttctcacagcagccaccagagtgatcctgctaaaacccaggtcagatcgccacactgctctgcttggaagcctccagggctccccttggccctccaagtagaaccgagtgttgtcaaaatggcccacaaggccctgcaggacccgctctctcccactcctcactgtgctccagccacacgggcctcctcgctattcctccaatgcaccaggctcggacctgccccagggcctttgcactgtggggccctctgcctgaagctctcttccccaggctccccctcacctcctctgagtcttcactcagtgggcactttctcagtgagccctgcctgacacccccaccccacctcaacttactataccgttgcagtcctccctccagtccctccgtggcggcgaccccatcccctttcccaggtgaatttctctgacggcactcggcatcagccctcattcggttcattttacttatttattgtgggtctctgccagacaagaacggacgcttccagggggcaggggtttttgtcttttattcgccgttgcatccccagcacctaaacaaggcctggcatagagccagctctcgtaaatatttgtggaatgggtgaaaaggtggatgttccaagtcggattatgtcaacacagggcacacctggacggttggaatagctgcccgagctgcta

SEQ ID NO: 23003 - DNA, 1035 bp, Homo sapiens
ggtccactcctccaccctctggcagcatgagtcgctctgaaagattttgaagctgggacaggagagggtgagtgaggtgaggcctccgcatgccaggttttcactggcacattccccatcttcatcttgaccatcagcagctgcactgcagccctgctcatggtcagaaagggagagaaacgtgagagggaaagaaaggctggtaagagaaggagaacacaaaagcatgatgccttaggaagccgcttccaagaatcctgggacaggcccctgtgctcagctgaagacgggagctggaggccaacatggtgaaggtggctagaacaggtgagcagcccggagcaggcgggctgctcattctcttgttcattgcaaaacacgtcttgagcatctttgcaggcaatgtgctacgtagggtctggggttggggtgagggatctgtgagggggctgctgagatgacatagatccagactttgttttctcaagaagggctggctggccaagaagccagatgtgaacagctgcatgacatgaagtaatctgaggggacaagcacggagagtggtttggtgaatctggaaatgctgtgtggagtaaaggtgtggccttagacgtgtggttctccatgggggtggtcctgcccccaggggacactgggcgatgtctggagacatttgtggctgtcagacaggggtcggggggtttcctggcatggagtgggtggaggccagggatgctgcccagcaccctgcggtgcccaggacggccccaccccagagtgtattcctgcccctcatatccgcattgctgaggtcaggaaagcctgtatgacatgacaagctgactggagagagggtttccccactgctcatcacttgcctgggatcccctttggagctgctggctgctgtctctctgcctccctccttcttcaacgcagcagtcactttaatcttagctgtcatgggcgggtggactttgagggacagagggctgcccagcctgcctggccctgctggaggggtcttgtcca

SEQ ID NO: 23004 - DNA, 1080 bp, Homo sapiens
tgtaagtatcactctgtgatattcgcacaatgatgaaattgcctgaggttgcattgctgagaacgtatccctgtcaggaagcgactcatggccgtattttactcctgcaagggtgccaagatcattcgatggggtaaatacagtctttccaataaatgatgctgggaaaactgggtttccacattcaaaagaatgaaattggatctcccctgcctttttttttttttttttttttttgagacaggatcttgttctatcacccaggctggagtgcagtggtacaatcatggctcactgcagcctcggcctcctgggctcaagagatcctcctgcttctgcctcccaactagctgggaccacaggcatatgccaccatgccaggctaatttttaaattttttatagagacgaggtctcactatgttgcccaggctggtcttgaactcctggcctcaggcaatcctcccacctcaccctcccaaagtgctgggattacaggcgtgagccactgtgcccagccaggacttttattttataacatacacaaaaattaactcaaaatggatcaaagacctaaacataagagctaaaactgtaaaattcttagcagaaaacatagggagacatctttatgacactggatctggcaatgatttcttggataggacatcaaaagcactcacgacaaaaggaaaaacagaaggattaggccatcagcgttcaaaacttttgtgcatcaaagaacagtagcaacagagtaaaaagacaacccaaggaatggaagaaaatgtttccaaatcatttctaataagaggttaatattcaaaatagataaagaatttctgtaactcagcaaaaaaattttttaatgggcagaggacttgagtagatatttctctttcttcaaagaagatattcagatggccaataagcagttggaaaggtgcttcataccagttatcattgcagaaatgcaaatcaaaaccctaataagataccacttcacacccattacgatgactgttacccaaaagaagaaagacagaaaaatgttgataagaatatggaaaaattggaactg

SEQ ID NO: 23005 - DNA, 1025 bp, Homo sapiens
ctgcattttaaaaagtaaaaagagacaagtgaaagtaatttaataatacatttcatccaatgaactgtattgaaaatattcatttcaatatataacctatatgaaaaattattgtcgagatatttcacattcttttttgtgtgctaagtcttagaaatgttagttcggaccagccccatttcaggtgctcagcagccacgtgtggccctggcttctataccgactgcacaggtaaaggtgttaaagtcaaagcaggcacaagttttaagtcaactcttccttttaaaaggtgaccactatattggctacttactggcgtgcagatacttcatagccgtgaaaacataaggtcactgacaaagtctgagtagcgtgggtccacctgacctcagcgttgtccattttctaaagtgatcatcactggactttgaaacacaggtggtgccctccaagccacctgagtgatctgtccccagaattccctagtgaccatttcaggactttgggatcctgtgtgtagtccccataattctgactgcttctcttttacattataaaagtcttacgttttcatcattaaaaaaaaatccaaattgtaaaaaagaaaaaaagagcctctggctgcttcttcctctctcctctgcccctcccaccactaagaaaagtttggtgtggatggtttcagatatttcacaggcctgtaaaacatacatacgaattctttagtgttttttgcattgggatgtaattcacatgccgcagaattcaggctcttaatgtgtacaatttagtggctttcagtatattcacaaggttatgcaaccatcaccaccatctaattccagagtcatcaccccaaaaagacaccctgtccccattaagcagtcactccccacctcccttccccagcccctggcagccactaagccactttctgtctttgtggatttgcctgttctggaaacttcatgaaaatggaatcatatagtaagtagccttttgtgactggctgtttttagcatgat

SEQ ID NO: 23006 - DNA, 1032 bp, Homo sapiens
agctgggggtccgtgaaaaacaggcggcgagcgagagtttgctgacccctgatcagactgttcccacatgtcccacactcctcctgtggggtaaacggagtcccttgggtcccctaaaactggactttcccaaaacgcgccaccaacccacggcgccgcgcgcgcgaccggttcgccaaccctctgagccgcgcgcgcctcccgccaagacccgcccctcttcgcggccattggccgagtctcgcactctttttcaagggggaacgcctcctccttccgacagactctgcagacagccaatggaacgccgtagggtctcgcgccccgccctcttgggggcccgttggaggcgagcgtgggcgggccgttaggaaggtggggcgcggagcctggtaaccgttgccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccaggtgaccgatgcgaccgccccgggcccagcccggccggggagtgtggggggcggcggggaccccgttcgggggccggggggcgggcagcacgtccccgccgctcaccccaaacgtccgggtggtgcgcccgcgggacccgcctccgccaccccgtccgcgcgcgcggcggagtttggggggaccctggcgacgtccccactttccttattgactgaacgcgggggaggtgcggtgccgtcgcctcactttttacaaaacttcctgaggttggggcgtccggggacccctttctcacgcttaccttcaaactcgctgagttgggggcgccccgggaacgtctctcaaactcctcaaactccctgaattgggggcgcttggggaccctcttctcaccttaaccccctagatctctgagttggggg

SEQ ID NO: 23007 - DNA, 1075 bp, Homo sapiens
gccagctgaaggagtttacacaccctaccatgaccctggtagagtagagacagcatgagttgaagcctgctactcagaatccactgcaactaagagtgtgtgtgtgtgtgtgtgtgtgtgtgtgtgtgtgtgtgtatgtatgtgtgtatgtgtgtgttttctgcagttccagtcacagatctgcctgccacacagtggagccctctcttggactctgaatgcatagcccagcaaagccaagcaactgaatctcaccatcagaacagctgagagcagctccatcaaagcagtcagtggtacatgtgatcaatttgttttttgtatttctgggctacaaaatgtctcttaagtttcatcattggacctatcgagaaaggagaaatcaattgagttgtggagataaaagaaaattacacacacccatgcatgaccaggcaacagagtcccatgcctggggctaggctgggtggctggctgtgccattgactttcagggtgtgtaacttttgccatctgtatggggatgataaaacttccatgtgatccttcagctgtggtgaggattctgtgagctggaaggtgaagagcatggtgcattctgtgcctgatgtggactgtgcacccaatggaggagggatatcatcatctcaaaccatacccctatccccattttacaggtgaggaaactggggcatagagaggaccagttcctctgaggtcagccagcaagtgcacggcagaatcaagtctcaaactgggagttgtctgctccctgagcccaggactttcattgaaagcctctgagtcaccaggggcattgaagcccctctgggtgtctcaagcaaccccacaaggactgtgttttcaacttatagatgagaagaccaccagcctggacaacatggcaaaacaccatctctacaaaacaaaaagaggatagcggccaggcacggtggctcacgcctgtaatcccagcactttgggaggccaaggcgggttgatcacgaggtcaagagatcaagaccatcctggccaaaatggtgaaaccctgtctctactaaaaatacaaaaaatta

SEQ ID NO: 23008 - DNA, 1029 bp, Homo sapiens
gcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagcagacgcatgcatctgcctggttcctcctgtccagtcagtgggcaggcttgcgaggtagcctggggccccctgccccgactacgtgtcccagtgcccccagatcagtgaccaaaacagagaaggagggttgggaccaagcctggtgggggtggggagtgtgagcaaggctggagacgatgctaccagcaattcaagagggcagagaattcggctcacatcctgcttctgatgctgtgctctctacttggaagcagacagcaaggtttgggttgagaagaaaacttggtttcataaggtggatgcatggatgatggatgaacagatgggtgggtgagtggatgggtggtttgatggatgagtggatgattggttgggtggaccatggatgaatagatgggtgggtgggtggaagaaaggatggaaggatggatggatcgatgggtggatggaaggaaggaa

SEQ ID NO: 23009 - DNA, 1049 bp, Homo sapiens
gccggagtgtttggagtgccctctccctctccaggcaggccaccctgagtaggggcggctttttggggaaaggacataggcccattggctgcaccagcctgccccagagtggggagggccctggggaccaggcagcctgcaggacacagtgggagagctgccctgagcccccggccccagtccagaccccagcacccactcccaggcaaaaagcgtttccactcctggattggaacaagagcctccttcccccttggcctggaatcctttgcaggggggctgggggagaggagtgtgcggggttgtggagggagtctggcctggaattcagccgtgcagttgccgagggggctgggggatggggcccttgaagcctacactcgctccaagtgttcttatctgccgggaagggagggggacctactgaagcgggatcatgtgactaaggtaattgagggctttgtgtccctctgttgccttggtaacaggaatataaaccaagatgccgtctgtaggggactggaaccgtgtgcctctggagaaaggggaggacggtggactgggagcagcagaggggattaccgagggggtgggcaggccggcgtagggtgcaggaagagagatctgtgaccccaggcccagcttcccagccaggctgtggctccctcgccctccctgggctctcggcagagcttctgatctctgtgccccgagcagaggaggggttctcctccggctgcagcaatggaggggccctgcgcgcccactgccggccagtcccctgaggcctgcgagcagggccaggaaggtagggaggggtgggggagccagggcgttctaggggaagcgggtggctgccggtgtgggggcagttcttagagatgggcacagggacccccaggtggacgggcgtgtgcatttgggggtcaccagtgtcaagaagctctgcgtggcctcatgggcgaggggccctggaggctcagtggagccctgcccttgtctcccctccctccctgccccgcctccccaggacccctgcgctccatggt

SEQ ID NO: 23010 - DNA, 1050 bp, Homo sapiens
ataattcttttaatttctataagattggtagttcccacttttatttctgatgtgggttatttatgttcttttttttaaatactagccaaaggtttgtcaatttagttgatctcttcaaagaaaaaacttgattttattgattcactctatgccttttattgcgtattttatttctgttcttttccttctgttagctttgagtttagttctttttctaattccttagggtgtagaaggagtcattgatttgatgtcactcttatttttgaatgtaggtgtttacagctgtacatttcgctctgagcactgtgtacactgtattccatatgtttcgatatattgtgttttgttttcattatctcaaaagtatcttctaattctcccagtgatttcttctttgacccattggttgttgtatttgttggggttttttctccagacaaaatcaataggagagacagatagatagatacccagatacgagagggaacttattgggggaataggctcacgtgattgtggaggccgagaagtcccgtgacaggccacctgcaagctggagatctgggttgccggcagcacagctcccctcaagctcagacgcctccgcagcagagaaaccctgctgtaattgtcagtctgaggtcgaaagcctggtactgagggtgtgaggccagagtcctaaggccacagagggagagaggcagatggagagattgccctccctgactttttgtccctttagagacagatggccatttctctgttttttgtcccatctgcaacccaaccagttggatggtgctggtccacactgagggcgagtcttccctcctcggcccgacttacatgccagtgtcctctggaaacaccctcatagacacacccagaaataatgccttaccgggtctctaggttctttttttcttttttctttgtggtggagtctcgctctgtcacctagactggagtgcagtggtacaatctcagctcactgcagccttgacctccttgggctcaggtgatcctcccacttcagctttccgagtg

SEQ ID NO: 23011 - DNA, 1035 bp, Homo sapiens
taagaccggagcagaaaaggtgctttctccgacagctctattcttgtataagcatgagggtttttcagcgagtgcacttgaccttgaatatggcatcgcctgtataatgaaggaattgtgctttatgcagtgttaggcattagaacgtaactgaggccgcattttgtttgacctgttggtaggatgtccttttacagaaaaatcactcctttctctcaaggaaaaagaatttggaaggcctcatctgattgcaaagtaatacatgtgtgttgtgaagaagtttttccgaagcaagacgacagcgttgccttgcttgacatctgctgggaacatgcgtgttgggcagctcaacctttctgctgttctgggcatgtctgcaaatgactgtgaaagctgacagtatcagtttggggttgcaaatgaacttcagtgaggaggtaaattcaaaagtatggaatctacacagaatgacggacagctataccattttctgtttatccattcatctgtggatagacgtttgggctgtttctacccatttgctatggggaatagtgctgctgtgaacgtgtgtgagtgtgtgtttgtacttgtttgagtgcccgttttcagttcctctgggtgtatacacctaggaatggaattgcaggctcatacaataattttctgtttagctttctgaggaactgctaagccgttttccagtggctgtatcctgtcataggtccaccagcaatgtgtgagggttcctgtttctccagatcctcagcaatgcttgttttctgtttcttaaaaattatagccatcctctagggtatagagcggtaactgttgaggtttttatttgcatttccttgatgacccgtgatgtttcacgtcttttcacatgcttgctggctgcacgtatctctttctcgagaaatgtctagatatatccattgcccatttttgtttgtttttttccgagatggagtctcactcttttggccaggctggagtgcagtggcgccatctcggctcactacaacctctgcc

SEQ ID NO: 23012 - DNA, 1006 bp, Homo sapiens
tagagtgactgtcagcttgctactcagtgctccctctcgccctgaatcaatgggacggcaccaggccaaggcccacaatgcccagagcaagcctctcggggcacagatggggaaactgaggccttggcagttttgtggcctgtgtggtcagactctgcttagacctatggtggccttggcttcaagtagaccttccagagctgctgtcctcctcccttcccacttgaggactgacctttggcgtgtctctttacaggacttcaatgacagaagagtacagggtcccagacggcatggtgggcctgagtgagtgtgggtcaccttgggtggggaggcccactcttccccaggaggaagtgtcctgtgagctcctgccagcccagaagccctggtctgagagggctcctatgtgctgttctcatttgtccctccttcgtcccctctgggcagaggacaggagctctctagaggactgctgccctcctgaacgtcagaggggctggggccccggccacacagtctcctgaggcctgggctcccttccctcatcacgctttgcttttctccttctttctccatccagtcattggcagaggaggtgaacaaattaacaaaatccaacaggattcaggctgcaaagtacagatttctccaggtataagagcgtcaggttcctgccagagtgggggccagggttgggccctttgcactttcctttaattacttaatttccacggggactgtggacaggaagcgagctggcgcttgttggtgcttactacggaccaggctcagtgcagtatctcactccactagtactgcccacggggcacagctgtgactttttttattttcagtgggtgggtatggactgaggtggcagggctagcatttcgcacaggggcctggttccagacaccgagcttcgacgcactgcactgacctgccgcgtgggtgaaagcaccccggcaagactgcgtgagacagggtggtgccttggacagag

SEQ ID NO: 23013 - DNA, 1050 bp, Homo sapiens
attggcggggtctggcctccctcaggggccagtctctcctgggctcctgtctcagctcctgttaagggtgggggccgaggggcactgtttaccttggacatgtggcaccagcatcaggttcgaggcggccgtgggtgggtgggtgctgcatctgccatcctctctctttcccagatcaaccggagagcaagaagctggcttcccagggagactgtaagtccagggggtctggtggcagatatgtggcttcagagggttgaggttttcaggagtcaggagctggaagcactgaggaggtggcagctctttacagaggcccctggtgcttcattctggggcccatacgtttgagggatcccaggaaccctgaaattgagggagatgagctctgtgcttttatggggaggaatccacagcatccatgaggcactggagcaggctggggaccgtggtgccgggctcagctcccactgacccggggcaggcagtgccaagtgcccgaggaggagctaagccagtctttgctttgggttttctctctacagcaatcagttctcaacttggacccatccatcctcccccaaggtaagccatggtggggcccacactgctttcttgtctgttggccagcagactggcctttctgctgacttgggagggctctgactgggggcacatctctcaggttttatcccccagtgccagttgaccagagtgctcagacgggaatgaggcagaggagctgtgtccgttcctcgtaccccttgtctgaagggctgtgggaggggagcgtcgtggcagtcactgtagtgatagggtggtctccgcaccctatggcttcctccgctggggtggggactctgagcagcacaaatgtcgtcttcctggaagaggctaggagggccttgcttccctccctcacacatctgcaagtgcccatcccactcagtgctgtggagctcagggctctttgccacctctttgccccaccagatggactgaggtgaacctgacacagggcagttgtcaggggtcattttttgtttgttt

SEQ ID NO: 23014 - DNA, 1015 bp, Homo sapiens
acgtataaaagtgttaaaactatacaggcttgatttatacagtcaatatttatttgtatttgctcacattttatctttcctgattatccttatatatttctggaattgcttccacatggaataattttcctccagccccaaaactttccttctttctttccttctccttccttccttccttccttccctccctccctccttccttcttttttttttttgagacagagtctcgctccatcgcccaggctggaaagcaacggtgcgatctcagctcactgcaacctccacctcctgggttcaagcaattctcctgcctcagcctcccaagtagctgggattataggcgaccgccactacgcccagctaatttttttttttttttgtagttttagcagagatggggttttgccatgttggccagccttgtctcgaactcctgacctcaggtgatccacctgcctcagcctcccaaaatgctgggattacaggtgtgagccaccgtgtctggcccaaaactttctttagtgtttcttgaagtgcagttctgctggtgatgaactatgttgttgctgaaacaccaggggttcaatctaggtcctgctgctcaccactgcacagaaagcctatcgctgagacaatgagtattgccaaggaagaaggctttaatcagctgctgcagctgaggaggtgggagaacaatctcaaatccatctccctgaccaactaaaatttgaggtttatatagcagggaagaaatgttaccatgtgtgggaatacaggaattagggaagggtaaggaagaggagttggtcaacaggaagcaggtggtcagttaggcaatcatgatgggtgatgggtctgatgtctcactgtacaaatgcagtattctggtgcgtttcagctcctagatactatctgggaggcctgatggttggtttcctgagaaaggaactcagataagataaatgtaactttcttaagttttaagattgggaagatcaatttgtttgtttat

SEQ ID NO: 23015 - DNA, 1041 bp, Homo sapiens
tatgtattaatcctgtaggtcctaaggaaataattcaaatttggggcagggaacaaagctctatgcataagattttcatcagtagcaaaatatgcaaaccactaagatgtccatccattggagaatggacacatggaagacggtgcatccatagaattggtggatgaagagccattgaaaatgatgtttgggggccaagcatggtggctcatgcctgtaattccagtgactcaggaagctgaggtgggaggattgcttgaggccaggagtttgagcctgggcaacacagccagaccccatctctgcaaaaaaaaaatttcaaaattagctaggtgtggtggtctatgcctgtagtcccatctacttgggaggctgaggagagaattgcttgagctcaggagctccaggttatagtgggctgtgactcactcactacactgcagactgggtgacagagcaagaagactctgtctccaaaaaaataagataaaatgtttgggatgacctttgttcagtgtaatgtagaagttaaaattacatgctctggagtttagttcgtttgtgttgttatcccccagcagttaagaatccccctgtatctgctgggtgcagtggctcacgcctgtaatcccagcactttgggaggctgaggcgggtggatcatgaggtcaggagatcgagaccatcctggctaacacggtgaaaccccgtctctactaaaaatacaaaaaaattagccgggcatggtggcgggcgcctgtagtcccaactacttgggaggctgaggcaggagaatggcgtgaacccaggaggtggagcttgcagtgagccgagatcacgccactgcactccagcctgggcgacagagtgagactccatctcaaaaaaaaaaaaaaagaaaaagaaaaaagaagaaaaaggaatccccctgtatccagactagcttatgatagaggaaaagcttcttagctcccagagttgaacaactgaagagcttctcacatggctggatccaggattcctttgggtcggttgcatctt

SEQ ID NO: 23016 - DNA, 1033 bp, Homo sapiens
tagtgcatgcctgtaatcccagctacttgggaggctgaggcaggagaatagcttgaacctgggaggcagaggttgcagtgagccaagatcacactactgcactccagcctgggtgacagagtgagactctgtccaaaaaaaaaaaaagaaaagaaaaggaaaaacttaaggattttttaaaaatcaaataaaaacaaataaaaaacaaataaaagtatatctggcaaaacctcgggaaaaaagaacttggaatgtgcctaaaggtccatccagccaaaaattgtaaaagcttttttatagtcattcttgagaaacaaaagtgggagcagcccaaccttggtgcccatcctccaagggtacaggctggaatttttgctaaatttgctgtttgggctgcattgtgagtagagtttggcatgcataaaatgaacattccctcttagtcccggttgtccatcctaatttctgggatggactccatctcagtatattccagtatattccaaccttctccttgaggtcctagaaactctattagcaaaacagcagaaactcaaactagctagatcaagattgactcataggcaggaggtctgtggaagacccagattctttccatctttgtgctcctcatggtcacaagatggctgcctcagccccagcctcacatctgtagaacagacagcaaatggggaaagggacaaaaggacatgttaatcaacatgagctggtaagtgacttgagaaggtggtctaaacaatatagtttagactatattatctgtactccagcctaggcaccagagtgagaatccatctcaataaaacaaacaaacaaacaaacaaaaaccttcaatggctcctttctccttattaaggatggccacatgttcttggtcttggtctggcatgcaatatactagagggtctggtccattgcaactacagctatttcctgtcacctattggccaaaacaggctactttgctcttccctgaactcagcttaggtgcctctgtgttatcagtatttcc

SEQ ID NO: 23017 - DNA, 1035 bp, Homo sapiens
catggtcatttataatttcccactgggaaagcatattatctgctttgttcactcatgtataccggcagctgagaacgggggttggccaagggccagatagtaaatattttcagctctcagggccatatggtctctgttggagctacttaactctgcctttgcagcgtgaaagcagggttagacgatgtactaaccaataaatgtggccatattccaataggatattatttgcaaaaacaggtggcctactggatttggctcccagcccactgtttgccaactccaggcttagagcattgcctgccacataataagaatagaggcaataaaagaagtcaaacatttggtcagtattttgtttctgcctcagctgttctgccactacctgggtgtacttgcaacaccgttctgacaccatcctcctccaaagttagcatcagacgccacaagtttaaggctcagccctccatgagatttcccttgcttcagacactggcagcatcttggggatcccccagccacccacacttctgactaactggctctaaattgggggattcccacaaactgtttgggtttcataatttactagaaggaactcacagaatgaaaataaacctggccaggtgtggtggctcatgcctgtaatcccagcactttgggaggccatggtgggaggctcacttgagcccagaggttcgagaccagcctggacaacatagtgagatcccatctctacaaaaatttaaaaacattagccaggtgagggggtgcatgcctgtagtcccaggtacttgaggggcttaagcaggaggatcgcttgagcccaggagttcgaggctgcagtgagctaagattgtgccagtgcaccccagcccgggtggcagagcaagatcttgtctcaaatttaaaaaccctgctatacaattacagttttattataaaggatacacatacggcaagatctgggagagttctagatgcagaatttccatattgcctcctcgtggcaacagcatgtatcaccctcttgac

SEQ ID NO: 23018 - DNA, 1019 bp, Homo sapiens
acgcagacacgggcacacacgcagacacacacacacgcccatcatggacacacacacacgctcgcccaccatggacacacacacactcccaccatggggacacacacacactcccaccatggggacacacacacacacacacacacacacacactctcactctggaaccgaccaatcctggggctgcacagacacacacgcgcacacactctctctcgttctctctctctctctctcgttctctctctctctcgctctctctcccactctggaaccgaccaatcctggggacacacacacacacacacacacactcccactctggaacctgccaatcacacacacacacacactcccactctggaacctgccaaacacacacacacactcccactctggaacctgccaaacacacacacacactcccactctggaacctgccaaacacacacacactcccactctggaatctgacacacacacacacacacacacccaaacacacacactcccactctggaacctgacacacacacacacacacacacacacacacccccactcccactctggaacctgccaatcctggggctgctctagcgaggagacccctgggaccccgcctccttccgggcctctgcgtgcgcagtatatctcctaagagatccgcagcatggagagggcccgcccccgtggacggactcactccctccccactcactcactcactcgcttactcactcactcactctctctccgaagagaagaagcctgcggctcccgaagcgggaaggccctctggtactctgttccctttctagcctctatatgcgccgtatgtctccaaagagctgcgcagttctattccaaaggcgtcatcgcgtgtggggcggtattgtcaggcaaggaaaaggggcgcttccccgcttcaaggacacgcgctcctgcggtcgtcgctgctgaccacgaagctgtcaaaagttcacctccttggctgcccccaacccctgcccctttgc

SEQ ID NO: 23019 - DNA, 1050 bp, Homo sapiens
atcatcatgcccagctaatttttaattttttatttattatttttttaaagagataaggtcttgctctgttgcccaggctggtcttgaactcctaggctccagcaatcctcccacctcagcctccaaagtgcagcctctatatcttgaactccacacctcaaacccagattgtccacatgtgagcacctgtctttttggtttgctgtttctctcgtgagttgtatccagttgcccaaggtggaaagttgggcgtcatccagcaggtaagtcctgacacctccacctccccgatggcttcagaagccagcctcttcttttctgtttcctctgcctctcaacttcctcatccatctaccataagccagaaaaatgacccccaaatgtgaatccgatggtgttctttctgcctgacatctttctttggcttctgctgtggggtaaagtccaagccccttggttccctgtctttcctctctggtctaatcttctattcctctcatcctgtactttgcccttcatcaactctgaactgtttatagttctctgaacatagcccgagtgattcacacatttgcatgtactgttcctctcctgctgtgataaagggacagtcacctaatccccgcccctccgttgcattttttttttcctacaagatttattatgcacctactgtgtgtatggctctgggatgctgtaataagcaagacagacacatctttcccttcacggggcgtatgtgtctcgtgcatactgggagggcagggacagggtctccattcatttctgcattccaatgccaagagggtgtcagatctgggtgggtcgaggtagggaacaggtaaacataactcacagtgtgatgccgtgttacagccaggctgggttcctcacgcctgtgatggcagcgctttggggagccaaagtgggaggattgcttgaagccaggagtttgagaccagcctaggcaacatagagagacccgctctcaaaaaaaaaaaaaaaaaaaaaagctgtcgcagtggcactctcctgtagtcctagctcctt

SEQ ID NO: 23020 - DNA, 1044 bp, Homo sapiens
aaccccaactctactaaaaataaaaaattaaaaaaaaaaattagttgggcatggtgctgggcacctgtaatcccagctactcaggaggctgaggcaggagaattgcttgaacccgggaggcagagattgcagtgagccgggagcctgtaatcccagctactcaggaggctgaggcaggagaattgcttgaacccgggaggcagagattgcagtgagccgggagcctgtaatcccagctactcaggaggctgaggcaggagaattccttgaacctgggaggcagagattgcagtgagccaagatcacaccactgcactccagcctgggtgacaagagtgaaactccatctgaaataaaataaaatataaaagttaaagcagtcatcctggcttttaggaacccgcagaatcaggaggtaagctaaaagtcgtctcccttttgtcacgatggaatgtgaaataggtgcattttccttctgacttatgattctgtttcacggtgcctctgcagaaattcagtacgtccccatgggcacctgtgtccttcaggagttgaggaaattttctccattccttgtccctgtccctagactctgccagctcgtgcatgtagaagctcccgggaaaactgtcaacctgtgcacattcaagaccgccatatacttgttattgaaaagccatcagtcatgtgagcagaacttttttatggttgagattgtccccagggaaacccgccttgcaattcagaccttccacggagatcgattccaaactctcatcccgttcccacttcctcgttcccatggaggctgcggttctctctctctgtgccgcttacagattgtcatacctatttccaaaaatgacacagaaaacttcaacgtgtggctaaatttgaacagagaaaaataagcaaagaattcaaggcgcgaggcgttttcagggagagagggagagcttttgcatggtttgaagggatgatctttaatgagttgagggtcacctagaatagaattaaactgtagagagcaaattgttggaaatg

SEQ ID NO: 23021 - DNA, 1068 bp, Homo sapiens
ccgggacggggtttctccacctggggcctgcggatactggggctggattgttctctggggtggggccgtcctgggcactgagggtgctagcagcatccctggcttccacccattccatgcctggagcgccgcccccgaggcatggcaaacacaaatgtctccagacactgccaggtgtctcctggtgggcagaatcgcctccatttgaggacccctggaccagggtgctggaatgggggtgaggggcactctgcaattattctctgctctttttttgaggggggggaaatggaaaccaagagcccatcatcagcctcgtggctctgtggtttgacactgccatgctaccgacaaaaaccacgtccctagacttgggggaccaaggaatctggaggaatatgatgatagtcatttaatgaaggtgggtttatgtattactcaagtgctgggctggggagtcaggacatagccacagggaagaaaacagaaaggtccttccctcttggaagcccctcttgaaacacctaattggtgacatggtacactggagaatcagagagtgtcactcaagcattttggcttggtggtggggcgggggtggcgggtcaggcactcaagcacccctaagctgatctggagaaagtgtcggggaaggggaacattagcgtttctccctgaggaatcatcttacacctataacggcaactggcccacagtaacattgatggagcaagtgtcttcttgtggctcggccgctcaatagctgtgtgaccatgggcaggttactgaacctctctgtgcctcagtcttctcctctgtaaaatgggaacatctaggattgttgggggaaataaatggttaataattggaatagtgctgggtgcataggaaactctaagtgttacacagcatgtggccacaacctcccctctcccctcctctctcctctttgctgctgccctgctgccttaatgggatactcccctctctgtctctgtctgtctgtctgtctgtctgtctctctctcatccccttttctttcctctgttcccccacccccacctctga

SEQ ID NO: 23022 - DNA, 1977 bp, Homo sapiens
aagaaaaagggaagcaaaggaaaaggaaaacacagacccagaggccctttatggggttgattgtatgtgaagtccataaattgatggagagaaggagcaccttggcagtatttacttgtactctcctatgtcatggatttcctctccattttcccaagggttctttcctgttcttagaaatgttttgtgattttgcttcagacacagtttgtctacttcttgtaagcattgttcttagattgctggctttatatctatcactcccttgctcatctgcccatccatctatccatccatccatccatccatccatccatccatctatccatccatccatccatccatccatccatcatccctccatccacttgctcatctgcccatccatccatccatctatccattcatccagtccattcaccacccaccatctattatccatccatccatccatccattcatccactcacccattcatccatcatccatccactcacccatccattcattcagtcacccttcatccattcactcacccatccatccatccactcatccaatcacccatccatccatacatccactcatccattcatccatccatacatccactcatccattcatccatccatccacccacccagacgtccatccatccatccatccatccatccttctgtctactctgccaacaatccacacacctgtccctccatcccttccaaccactcacccagcaatcttctcatccatctatccacccatgcatacatccacttattcattcatccatccctccacccacccattcatccacccatccatgtgtccattcatctctccatctatccgtgtgtctatcatctaatataagggagatgttttgaagtattaaaagtgattattttgtagcataggggacagggattgtgttttctttacttactgctaccttattaaatgcttactagttctaaaagccctgcaattgattcccttcaattttccaactctataattgcagcatctgcagataatgatgacttcttgccttttgccaataattagaccagttattgctgttaaccttgttatggcaggaacttccagaacagtgttcagtgacgcagctgaatatggtcagcccagtctcatttctgatttgagtggaatgcctcaattgttttactgcagaggataattatataattgttaatactcttgaccttcctgtctttagcctcactgagtaaatggggtgtgatcatgaaatcttgattgtctcatagatgcaagagacataaacgacatttgtctgtgtataatgacagcagatttattttgctaagctgttaagctgttaaaataagcctttaagcccccgcctcaattttccagcagagtggaatgttattttgttgcttctggccaagtgtcgatattcattttagggcaggtcttcatggaaagtctgctggactataggtctggatacttgccggaccctgtgtcatcactaaagttagggtgcgtttcagaaccaccctgtaccacagtgaagagggacaaatggccttagggagcaggacccatgggggccctctggggctgtttcttgtgccctgagagaggccctagatttgggacagtctgatttacctcccctcccttttttttttctgggtgatgctaccctggtttctgtgttgaaatatgaccctagtgtgaaggtcgcggtctcagaccatcttgtttctggtatgttaagaaacagaaaaacaccttttaggacacaatgttaaccattgaggatacatatcagtgttctggaaaaacaaaaacaaaaacaaaacaatctgtaccgcgactgtggttttcatcagggtgggctgcctttccgatccataaccctgtgtggcttgatggagaacatgttttgtaacttgcaagggcatctgcaatagccgggtcctcttg

SEQ ID NO: 23023 - DNA, 1052 bp, Homo sapiens
taaaaaaaaaaaaaaaaacaaaataaaataaaaagtgaataagtgaaagtaataaaatgtaagatacagttggagttctctttgtcatcttcccttgctatattctcctcccttcttcccagaggtaacaactctcttaggtttggtacataaacttccagccctgcatgtattttgacacataaccttgtacacacgtcaatgccagatacaggttcagtatcccttattcaaaatgcttgggaccagaagtgtttcccacttgggattttagaatatgtgcgtatatgtaatgagatactgtggggctgagaacgaggtctaaacgttaaattcatttatgtttcatgtacatcttatacacatagcctggaggtaattgtatacaatattttcagtaatattgtgcgggaaacaaggttttcaccgccctgactgtgacctgtcacaagaggtcaggaatggaattttcttccactgctatcatgtcggcgctcaaaaagttgaattttggagcatttaggattttggattttcgggccaggaaattttggagcatttaagattttggattttgggttatcttcagttgttctttaaatctatttatttatttatttgtatttgacaacgagtttcactcttgtcaccctggctggagtgcaatggcgcaatcttggcttactgcaacctccgccttgcctcaagcaattctgctctctagtggctcagattacaggtgtgcaccaccacgcctggctaatttatgtatttttgtagagatggggtttcaccatgttggcctggctggtctcaaactcccgacttcaggtaatccacctgcctcagcctcccaaagtgctgggattacaggcatgagccaccacgcctggcataaatctttctttaaatctttcgctgctgtaataaaatatacatcataaaatttgccatcttatttatttttcagtatacagttcactggtgttaaacactgccatttatattgtaatacacttttgagtattctaaatatctgcatatattgggaa

SEQ ID NO: 23024 - DNA, 1079 bp, Homo sapiens
gctggcagcccaggtccttcagtgatctgtttctctcaatgcgcctgtgtcagatagaaccgtgcatttcccagtaaaaggaggtgatgtgtgtgctggagtttcaagattgtaccccttatcctatctcccctttcctctgtcttccctctctacttttttattttgttgtttgtttgtttgtttttgagatggggtcttgctctgtcacccaggctgcagtgcagtggtgcgatcatagctcactgcagcctcagccttttgggctcaagcaatcctccagcctcagcctggccagtagctggaactatgggtgcatgccaccacgcccagctaattttatttacttatttacttatttattaaagagatggagtcttgctatgtttcccaggcagctcacaaattcctgtcctcaagtgaccctctcgcttcagcctcccccattagctaagactacaggtgcgcaccaccatccctggctaatttattttttaaatttttctttttgtagagatggggattttgctatgttgcccaggctggtcttgaactcttagactcaagcaatcctcccactttgggaagcccaaagtgttaggattacaggtgtcagccaccaggccgacctgtttgctcatttttccttttccttttttcttttcttttcttttttctttttttttttgagatggagtttcgctctgtcacccaggctggagcacagtgacacaatctcggctcactgcaacctctgcctcccaggttcaagcgattctcctacctcagcctcctgagtgctgggattacaggggcatgccaccacgcccggctgatttttgtattttttagtgaagacggggtttcaccaggttggccaggctagtctcaaactcctggcctcaaatgatccaccagcctcagcctcccaaagtgttgggatgacaggcgtgagccaccacactcggcccgtttgctcatttttaaacataaatgatgtcaagagtgggaagcaaacaagaaagtgttgaaagcattgctctcctctgctccctggttacctatcatcctggggcccg

SEQ ID NO: 23025 - DNA, 1050 bp, Homo sapiens
gggccaaaaaatgattgttttttgaactgttgcccctgtctttgagagcaactcagcttcagctttctttcccctcttcaatttcttgtattgtgataaaatacacatagaataaatttttcatcttaactttttttttttttgagatggagtcttgctctgccacctaggctggggggcagtggtgtgatctcagctcactgcaacctccgcctcctggattcaaatgattctcctgcctcagccttccgagtgactgggacttataggcaccagccaccatgcccggctaagttttgtattttcaggacagagggggctttgccatgttggccaggatggtctcaaacccctggcctcgagcaatacacccacctcagcctcgcaaagtgctgggattacaggtgagtgccaccgcgcctggccccatcttaaccattttaagtccacagttttcagtggcattaagcacgttcacgtggttttgcaaccatcaccaccaccatctcccaaactttctcatcctcccaaactgaaactctgtccccatgaaacactcactccaccatctccctctcccagccccctggcacctaccatcctattttctgtctctatgaatgtgatgactgtagggacctcctgtgagtggaatcagacgggatttatccttttgtgcctggcttatttcactgagcatgttgtcctcaaggttcatccacgtggtagcctgtgtcggaaattctttcctttttaaggctgaatcatgttccattgtatggagggagcacattttgcctgtgtattcatccatctacgggcacttggtcgctttcacatttctgccattgtgaatcagggccactgctgttgacgcatctagcttttcaatgcctgcattaaccttgttgctgaggctttaggaaacttatttatttatttattttttgagacggagttttgctctcgtcgcccaggctggattgcaatggtgcgatctcagctcactgcaacctctgcctcccgggttcaagcgattctcctgcctca

SEQ ID NO: 23026 - DNA, 1029 bp, Homo sapiens
cttggcttcccaaagaactgggattacaagtgtgagccacggtgcccggcccatttctttacattctttgcacttgtaattgtcactctttttggttttagctatcctagtggggataaagtggtatctcactgtggtttgaatttgtatttctctaatgtccaacagccagttaatctttcctttttttctgttttttttttgagacagagtcttgctccatcgcccaggctggagtgcagtggtgtgatctcggctcactgcaagctccgcctcccgggttcatgccattctcctgcctcggcctcccaaatagttgccactacgggtgcccgccaccacgcctggctaatttttttgtattttttagtagagacggagtttcaccgtgttaaccaggatggttttgatctcctgacctcgtgatcagcccatcttggcctcccaaagtgctgggattacagccatgagctggccaccacgcccagccgttgtgtttttttaatcgagacgaggtctcactctgttgcccaagctggagtgcagtggtgtgatcacagctcactgtaacctcctattcctggacccaagtgatcctcctgtctcagcctcccaagtagctggaattacaaccacatgccaccatgcctggatatttaattattattattattttttagagttggggtcttgctatgttgcccaggctgactttaaactcctggcttcaatcgatcctctcactgtggcctcccaaactgctgggattacaggcatgagccactgtgcccagccctagttaacctttgaatgcatattcatgtctgattttggttctgccatagcctggggaggatggcggccaagtgttctttctacctgcagtgtgtgtgtgtgtgtgtgtgtgtgtgtgtgtgtgtgtgtgagagagagagagagagagagagaaatgaaatatagtgtgggactcagggttgagaagcccagggctatggccaaatctaagattaggatgccagccaggcatgg

SEQ ID NO: 23027 - DNA, 1051 bp, Homo sapiens
gtacctgggcatccagaaaaatggtggtgatggcgcgactctcgcggcccgagcggccggaccttgtcttcgtgagtccacagaggagccgggggtggcctgcgttggggcattgggacctggacgccgcaggggatcgaggctgggtcggcaaggagatttaggccgaaactgccaggccaaggtctgggaaccctaatgggccagagaccggatcgtcatgtccgcaccgaactgtccaggagtaaaaatatggtgttgtatcttcgggtctgagtagaaaaccactgtcgaagggaagcgtctagcctcccgaaccaggggcggaaatgggggcgtgcagggaatgggagaggaggaagatcgcataactgaaccttgagaggtgaagatcggtgtctgaagtaaaggcttgcttacgaggccagggttctggtttctgggatgaaggcttggttttctggatagcggtctctaggcctggactgcagcatgacagtttctggggtggtggccaggctagaagaaccctggtgatgtggagcttgtcaggcgatggccagtgaaatacttactctctggagtagaggcgtgacatcttcaccagattcttggtgtgcagagttaaaggcttggcttctggtgtataactcctcctgtgagataaaggcctagcttttaatttctggggcagagttgagctagacgctggctagtgggatcctgggggcggggctagtggcttggaatctggacctgagagccctggtggctggggtaaagatctggtcatctgggcctggggtggagatgggtcagatggtgacagtgggagtctgaggggccaaaggcctggtgtctgggaagaggcacgttttgaagaagtggggtctggtgtccaggactggcatctgggccagggccttggtatctaaggagtctgaccatctggggcagaaagcgagtggtgatgcggactcattcctggcccagagccctaatgactgagaagtctgatgatttgggttcgattttgggtagttgaattctg

SEQ ID NO: 23028 - DNA, 1049 bp, Homo sapiens
tgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcggggccaggactgcgctcaggatcccgccccggagcccccagcccgggggagagggggagggagttgggagaagcccagcccctccccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtttatagcctgtctcctcttcgggatcgtgagaatgagccaggccctgttagcatcccta

SEQ ID NO: 23029 - DNA, 1026 bp, Homo sapiens
ggggttgagggtgacactgggggctggtcagtgacagaggcagcctcaggctgaggacagatcctagaagaggcgtttgatctcaggccaagattcagagtgcggcgaatatggaagtattaaagatcagccaaggggccgccagcttagccctgggagtagatttgggattttgttccaagagaatcacccactttgctgattaatcctgttttcattgggtcatctggatagagtgttgttcccaggagtgggaagcgtgtgatctgggccagtaagtgggtggcacctgcctccccacttggacctgggttcttggcctctgccattgctggctggcggcagggcacctgggcgccagggtgtgtgggcagcagctctgtgtggcgtggtgcccaccctgggtggcatcacgcaggcgtgtcggcctctcattgcagacttacagccagctggcccaccccatccagcaggccaaggcactgggtctccagttccattctcgcatcctagacattgacaacgtcgacgtaagcacctcgcagtgggggcccgggccaccatcgggggtgggaactatggcccagacaaggcccaggaggtggccttgccaggggctgggggccatgggctgatccaagaggtcttgggcttgtccaaggggagggtctcgagggaggcctggtcctggcctgagaggcaaggcccacggggagggaccggtgctgggcctggtgctggagccttctcctagcagggcctaggcgcaggggtttcacctccaggggagcagccgggctgtcctctgaggcacatcccccctctcggcccctctgcagctggccatgggcaagatgatggagcaggggccggtgctgatcatcaccttccaggcacagctggtgatggtggtcaggaaccccaaaggcgaggtggtggagggtgacccggtgagtgagggagtgggatggggcaggcacatgacaccgcctgtccccaagatctgtgtgtggccacctggcagag

SEQ ID NO: 23030 - DNA, 1061 bp, Homo sapiens
ctgggcctcctgttctcaggaggtagctgccaagcggggacccgagtctgccggccttctgagcaaggagctcaccgctgctgagaccctcaatccaagccatgtgggcagccgggggccctggaggcagcacatgctggcaggtgcggggagggaggggctgcggagaagatgcttcttggacctttggctgtaagagaaatgtcactgccgtgtcagaacatacagacttaaagacacaacggttggccaggcacagtggctcacacctataatcccagcactttgggaggccgaggcgggtggatcacttgaggtcagaagtttgagaccagcctggccaacgtggtaaaaccctgtctctactgaaaatacaaaaattagccaggcatggtggtgggccctgtagtcccagctactcgggaggctggggcaggaaaatcgcttgaatctggcaggaggaagttgcagtgagccgagagcgtgccactgtactccagcctcggcaacggagacattgtctcaaaaaaaaaaaaaaaaaaaaggacacagcgctctttacctagaaaaccatcgagtcagaaaccgtgcggacgagcgaggtgctacggaagaagcttggggagctgacgggcaccgtgaaggaggtaacagttccacgcccgcctggagccgctggggccatcaaagtcccctggccgctggaggctggaggaagagtcggctcctgggtgggggtggcttggcagcagtgggtggcatggggcgtgctgccaccctcgggaaggtttcaggagttcccggcacatgcagggtgaggtcagactggcaaccttgcatgaccgttgacccagggagtcggcagcagtaagtgctgctagccaggactcgaggagaacatgaaaatgtttttcctgcctaaaaataggaggagaggggccgcttccaccccctcccgagggtagaggcgggaggcaggattcctggggtgctgcggctctcctcggttgtctgttctgtccagctttgcgcagcatggggcgccctcaccgccgttcttt

SEQ ID NO: 23031 - DNA, 1021 bp, Homo sapiens
tatttttagtagagatgggggttcaccatgttagccaggatggtcttgatcccctgacctcatgatttgcccatctcggcctcccacagtgctgagcgcagtggcacacgcctgtaatcccagcaatttgggaggccaaggcaggtggatcacgaggtcaggactcgagactagcacggccaagatggtgaaaccccgtctctactaaaaatacaaaaattatccgggtatggtggcgggcgcctgtagtcccagctactcgggaggctgaggcaggagaatgccatgaacctgggaggtggagcttgcagtgagccgagatcacgccactgcactccagcctgggtgacagactgagactcagtctcaaaacaacgacaacaacaaaaaattgttttttagagatggaggtctcgagggggcatggtggctcatgcctgtaatcccagcattttgggaggctgaggtgggaggatcacctgaggttcaggagttcgagaccagcctgaccaatatggagaaaccccgtctctactaagaacacaaaattagctgggtgtggtggcacatgcctgtaatcccagctacttgggaggctgaggcaggagaatcacttgaacctgggaagcagaggctgcggtgagccaagatcgcgccattgcactccagcctgcgcaacaagagtaaaactccatctcaaaaaaaaaaaggccgggtgtggtggctcacgcctgtaatcccagcactttgggaggccgaggcaagcggatcacgaggtcaggaaatcgagtccatcctggctaacatggtgaaaccctgtctctactaaaaatacaaaaaattagctgggtgtggtggcaggcacatgtagtcccagctactcgggaggctaaggcaggagaatggtgtgaacctgggaggcggagcttgcagtgagccaagatcgtgccactgcactccagcctgggcgacagagtgagactctgtctcaaaacaacaaaaaaagagatggaggtctcat

SEQ ID NO: 23032 - DNA, 1029 bp, Homo sapiens
agacctacctcacctactaggacctgaggcagctccttagcagagacccctggggtttagctgactctgggggtcaggggttcctgtccccaaacttcgcaagacagccctgaagtcacaagtgctttcttttaagtggcattggcaattggcgtgtaatgatggcagtagaatctgaatctcggatcccaggcagggttcacatttccaaacctttttgatttcccctgacctctaatggctggatcctatttttctacaacctttcagtgacatcgttcaggtttctttcttggccatttaaaaaaacaaattttttttttctcacttgtaagtcaccgccagtacctaagttaggctaacggagactttgacaggactggatttttcttccaccagaagagaagccttttccgttggtttggggccacctctttgaccatgaccatgtgatgttccgtttacagtgacttgctttgggggaggggaggctctcttaaccgattcccatgttgtacagtagatggttagaccttttgtatattagtgtgttttaagttattgatttgttttatataaaataatttatttttcaggtgccatttttcattttaactttgtttttacatgggtttgttttcaataaagtctgacactggtgtccaaaagtcaacaataaaatgaatcccattgtgttcttttgaagatgcctatgtaacttttaagctttttaaattattttcagaaaaaaaaaaagaaaagcccttatcagttttccatcagcccattgcctttttattttttttttttaatccttgtgaataaatgttctttagtgttttaggaggaaaaagcaaacctagattttgataacccagaagacttcagattaataaagaagctttgaaagaagaccatttttcaaaattttagtgaagtgtgaatattttttgtcaatggctttctcaaagagaatgaaacttttgcaccattttcagagtttttatagagatgccaaattgatatatt

SEQ ID NO: 23033 - DNA, 1052 bp, Homo sapiens
gctgggacaggtgagaagaaactgtgaagtatatgagcctttgaaagttccctgaagtttctcagttcaggaacattctcattgtatgtggtctccgctgtttgaacagccttctagctaaaaaattccaaagcctttatttgggagtcttagcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgcctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagac

SEQ ID NO: 23034 - DNA, 1432 bp, Homo sapiens
catgataaggggaaggtgcaaaatttggaaaaaggagttcagcccctgcacgtaccccacagtacgaggagagtttcctccagggagaactgaggctgtcagaggcctgcagagcatttctaccttcaacggaggaccaggagaagcgcccatcatctaaaatgtggggaaccgcaggaacccctaaacagaaaccccgacatacacagtgggaggagtggagggcaccaaccagcccctcagagtcagctccctacagaacagggtcccgcccctccactactgtatttaattcctcccagggttttgacccatgcaggtgtctcaaccgtgagcacctcgtggctgcgcagagcgggatggggcccagcggccatggtcagcatgcgtccaggccttgccccatccccaggccgcctgcgctgaccgtggcctgacgcttgctctctgtctgccaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcg

SEQ ID NO: 23035 - DNA, 1050 bp, Homo sapiens
cagctaaatagtgacggtggatgtgctgtttcctaatgttgctttcttccaaataagaggcctgggtgtctattggggatgtctgtcaccaaaatatctttgggcgccaacactgtggagtcatggcttcagccgggaagaaagtctgaagctttaatcttctgttagtcattggttttctttactccatccatttgttttcacttttaggtttaatttttgtttatttccttaaccagacttctagcctggcccacagtagactgacctgacttttgcttttcagttttgaaagtcctagcgtttttccccctaactccgtttttgttgatttgttgaaaaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggtgggtcgggagggtgcgcgctcctgaaagccatacttagccccgctggcaggcgacggcacagccacagaatagaaaccacggggatgatagactgatcccgtcagagagcgcgtttcagaatcattctgcagctccacaccacaacctccatcagaaaggtgtctgtaggaaagccgtttacttccgattgggcgttgtctttcatgggaatcaaaacagtgactccaggctggacacagtgacttatccctgtaatcctagcaccttgggtggctgagagaggaagatcgattgagcccaggagttcaagaccaacctgggcaatattgcgagaccccatctctacaaaaaatacaaagctggccaggcatggcggtgcgctcctgtagttgcagcaactcaggaagctgaggtgggaggattgcttgagcccaggaggttgaggctgcagtgagttgtgatcataccactgcactcc

SEQ ID NO: 23036 - DNA, 1045 bp, Homo sapiens
agcctcatggggacgtgacagccctaagtaatttctccccaggtctccccgaggctccctgggcctggctcctctagcagttcccccggcgcagccctggggtcctctgtgctccaagtgtgttcattccgcaaacctttactgagcccctggccagtgtggtgctgggccagatacgttgatactgagggacttcggatcccctgccatccccagtttaaaggtgactgatctgtgcagtgtgataagggcctggatggagttgtgcgttcaactgatcctggattttattgcatcttggtctgatgccacctggtgtcctgcagttctattctgacaccagtcacccagagttagcacagccccagcacatttaaggccacggtccccaacaagaccgccctcacctcagatgccagtcaccctttgggggaccccaggcccctgcacttttgaccagctggctacaaattcagggttcccgccaccccttcagggtgcatgactcactagaatgactcctggaactcacacttctgatgacagtttgtttataaaggttgcaactcagggcctgccaaatgaagagccacacagggagggtcccaagcacagagctcacatgtctgcacctggtgggatcaggtgcctagtcctccctgcatgtgacctgtgcacctgccaggaggctccgtggagctttggtgtctgccgtgtttactgggctcattacgaatgcatgaccgattgactctttggccatgtgatcgaactccatccccagcacccctttcccctcccccaccctggaggtcaggccggtatcgcccagctcacagccccagccgtctagtcacatgcttggtctttctggtgtcggagcccatcctgagccatcacttagcacaaactcaagtgggatccaaggccttatggtaacaaagacagaaattccaggagttttacaagcttcctcctaggaatctgggacagagaccagacaaatcctttatgacaatacgggctagggccaagccctctgcca

SEQ ID NO: 23037 - DNA, 1052 bp, Homo sapiens
tcacatctgtaatcccaacactttgggaggtcgaggtggggccgaggtgggaggattgcttgagcccagaagttttagaccagcctgggtgacatagtgagaccccatctctaaaaataattttaacaattagcttgggcctgctggagcgggcctgtagtcccagatactctggaggctgaggtgggaggctgtcttgagcccaagaatttgaggtggcggtgagctgtgatcacagcgctggactccaccctgggtgacagagcaagatcctatctctttaaaaaaaaaaaaaaaaaggaacctgtgttcattgcagaaaatgtacgtgtttgccaaagaaaataaagtttgctagcacctgtaatcccatttcccaaaggccaggcagatatagtgcttcccgacctccctgtccctcactcgcagacggttggcttaccaatgtcttcatgttctcttgcacaggacacagcttgggctatggctttgtgaactacgtgaccgcgaaggatgcagagagagcgatcaacacgctgaacggcttgaggctccagtcaaaaaccattaaggtaaagggatctgatcaccaccgcatccattcctgccctgggcacaggtctgtgctgagccccgcccagcctcacagtcactctccaagggactatgagcacagccgctcctcgggggctcccatcagataccctggtcaggtgtatctgacccaggccttacatgagtgtctcaggacccactccccgcccagggtgcccccaggttgcgtcagctcccaggcctcccctgtcgtctctcctgcctggctctctgtgttcccatccctggacagctccatccacccccagcctgcccagtgctccctctgcgctccttggggccagttgtaacccttccctcacccagcacctcactcagcacctactgtgtgccccacagtgaccaaaacagacaaattcagtgcccccgtgggtcgggggtgcagacagtaaacaagacagaggatagccatgtgtgaccggcagttgccgtgtgtg

SEQ ID NO: 23038 - DNA, 1047 bp, Homo sapiens
ctgagtctcttagccctgaggagttttattagaaatacgagtctagaggatctgattttggttttgttctttaggaaagagagcgccccatgcagaactaactgcacgtcatttctatagctgctacgtcagggccatgccttaagtgtgggctgggcgtcctgacttccttccgcggagggcagtgtggaaaggggtgggagtcactttacagccaagaaacctggcaaactgactgcctcggcccagtgatcacggtcagcaccagcagccataagtcacgttgacggcctgtgcccttgacatcgtgtgacgagaagggcgctccagctgtgacagactccagcaaacccaatcgagagtctacgggatgtccgaccagtcctcaaaaccgtcacagtcacgagaaacaagaaactgtcatagtcgagaggagcctgaggggatgtgactgctaaatgtcacgtgggatcctggatgaggtcctggggcaggaaagaacatgagggaaagactaaggaagcggctggggcgtggactagaggtaatgggaacattcatcgtcaccagcatttcatactcacttgcggtggtacccataggggaaactgggagggggccatatgggaacttggtattatccttgtaatttttctgtaaacctaaaactgttctgaaaaataaaattcattttaaaaagaaagtggcaaacctgggttaggctctctgctggatttgtaatcttgctgtcggtgagatggatctggatgtccctggcccagctgccaggaggatctctgcctcagtggggctccaggccacctcctgttcggtgacctgctcgttgtcgcgctctgccggctgggggaatggagcagtgctgggtgaggctcaggcccacagcagatgttcagcagccttgcaagtgcatggataagctgcgggagacggggattgcgctcttccctgtgcctcctcacttcccctttagtgagagcatttggccaaatgtcctgtgaagctccttctgaaccctgaccccagagg

SEQ ID NO: 23039 - DNA, 1082 bp, Homo sapiens
ctggttgagtgccagccatgggctgggcactggtggcgggaggaaggaggggcgtgatgatggctgggaggaagggactgccccatgtgctgctctcaagactcggaatgtttctggctggcctggccctggtccctatgttggggatatggcgttggttggttgttggctgttccacccacaaacaccagctaaggaggccactgcagcgcccggtggtcctgcccgctgccttcctgggcagccctgccccagtgtctggtctctccacagtggccccatatgtccctcgggggatcagaaggagtcagccctctaccctcatggatgacctgtcatgccggagccaccaggctgcagccccattcacggcttctgtcttgctgtatatctctggtcgggttaaagcccacaccgctgcccaaggctttaaccacatcccggaggagggggtgtcccaagagggtagggacacccctgggcgcctgccccctctccccacttgctgcaccctcccccccccccggcaccccccggtcaggctctactcttgggcgcttgtgattctctgaacactgttccctctgcaggaatgtccttccggactttcccagcctgatggcttttttcttaatatgagtcatgtttgctcctcacagaaaaaaaaacttaagcatgagccaagcagaaacaaacaaacaaaaaatcacccacaatcataccgctgttagcttttgggcacatgtccctccaaatgattttctttacgtattcatggccataagcagccacgtacttctacagaatgggctcttctctcaggctgtggataaacttcccttcctgtatctggacatttttccacttcgctgaacatctcgcgatcccatcatcatcggtcgcatagtattctgcttcccatttgttgatatttgaaagccctgctgacataaatgtcctggcacaaatctttgctcactggttatttccatagaaagtcttcctgccggtgaagcggcagatgggagagcgcaccttttaaaggctcttggtccctgtcgctaactcgctctctaggggac

SEQ ID NO: 23040 - DNA, 1049 bp, Homo sapiens
gctgtaaacatccatgtgcagatttttgtgtggctgtaagttaacatgcagcatagaaaagaatctctaagtgcagggccaggtgctgtggctcatgcctctaatcccagcactttgggaggccgaggcaggtggatcacctgagttcaggagtttgagaccagcctggccaacacgacgaaaccccgtctctactaaaaatacaaaaattagctgggcatggtggcagacgcctgtaatcccagctactcaggaggctgaggtaggagaatcacttgaacctgggacgcagaggttgcagtaagccgagattgtgccactgcactccagcctgggtgacagagtgagactctgtctcaaaaacaaaacaaaaaaaaaaaaaaagaaagaaagaaaatctctaagtgcaaatgcagttactagttttgccttcatatactgcaatatgaacattttgaatttacttgctctttttctcttggcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggtaaagaaatggaggcgttttagtaaaccgggtattggtggccatcctttgggcactgtctcctttgcctgtgactctgtggcattcctcagtgcaggataactacagccttgaaacgatggctgtgaagtttcatttttatttcaaactctgtccattgctcttgtataagatcggacataagttcccaaaagaggaaaaattcattgtaagacagagagcatgtacaaaataagacagtgggaggagaggaaggaaccagagacagggcattctgagagctggaaggggctggagaaccacagcctgacctggcttggcctgggcagattgattgggtcccacgtgtggaagggaccctggcgagtgtactgtc

SEQ ID NO: 23041 - DNA, 1033 bp, Homo sapiens
gcggggcgcccgcgggcctgcaccggccgaggcccaggccgcgccggaccgggggaggggacgcgcgctggggccgcggcgggcgggtcggggcgggccggtgtgggcgccggctacaggccccggggccggattcctctggcgcctcgagggacgggcgagggggatacggcgtgggcatgcgccggggggccgggctgcacggccgggggccccggtcgccttggaagcccgggctccgggggcgggagagtggggccagctacgggggagcgccgggaacgctttgagcgcgcagaggtcacggcccacgggcttgctcccccgggaaatcccacagattcttttgtggtcgttgtcagagcaccgcggccggtgcgaggtcctttgagaagtgtgcaaacccttcagtagatacacgggagtcctgggggaaaaaaaaaatctaaactgcatctttttttgagcgccatctctaacaaagctgtttgtggggcgtgggacgttaggatttgtaaaatatgtgtgtgtgcctgttggaaacacaagctgcacacagttgaacaatgggggatggatgcccttccttccttttccggtgctctgggctgcggggcttgttaaaatgggttttggtccctactgtgtgcagggcaggtggagaagaacttctgcacaacttctgcatgggcttcccgtggtgggactgagcccccttgctagaaagtgttcatctaagatccggatggccagaaatgggaagatgaggagaatgatctgtctagagcagggtttctcgacgttggccctactgatgtttggggtcagatagtttttggttgtggtggtagtgggggcttccctgtgcaatgtaggaagttgagccgtattcctggcctctacccactagatgccagcagtatccccatgctccaagtcgtgaggatcaaaagtatctccaaacattgccagatggctcgggttgcgggggaggggtctcttccactctcacacgcacaggtgagaaccatta

SEQ ID NO: 23042 - DNA, 1024 bp, Homo sapiens
ccctgcccccaaattcgggcccccacctcaccctggccagcttgataggctgcacacggctggtgtccatgatggcggcgcggcggcggtctggcggagaggagtcacgtgcttcggggagagcctttataggacgttctagcaccgcccactcccgtctcgcgataccacgccgcgtctttcccagcagccccagcggtggagacgtcaccggctgcgcccttcagtatcgcggacggaagatggcgtccgccacccgtctcatccagcggctgcggaactgggcgtccggggtgcgcggggcggacagggctgcaccatggggggcttcgggctccgtgtgtccgggacccgctcctgctcctcacctccctcctaagccgggacccttcgctctccccgaatctccctgggaacccccagctagtcaccccttcagcccgggaccctctcctggcctgggaaccactcaggcctgggatttccccagtccccgaccttcttagccttggatctgtgggcccggactctggctttgctcttcacctgcaggacccacatccgtttccccgagtgttcatcccctgccttcccttaaaatgcgcatccccggaccatccctggtcccttgccctctcctttcctctctcctggggtgccttgcaggccgacctctcctctcctcttcccacagcatgacctgcaggggaagctgcagctacgctaccaggagatctccaagcggtgagcaggccccgctcgctgcccagcctctggctctgtcctttctccaccaaaaacgaaatctgtgttcctttagacccctgaaacggagggctgacatcctgccaccagtcccctgccaggctgtggaggcagaggtttgcctttaaccttgctgaactccggaggacagccctcctgaaacagcgaggccgggcgtgcattctgactggcaatcaggctagatttgcagtgctcagcgtggccatgttagtcagtgttatccccaagctacagatga

SEQ ID NO: 23043 - DNA, 1062 bp, Homo sapiens
actgtttagtgtaaaaacaacactcttcccctaagaaggtgcagagtcctcctttctcagcagtgaggaggtctaggcctcagtggttttggagagttgctgctgccaaagagtatatttgggattgtagagtaaggatagattttgttatttcttacaaactgtctgagaaatcctttgaaggtgtatggtagtagaataatgaagtggataaactggctattccggttcctgtagcagtagccattcctaaccctataagtagggatattagttgtatggccctgcgctgatagacttgagctttgaggggcacagatacggtctgatttccataagattagaagttaggataatacatgttacactgttaacttttttagcaaactttacttttgttgaaaaccttgtaagtttgggatttcaattattctttgctattagtaagaccttgttcagtccatattaacttagaattggtatagatggctgcttcctgattctgtaagtactttaagatttggctgagtggaaacaactggcatgtttgagcagaccaattattaggcaattttcctaactctgcatctacaagagtttccttatcacttactgaatacccattgtgtctttttcccttaatcgcctgggaggaaccatctatcatcctgtcctgaagggagttcctcctagatctggtcagacctttgtatggtaattaattaagatttagatctcctgttaggaaacctgctgggttaaggatttttgataggaaggctacaggttgtcagtggcctcagtgctttccggctatgcccttgtttacactgacaacaaggtggtattggagtgttataaggttacagagaagaccttcaattatcaattataggttttaaatttacgctagggtacacttttttttttttactacttctatctccttttctctttgacttcttctttgtctctgtctcttcctctctgtctccttctctttgtctctctgtttcttcctctcttctctctttctctgacttcctgtctctttctctcttt

SEQ ID NO: 23044 - DNA, 1048 bp, Homo sapiens
accactgtgcccggctacaaaattcttttaattaggcgggtgtggtggtgtacacctgtagttccagctgctcgagaggctgagaggcaggaggatcccttgagcccaggaggtcaaggctgcagtaacctatgatcgcaccactgcactccaacctgggtgacagagtgagatcctgtctgaaaaaaaaaaaaagctggccaggctcataccggtgctcccagcactttgggaggctgaggcaagaggatcacttgagcccaggagtttgagaccagcctgagcaacttaaggagacccccaactctacaaaaaaaaaaaaaaaaaaaaaaaggttttttagttagccaggtgtggtggctcacgcctgtagtcccagctactccagaggctgaggtgggaggatcacctaagcctaggagtctgaggctgtagcaagccaagatcacttcactgcactccagcctgggcaacagagacatcctgtctccaaaaaaaaaaaagaaagaaagaaagaaagaaaaatcctaacccagtcatttcctagctgtaaaacctggtcaagttccttagcttctctgagcctcagttttgtcagccctaaaatggggataatgaaacacctggttcacaagggtggggcaggggtgcagttagatgtgtgtttagcgcagtaatagttagctgttatcctcatgggccggggacaggggaggcaggcaggtgttggggacatgccaagtgggtgacatctgagctctgctgttcagggtacgaggatgtcgtctggattcccaaaggctccgtccacatcttcatccaggatctgaacctctctctcagtcacttgggtgagcagatggtggggaggggatgaggattaggggtcagtggggagggcggtttcagcatgactagaattctgaaccctgcatcgtcccccagccctgaagggagaccaggagtccctgctgctggaggggctgcctgggaccccccagccccaccgtctgcctctagctgggaccacctttcaactgcgacaggg

SEQ ID NO: 23045 - DNA, 1040 bp, Homo sapiens
gaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatcca

SEQ ID NO: 23046 - DNA, 1064 bp, Homo sapiens
tctttttttttttttccttttgagagagagtttcactctgttgccaggctggagtgccgtggtgtgatctcggctcactgcaacctctgtctctcaggttcaagcgattctcctgcctcagcctcctcagtagctgggatttataggcatgcactaccatgcccagctaatttttgtgttttcagtagagatggggtttcaccacattgcccaggctggtcttgaactcctgacctcaactgacacacctgccttggtttcccaaagtgctgggattacaggcgtgagccaccgcccccggcctgattttttctttatcaaataggggtcattggtatctactgtaaagggtggttatgataattaagcgagtatataaagctgctagtgtgacttctgacacacactgttcctcagtagtggaagttggtcttcctactatttgtagtgtacaccgttttcagtgtcttttcctctatatgctctgcagagagagtgctaatgatgtctgatgactgataagtaatgcttgttgattaatgatttatacaaacaggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtaagtcctgtttctgttcattttcagataccctgctttaggtgtccccccccacacagtatggagtccagtggcctgtgcctgatcattcacgctgcagcttcatttctgaggtgctgatgtgggctagggaatgctttgttcctttttttttttttttttttgagacagagtcttgctctgttgctcaggctggagtgcagtggcatgatctcagctcattgccacctctgccccccaggttcaagcgattttcctgcctcagcctcccgagtagctgggattacaggcgtgtgccaccacacctggctaattttttgtaattttagtagagatggagtttcaccatgttgg

SEQ ID NO: 23047 - DNA, 1035 bp, Homo sapiens
gagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctat

SEQ ID NO: 23048 - DNA, 1050 bp, Homo sapiens
caagtgatccacccgcctcggcttcccaagtgctgggattacaggtgtgagccaccatgcctggccaacttccaggttatctaaatgcactttgcataaggagaaataatcacactgtagaaggtttttctttacctttttggtagctggtctaagaaaggttttacaagaaattatcgagataatttcctgtattgcctttattaagttttttatcacttaaaaaaaaaaacctggttggttgggcatggtgtttcatgcctgaatcccagcactttgagaggctgaggtgggaggatcacttgagttcaggagttcgataccagcctgggcaacatgatgaaagcccatctcttaaaaaaaaaaaaaaaaaaaaagacacacatacaaaaattagctgggtgtggtaacgtgtgcctgtagtctcaactactggggaggctgaggtgggaagatcacttaggcctgggagatcaatgctgcagtgaacttttgtgctgctgcactccagcctgggccactgagtgagacgctgtcccccatctacccctgaaataaataaaaagaatcaacaaaaaactctgggctttaaaaggattcattttttcctagtaactctatttactcctactaatgacttttgattatcactgtatttacatggattactaacaagtgagctgttatcctgtttcaatcaaatgttttgagccttctaacatctttgacaaacttccccaaatgcaaattctttttattttattttatttattttttttgagacagagactcgctctgtctcccaggctggagtgcaatggcataatcttggctcattgcaacttctacttcctgagttcaagtgattctcctgcctcagcctcccgagtagctgggattacaggtgtgcgctaagatgcctggctaatttttgtattattagtagaggtggggtttcaccatgttggccagtttggtctcgaactcccgacctcagttgatcctcctgcctcagcctcccaaagtgctgagattacaggtatgagccac

SEQ ID NO: 23049 - DNA, 1080 bp, Homo sapiens
taaaatattcagtaaaccatgctgtaaatagatgtaaatagataccacaggaagagtagatgtagcataattcttaactggctcttggatttttggaatggtaattgaatattagcattcatttaaagtcaccaactgcattgacctctaacaagaaagccagcccaggctgggaaaagtggcttacacctgtaattccagtgctttgggaggctgaggttggaggatcacttgaggtcaagagttcaagaccagccagcacaacagagcgtgacgctgtctctacaaagtaaagagtcagcccgtcctttgaatctttgaagtcagatattagcttacctagagctgtgaaagtcctaaatggcatctcctgaagtaaggctgttttgtctctgttaaaactctagtagagctacctctgccatttatctagatattctggaaatgcttgctgcagattccacatcagcaattgctacttcactttgtacttttatgttatggaaatgacttgttaaacctcacgaactgatctttgccagcttccagcatttcttctgcagctaactcacctctcagccttcatagaattagagttagggccttgctctggattaggttttggcttaagggaatgttgtggctggtctgatcttctatccagaccactaaaacttattccgtgttagtggtgaggctgttttcctttcttattatgtgtgtgttcactggagtagcacttttagtttccttcaagaactttacattcacaacttggctaactggcacaagaggcctagattttggcctatcccagttttttttttttttttttttttgagacatggtctcccttttgcccaggctggagtgtagtacagttatagcccattgcagcctcaaacttacgggttccagtgatcttcctgtctcctgagtagctaaagactgcaggtgtgcaccaccatggccagctaatttttttttttttttttttttttttttaaagaggcaggactttactgtttacccggctgatcttgaacttaaaacctcaagtgatgctcccctatctgcctc

SEQ ID NO: 23050 - DNA, 2075 bp, Homo sapiens
gtggaaaatccttcagaagctcttcatgccttaagaatcactttagaattcacactggaataaaaccctataaatgtaaggagtgtgggaaagcattcactgtttcctcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctatatatgtaacgaatgtgggaaagcctacaatagattttatttacttactaaacatttaaaaacacactgaagaaaaactctgaatgtaaggaatgtggaaatcttttaggaatttctcataccataattaccacatttgaattcacactgaagagaaattttattggtacaaagaatgtgaggaggccttcagttatccccattcacttcgaagacatgaaagaactcatactctatgtgtcccctataaattttaggaatgttagggagccaatggaatctttttttattattttattttattttattttattttattttattttattttattttatttgagacagagttttgctgttgtcatcacacaggctggagtgcaatggcatgatcccagctcactgcaacctttgtctcctgggttcaggcgattctgcctcagccttcaagtagcttggattacaggtgccgtcaaccacacccagctaatttttgtatttttagtagagatggggtttcaccatgttggccaggctggtctcgagctcctgacctcaggtgatccacccgccttggcctcccaaagtgctgggattataggagtgagccactgctcctggccttttttttttttttttttttttttttttttttttgtaagtcgttgttaatacacattcttttctcaagggattggattgtggtcacaatccaacatttgagaactcaccatggggccatacaatgtagaaaacacagaaagccctcattatttccttaggcctttctaagtatataagatgttgcaatggagaagagaaaccctattgatacaagatacaggcatgccctgtagatattgtgagttttgttccagactaccactataaagtgaatatcacaataacatgaatcatacaaatgttttggtttcccagtgcatataagttaggtttacatcatatggtagtctcttgtgtgcagttgtgttatgtctaagtaaagtaccttagtttaaaatactttattgccaaaaagtgctaatgatcatgtgagactttggtgagttgtaatctttttgcttgtggtaggtcttgcctcagtgttgatggctgttgatcagggtggctgtggcagtttcttaaaataagacagcagtgaagattgctgcattgattgactcttcattacatgaaaaacttctctttagcattcgacgctgtttgataacattttacgcatagtggaacttcttttagaattggacttaatcctctcaaacttcgccactgcttgatcaactaagttgatgtaatattctaagtctgttgtcttttcaacaatgttcacagcatcttcaggagtagatttcatttcaggaaaccactttctttgcttatctatacaaagcagcctctcatctgttcaagttttttcacgagattgaaacaattctgtcacatcttcaggctccacttctaattctagttctcttttttccatcacatccacagttactttttccactgaagacttgaacccctcagagtcacctatgaaggttggaatcaacttcttccaaactctggttaatgttggtttttatttttttaattaaaaaaattttttttagagacaaggtctcgctgtgttgttcatgctggagtacaagtgggtattcaccagcacgatgagagcacactgtagccttgaactcctggcctcaagtgatcctccttcctatgcctcctga

SEQ ID NO: 23051 - DNA, 1032 bp, Homo sapiens
cttgtaatccgcctgacggcctcccaaagagctgggattacaggcgtgagcctccgctcctggccaggatggaggctttataatcagaatattattctagtattagtgtaataaagtagtatctattgaatttattaacagcatgtttagactaagtgtagttttgacatttttttctgaaaaatttgatcctagggaaaacttgaacatctaacacacccagtctagtagtttttttttttttttttttgagacagagtctcgctctgctacccgggtcggggtgcagaggtgcgatctcggctcactgcaacctctgcctcccaggttcaagtaattctcctgcctccctagcattaggtgcgtccatgtgaagagaccaccaaacaggctttgtatgagcaataaagcttttaatcacctgggtgcaggcagactgagttcagaaaaggagtcagcaaagggagataggggtcgggcagttttataggatttgggtagatagtggaaaattacagttaaaggaggttgttctcttgcgggcaggggcggggatcacaaggtgctcagtggggagctcctgagattcattgtccaggagaaggaatgtcacaaggtcaattgatcagttaggttggggcaggaacaaatcacaatggtggaatgtcatcagttaaggcaggaactagctattttcgcttcttcttgttgttcttcagttgcttcaggccatctggatgtatacgtgcaggtcacagggagtctgatggcttggcttcggctcagaggcctgacacctagtagctgggacacaggcacatgccgccatgcccagctaatttttttttgtattttagtagagacaaggtttcaccatgttggccaggctggtctcgaaatcctgagctcaggcagttcacctgcttcggcctcccaaaatgctgggattacaggtgtgagccactgtgcctgaacacttactttttgagcattgtgcttgttttctttcacctcaggtaaatacattttatg

SEQ ID NO: 23052 - DNA, 1028 bp, Homo sapiens
aggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtgataaacattatttctatagattatagattagctaaaagtattccttacaagaaagaaagggacaggctctggcttgttatctgcaacaggaacatgtccttaaggcacaaatcactcatggtattgtttgtggtttaggaatgcctgagcagttttccagttttccaccgtgggtgggccaggtgttccttgccctcattcgggtaaaccagcaacctccagcatgggtgtcatagccatcacgagcatgtcacagtgccgcagagattttgtttatgggcagtttctcatggcctgtttatgtccaaatttggggggcctgttctgagcacattttcctgtaagcactcaggaagaatgaagcttcctgtgtcctttaacactttaagtacagatcttagtgatacataaccagttttatctctctcaagctctaccttccgcaaagtgctagaatacagttctgccaagttcttcactactt

SEQ ID NO: 23053 - DNA, 1350 bp, Homo sapiens
caggagtttgaggttacagagagccatgatcacaccagtgcactatagtccaggcaatggagcaaaaccccaactctgaaaaaagtgaaacatactgggtgtggtgggtcatgcctgtaatatcaccactttgggaggccgaggcaggcagatcacctgagcttaggagtttgagaccagcctgggtaacttggcaaaaccttgtttctacaaaacagaaaaattagccaggtgcagtggtgcacacctgtattcctagctactcgggaggctgaggcaggagaatcagttgagcctgggaggtggaggttgccgttagctgagagtgtgccatgcactccagacagggagatagaacaagactttctctcaaaaagaaaaaaaaattaaatattaaaaagtaaaatcataattgtcatcaaaatgcttctgtgttcagatgggtgaaatctcttaatatgtctgaaaatgttttaaaacctttatctcgtcatcaacagacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagc

SEQ ID NO: 23054 - DNA, 1014 bp, Homo sapiens
ctcccaggttcaagcaatactgcctcagcctcacaagtagctgggattataggcatgcgccaccatgcctggctaattttgtatttttagtagagatggggtttctccatgttggtcaggctggtctcgaactcctgacctcaagtgatccacccgcctcagcctcccaaagtgctgggattacaggtgtgagccaccactcccggcatttttaatttttacagaagtagtttgtaataaactatctaaacacatcagttatgtaataaaccccacatcattatagccaaatttttgatgtaccaaaatcctcaaggttctctggcttttattttattgctgtgtttaatttgaaaacaagtaaaaatgactcattttaaatgaatatttcttctctaaatccttacgtttctttttctgcttaactttagaatgggaaatacaacctagaaccaaacggtcatcacttcagcagggttttttgaagaatcaaatattcagtgggatacaaatggtaagattcatgagggatatttcttaatttcctctcttagaaaagatagagaattccattctagaaaatcagctcagtcagaggtgtggcttacatctgtaatcccagctatttgggaggctgaagtgggggtctcatttgagcccaagagttcaagaccagcctaggcagtatagtaagatcccatctctgattttaaaaagaaggtgaatgtggtgactcacacctgtaatcccaacattttgggaggccgagatgggtggatcacttgaggtcaggagtttgagaccaggctggccgacatggtgaaactccatctctactaagaatacaaaattagccgagtgtggtggtgggcacctgtcataccagttacttgggaggctgagacaggagaatggcatgaacacagaggcagaggttgcaatgagctgagattgcaccactgcattccagcctggttgaccgagtgagactctgtctcagaaataaagaaaaga

SEQ ID NO: 23055 - DNA, 1037 bp, Homo sapiens
gggttgagccactgtgcctggcctctatttctaatgtctaggcagcaactgttgttgtgttgttcctgttacatagtcttattacccatttgatacaaagttcagattgattgttcctgttcgtattccattttgggttttccctctatctttgttgattttttaaaaaattaaatatgtaaaagaataaagggccaagcagagtggctcacagttgtaatgccaacaatgtgggaggccaaggaaggatgatcgcttgagctcaggagtttgagggcagcctaggcaacatagagagatctcttctctacaaaatatatttttaaaaattagctggatgtggtggtgcacgtatgtagtccctggtactcaggcaaaggactgcttgagcccaggaagtaaaggctgcagtgagccatgataatgccactatacttcagcctgtgtgacagagtgaaaccctgtttttttttttttttttaaagaaaaaaaagaatgtaattttaaacatcagaactgtaaggtactctgagctggccataccatggtcaagccattgtgacatccccccgcccttgtgataatgtactttgtgatattcccctgcccttgtgaatgtactttataagatacatcctcccccacctagtgaatgtaccctgccattggcccttgtgacagtacacctttcctctccttgtaaatgtactttgtaaccttcctccccacccttgtgatgatacaccctccccgcccttgtgaatgtactttgtaacatcctccccgcccttgagaatgtactttgtaacgtccaccccactgcctacaaaaaaaattgctcctaactccaccgcttatcccaaacctatgagaactaatgataatcccaccaccctttgctgactgttttgttggacagcccatccacatccggatgtaatacacagccattgttgctcgcacaaagcctgctaggtgctctctttactcagacgcatgtaacattttgtgctgaaacctgggacattagaactcct

SEQ ID NO: 23056 - DNA, 1030 bp, Homo sapiens
aaaaataaaaataaataaataaaacagttatcaggctgggagtggtggctcatgcctgtaatcccaccactttgggaggctgaggcaggcagatcatgaggtcaagagatcaagaccatcctggccaacatgttgaaaccccgtctttactaaaaatacaaaaattagctgggcacggtattgtgcccctgtaatcccagctactcaggaggctgaggcaggagaatctcttgaacccctgaagtggaggtttcaatgagcctagatcacaccactgcactccagcctgacgacagagcgagaatccgtctcaaaaaaaaaaaaaaagacaactaggttgggcacggtgcttcacggctttaatcacagcactttgggaggtcaaggcagggggtcacctgaggtcaggagttcgagaccagcctggccaatgcggtgaaacttttgtctctactaaaaattcaaaaaataaaattagccaggtgagttggcgggcgcctgtaatcccagccgcttgggaggctgaggcaggagaattgcttgaatctgggaggcgaaggttgcagtgagttgagttcttgccactgcactccagcctgggtgacaagagcaaaactccatctcataaaaaaaaaaaaaaaaagacaactaaggcttgcataagtattttgagaatattcttctaggcatgtttttatttccaaatgtgtagcaaaaatttatactttttatatttttcatttttgctggttgtataacttcagtctccttttgcattctggaataacttattaattgtgcattctttccctttgcttgtgttaatcttggtagagagtacccaggtttatgaattctttcagatatttcgcttgaaaaatctacactatttcttgcatgttttctgttccactaattctgttagatatttatatagttacatcagcttgattttcctctacttcttagtctttctgtatgctttttaaaaaaatgtgtctttttatacatactttagctggagttttaa

SEQ ID NO: 23057 - DNA, 1021 bp, Homo sapiens
acaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtgg

SEQ ID NO: 23058 - DNA, 1699 bp, Homo sapiens
gggaggctgaggcaggagtatcacttgagcccaggagaccaaggctgcagtgagctatgatcaccactgcattctagcctgagcaacagagggagaccctgtttctaaggagaaaaaggtcatgtcattggcaaacatggctaatttgacttcttttttagttgagatgccctttatttgtttctcttgcctaattgctctggccagaacttatagtattatgttgaatagaagtggtaaaagtggacatccttgttctgttcaagatctcagaggaaagactttcaatttttccctgttcagtatgatgttggacgtgggtgtgtcatatatggcctttattattttgaggtatattcgttctatacacagtttgttggggacttttgtcaaaaagggatattgaattttatcaaatggtgtttcagcatctgtggaaatctcatacggtttttattcttggttctgttaatttggtacgtcacatttattgatttgcatatgttgaaccatccttgtatttctacgatgaatttcacttgattgtgatgaatgattttcttaatgtgttgaatttggtttgctaatattttggtgagaatttttgcaggtatgttcatcagtgatattggcgtgtagttttgttgttgttgttgtgctcttgtctggtttttgatatgagaataatgctcaccttgtagactaagtttggaaatattctctcctcttcaattttgtttgaggagttcaagtagtattggtattagttctttaagtttttggtaggattcagcagtgaagttatcaggtcctgggcttttctttgatgggattcattttgttatcactttgatcttgttattgttgtgttgaggttttctatttcttcatggttcagtcttggtaggttgtatgcacccaagaatttgtctatttcttccaggcttttcagtttgttgggatatagtttttcataatagtttctaatgattggttgtatttctgtggtttctgttctgttttctttttcattttttattttatttgggtcatttttttcccttagtctagccgaaggttaattttgtttatcttttcaagtaatcaactttatgttttattgatcttctgtattgttttttattttcaattttattttggctctggtctttattcttttgttctactaattttgaatctggtttgtttttgcttttctagtattttaaggggtatcattaggtttattttaaatttttctacttttttgatgtatgtgtttactgctgtaaaattctcccttagtactgcttttatcccatagattttggtttgtcaacataccaaaaccaaaacaaagttccattgtgtaatttttttttttttttttttgagacggaggtttgttcttgttgcccaggctggagtgcaatagtgcgatctcggctcaccacaacctctgcttcccggattcaagcgattctcctgcttcagcctcccgagtagtgggattacaggcatgcaccaccatgtctagctaattttgtatttttagtagagacagtgtttctctatgttggtcaggctggtcttgaactcctgacctcagaagatccacccacctcggcctcccaaagtgttgggattacaggcatgagccatagcaaccagcctcttaaattcttttgatttttttttt

SEQ ID NO: 23059 - DNA, 1034 bp, Homo sapiens
acagaattccattctctttatggctgaataataatctgctgtctatatataccatattttctttattcattctttcattgttagacacttaggttgattccatattttggctattatgagtagtgctgcggtaaacaagggaatgtatatatatcttttcaaatatattgatttcctttcttttggatatatacccaatgggattccagatcatatggtagttctatttttaattttttgagaaacccccatactgttttttttgttttgttttgttttttttgagatagtcttgctgtgtcacccaggctagagtgccatggcataatcatggctcactgcagccttgacttcctgggctcaggtgatcctcccacctcagcttcctgagtagccaggactacaggcctccactaatacacctggctaagtttttttgtttgtttctttgattttttgagacagagtctcactctgtcactcaggctggggtgcagtggcacgatcttggttcactgcaacgtccgcctcctgggttcaagcaattctcttacctcagcctctggagtagctgggactacaggtgcacgccaccatgcccagctaatttttgtattttcagtagagacagagtttcaccatgttgaccaggctggtctcaaactcctgacctcaaatgatctgcctgccttggcctcctaaagagctgggattacaggcatgagctactgtccctgactggttgtgtgtgtgtgtgtgtgtgtgtgtgtgtgtgtgtgtgtgtgcgcgcgcgcgcgcgcgctcgcgcgcgtgcatgcagacaggtcttgccagtttcagacaggttttgtgcgtgcatgtgtgtacagacaggtgttgctgtgttgcctagcctggtctggaactcctgggctcaagtgatctcccaccgcagcctcaagttttgggattaaaggcctgagccaccacacctgaatattgttctctacagtggctgtactaatttatattcccaccaactgcatacaaggatt

SEQ ID NO: 23060 - DNA, 1040 bp, Homo sapiens
ggaggggccggggtggaatgatatagtttggctgtgtccccacccaaatctcaacttgaattgtatttcccagaattcccatgtgttgtgagagggacccaggggaaataattgaatcttgggggctggtctttcccatgctattctcgtgatagtgaataaatctcaagagatctgatgggtttatcaggggtttccatttttgctttgttctcgttttcttaattttttttttttttttttttttgagatggagtcttgctctgttgccaggctggagtgcagtggtatgatctcagctcactgcaacctctgcctcctgggttcaagtgattcccctgcctcagcctcctgagaagctgggactacaggcacgtgccaccacactgagctaattttttgtattttttaaattaatttatttatttttctttgagtcggagtcttgttctgccaccaggctggagtgcagtggtgcgatctcagttcactggaacctctgcctcccgtgttcaagcgattctcctacctcagcctccttagtagctgggactacaggcatgcaccaccacactcggctaatttttttttgtattttagtagaaacggggttttgtcatgttggccaggatggtctcaatctcctgacctcgtgatccgcccgcatcggccttccaaagtgctgggattatgggcatgagccactgcgcccgggcttctttctcattttctcttgctgccgccatgtaagaagtgcctttcacctcctgccatgattttgaggcctccccagccatgtggaactgtaagtccaattaaacctctttttcttcccagtctcaggtatgtttttatcagcagcatgaaaatagactaatacagtttgtattacatgggtatatatatgcatgtataaaaggcaaatgtaagcatgctttctgaaggattgatgataagctattttcttcagtgaatggaagagtttgatgtagaaacacctttttggccgggtgcagtggctcatgcctgtaatcccagca

SEQ ID NO: 23061 - DNA, 1050 bp, Homo sapiens
tacctcccggtacgggaccggatccgcatctccaggtgcggccccgcctccggggggaagggcagggcggagggcgcagctggcacctggagatgcgatgtggcccggggctggggtcgttctaaccgcgcgtcccctcccccagggtctgtcaccgctggaagaggctggtggacgaccggtggctgtggcgacatgtcgacctgacgctctacacggtacgcgcagctggccgggcgggcctgggccgcggtcgcggtgcccggaccccgaagaccacctctcccaccctgggactgtgtgtcggggcccgggctggggatttagagccaggcgatccggggcctatctcggcatcatcgcttaccagctcctcttcgacctcagggcctcaatttcctcatccctgcaatggggataaaggacagtacctgcctcacggggctattatgggacttcactgagatcacgcagggaaagggcttagaacagtctggcacatatttatcattcgataaatgctaatttatgactatgttatcaagtttttgttttgtttttgagacagagtctcgctctgctgctcaggctggagtgcagtggtgcgattgcagcctcgacctcccaagctcaagcgatcctctcgcatcagcctcctgagtagctggaaccacgggcgctcgccactacacctgctaattttttattttttgtagagacggagtctcactatgctgcccaggctggtctcgaactcctgggctcaagtgattctcccgacttagcctcccaaagtgttcagattacaggcatgagccacagcaactggctcaaaacatttatagatatatttgttgccctttttgaaactgtcttcatagataattgctattataaagtgaatttgcacccttccttttacgttacttcatatgtgtgtgtccaaaaacaattatagtgttagtaatgtatttctgaacttcgggtaatgctgttctactatttagatagtgttctacttttaaacaattttactgtatatatccatct

SEQ ID NO: 23062 - DNA, 1032 bp, Homo sapiens
gagaagacaggtgtcattgcacaagaagaaagaaacaaaaaggcaaagccagttcagccatcaaatgaaatggcaaatagcttctcactttttaggctctaagagagtcctggtgaatcccaggaagaatacatgatgagcacatggtgagccgggttctttttaaattttattttgtttttttttttttaagacgcagggtcttgctctgttgaccaggctagagtggagtggtgtgaccacagcccactgtagcctcaacctccttggcccaagtgatcctcctaccttagcctctcaaatagttaggactacaggtgtgtaccactacatccagctaatttttctctttctttttcttttttttggtagagatgggggtctcactatgttgcccaggctggtcttgaactcttggccttaagtgatcctcttgcctcagcctcccaaggtgctgggattacaggcatgagccacagggcccagctaatttttgtatttttagtagagacagggtttcacaatattgttcaggctggtctcgaactcctgacctcaagtgatccgcctcagcctcccaaggtgctgggattacaggcatgagtcactgcacccggcccacattgtttctgttcctaatttctctagtaatttctatgagaaagacactgatagaggcactcactcactcaggagggacgtgacacagtccgctctgaatggctgtcagttgccaaatttgggagacagatgcagccgacacatggtacaaagtgccagatgtcaagagtcaagtgggcttcctgggggaggtggcatttgagatgggccttgaaggatgagcgagtgaagactggagggtggacacagaagaaagtcattggtcatgctgacaagacctggtgggtttacccttattttacatgattctaaccatgtttaaaagaggggaagtttctggaaatgggaactagggtaagtgtgtggttgatgcctatggtgggtgcagataggagaagggaagtgagcttg

SEQ ID NO: 23063 - DNA, 1050 bp, Homo sapiens
ggcatgggccatcacacccagctaatgtttgtatttttagtagagatggggtttcaccatgttggccaggctggtcttgaactcctgacctcgggtgatccgcttgcctcagcctcccaaagtgctaggattacaggtgtgaaccaccgcgcctggcctgaatttccttgtttttaatcccactttttcagtggtcacattttcaggtatacgatccttcaccaagaacaacttgaggatgtattttggtgtaagaattagaaaccttgtcttttctttttagagacagggtcttgttctttcacccagactggactgcagtgatgcgatcatagctcactgcagcctcgaactccttcgctccagagatcccccaacctcagtctctggagtagctgggactacaagtatgtaccatcacgcctaactaatttttatttttatttttagtaaagatgagttcttgctatgttgcccaggctggtctcaaactcctgggctccaatgatcgtccctcctcatccttccaaagtgctgggattacaggtgtaagccaccgtgcctggcttctttttttttccttttaatatatgattattttttgtaaagatggcgtctcactctgttgcccaggctggtctccagtgatttcaattcttgtaagtataaagcagatgtggaagtgctgggtcatttggtggttctatttttaatgttttgaggaaccaccataccatagttcatagtggaaggctgttttttaaatgaaataaacatgtaaggctgaggtgcccatctacttccctagaaaaaccacagtaaggacattgccacgtctcctttctgcccctgttttttggctgttaccacatctgcatgtccatcaatttagtatttctttctttttatctctatttactttttttttttttttgagatggagtctctgttgcctaggctggagtgcaatggcgcaatcttggttcgctgcaacctccgcctcctgggttcaagtgattctcctgcctcagcctccttagtagctgggat

SEQ ID NO: 23064 - DNA, 1075 bp, Homo sapiens
ttactagtctgcgttagagaggggacagtgcgtttctctcccaaacgattgcagttctctccttttcaggcctataatgcaaagagcaaaagctttgaagatcctcccaaccatgcccgtagccctggaaacaaagggaagggcaagggaaaaggtacgtcattgtatgagtttcttttcaagttattcttctgtaacttggaggctgcctgtgaatccctcagtgtaaaaccacctctggtgttactgactctgggacagcgaggccgcctgagttaacaaggcgcttgagagcaaggtggacttggactctgaggatcgggtttagcctctggcctctctcccccagggaagggcaagcccaagtcccaagcctgtgagccgagcgagccagagatagagatcaagctgcccaagctgcggaccctggatgtgttttctggctgcggggggttgtcggagggattccaccaagcaggtgagcgcccgtaggctccatctctgaatacctggtgagcccagaccgggcaggtgctacctgaaacgacttccaaccccggtcaccttcctgactcaagaatctccttccgaggccaggcacggtggcgcacgcctgtaatcccagcactttgggaggccgaggtgggtggatcatgaggtcaggagtttgagaccatcctggccaacatggtgaaaccccgtctctaataagaatacaaaaattagctgggcgtggtggtgtgtgcctgtagtcccagctactcaggaggctgaggtgggagaatcgcttgaacctgggaggcagagcttgcagtgagccaagatcacaccactgcactccagcctgggtgacagagcgagactccatctcaaaaaaaaaaaaaaatcttctggagagttgaaagcatggcttcgtgcttgatctgccaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccg

SEQ ID NO: 23065 - DNA, 1082 bp, Homo sapiens
ggtcaacaagttctacaggtcagcagaggcctctgttcttccacgaggccacagactcttctagaaggctctgcctgaaacaaggttgtggcatagcacccacagttgttctaagagttaggttgaagtagctgtttttccaagtgtttctgattatcggtgggcactgataatgactagaattctagttcccagccctcacttttaggtccttattttaatgttgcagagccctttttccaaaagaaatccttaagctggctgggcactgtagctcacgcctctaatcctagcactttgggaggctgaggcaggaagatcacttgagtctaggagttcaagaccagcttgaggaaacgtagtgagaccccggccctaccaaaaaaaaaaaaaaaaaaagactagctgggcgtggtggcacacgcctgtaatcccagctacttgggaggctgaggctgaagggatcactgaaacccaggaatttgaggctgtagtgagccatgatcccaccactgcactccggcctgggtgacagccagaccccgtctcaaaagaaaaaacgggtagagtgcctgggcacccccagagaacctcccaagctccatctatgactgtccaggttctgtcccgctgtccccacctcttcccaggtcctcctttctgtctctgggattttttctctttcctaagcttttggcctattacgttttctttttctaagacccgagtaacttgcggtgattaggcattaacctgaaactagcctgtacaggaagctatacacttgcctcacctcttagctaacatagatcaaagatttcctgaagcctttgtaataacaggaaataaaacaagggctgtgagtggtacaggtgagagaaacacactcgagaggctgctaccggcaggcggacacagcagggcagggccaggcgtgcagagcaagcagccaagctgacctaatggttggggggtctctaccctgtggttccctaattgggggcgaatctaccttgcagttccctcatttggggaggggttatctttacctgcggttccctaagtaggggggtctttaccct

SEQ ID NO: 23066 - DNA, 1044 bp, Homo sapiens
gatgacttctctgtgtcagaggatcgaggctcttccaggaaaaacctaaagccacagatcgtttccacactgatccattctgtgttttttctaagaatcagcgtgtggttggaattacagccaacgttttccagatgccttcccggctcacaattccatttccttagagccccagctcccttgccttagttcagttactgtgaattatgagaactggagaagcaggttccctccagccttggcacagttggggcgcgttaccccctctggttgtccttggtgggaaggggacacctccccgtagtgttttctgccagttgctcctggcaaagtgggagagtcagcacagagacgcctttggggcccgtcagactcctggggggcctagtggggagaacgtgacagctgacttccctaacggcaggccttcttcaaagaacagcttttccacactagtcagaccacactcccattgtcccaggccctgtggcgccttacattggcctccagtgtcgcttctagatcagagccttagtcagggtagcgtaggttgtatcatagcaacaaccccaaatcacagtgacttaaaaccacagaagctggactgggtgcggtggctcatgcctgtcaggagttcaagaccaagaccagcctggccgacatacctgtctctactaaaaataaattagccagggttagctgggtgtggtggtgggcacctgtaatcccagctacttgggaggccgaggcacgagaatcgcttgaacctgggaggaggagttgcagtgagccgagattgtgccactgcactctaacctgggtgacagagtgaaactctctcaacaaaaaccacggtagccgctgtctcgctcatacgaggtgcccatcacaggtcagcagaggactccacctgttgtgtcccttggatatctgggccgctggagtcagaagttgccagtgtttgagcccaagggaaagcacacaggacattccccaggcagtgacatcctctttggtcacttctgcccacgtcacatgccagga

SEQ ID NO: 23067 - DNA, 1055 bp, Homo sapiens
tgcaggaatttgtcacacgcctggctaattttaattttttgtagagttgggggtcttaatatgttgcccaggctggtcttgaactcttggactcaagtgatccatctacctctgcttcagcctcccaatgtactggttcaggtatgagccaccatgcccagcctaaaagtcttaattcaccgtttgtttcattgttgctaagggctgtgtgactcactttttttttttttttttaattttttgagacctaaaagtcttaatgcatcatttgtctcattgttagtaagggctgtgtgatttgccctttttttttcctttttttttttttttttttttttttttttgagatggagttttactcttgtcgtccaggctggaatatggtggtgtgatcttggctaactgtaatctccacctcccaggttcaggcaattctcctgcctcagcctcccaagtagctgggattacaggcacaccctaccatgcctggctaatctttgtatttttagtagagatggggtttcaccacgttggccaggctggtctgcaattcctgaccttaagtgatctgcctgcctcggccttctgaaatactgggattacaggcatgaaccactgtgcccagccctgatttgcctttttaatgccattttttaggtgtgtcagcagcctgagtgtgggaaatgtaaagcctgcaaggacatggttaaatttggtggcagtggacggagcaagcaggcttgccaagagcggaggtaggtcaggccgagtcttcctcctgtggcagaggacttgccagctggtggcagatgcactgtggagaagggcctgcatgtgtgggacagcaccaggattccttcgttaggcattgtctcaggacctgtccctgttatgaagaaaacagccccggttggtcttacttagaaaaggggccttaggtataaccagtgacattgcaggtgtcccaatatggccatgaaggaggcagatgacgatgaggaagtcgatgataacatcccagagatgccgtcacccaaaaaaatgcaccaggggaa

SEQ ID NO: 23068 - DNA, 1035 bp, Homo sapiens
taatttttgtatttttagtagagacagggtttcaccatcttggcgaggatggtctcaatctcttgatctcgtgatccatccgcctcggtctcccaaagtgctgggattacaggcgtgagccatcgcgcccggccctgtgcctggccaattatttgtttaccttgaggtgtccacttacacaggaaagctaaggttttaaaaaattggcttttcctctaaatcttttcaggaagtctttggttatgagatttatttattcatttattttgagatggagtctcactcactctgtcgcccaggctggaatgcagtggcatgatctctgcttactgcaacctctacgtctcgggttcaagcaattcttctgcctcagccttctgagtatctgagattacaagtgcccgcctggctaatctttgtatttttggtagagacgtgatttcgccatgttggccaggctggtctggaactcctgacctccagtcatctgtgtgccttggcctcccaaagtgctgggattacaggcatgagccactgtgctgggcctgactataagattttgtattctatgactttagatggtagagtgagtcagagctcacctgctggccctctcactgcctccctccccttctctctgttttatgataatcacttatacaaagttcttaacaccgaagcactatctgggtgtaaaacactctcttagcctttaatcctcttttgttttccctgtgtaggaggagaagagacgcaaaacgacccccaaagaaccgtaagaatttattcttgacattatcgaaagcagatggtaatgttaaaatgatggttctagaacaaaagggaaggggtttcagtaattgccagagcaaccttaggctcattttggatcgggttggtgaacataggaccaaggtgcgtcaggcaggatgcccctgcggtgaagagccactgtgaccacgcgcctgggcctcactgccacagccggtgcctccctgtgccacaggcacctcaggcagaaacctcacaggggcg

SEQ ID NO: 23069 - DNA, 1921 bp, Homo sapiens
tagctgggagtatgggcctgtaccaccatgcccaactaattttcgtatttttagtagagacagggtttcaccatattggtcaggctggtcttgaactcctgacctccgtgacccacctgcctcgcctcccaaagtgctgggattacggggtgaagttagcttcgatttctcctcccaaccccagggcccttctcagggttggtcacacagctgtgtgtcatgtggtagtgaaaggccatcaggtgagcagctgtgtcacttacctttcactgtgaaaatgctgtgtgacaaatggctccaaggccagaggcctagaacagtgagcatttttcaagctcacttgtctacagcttggtggctgtcggctgatcttgaggtggcttagtggggatggctgggctgacccagctctgcctccgcaatttggccaggctgggtacacgcttgtggctgtgccagaccacaagggcagaaatgaaaagtagcactttttcaaacctctgttgaaaaaagttgggccaggtgcagtagctcgcgcctataatctcagcactttgagaggctgaggcgggtggatcacttgaggtcaggagttcaagatcagcctggccaacatggtgaaaccccgtctctaataaaaatacaaaaaattagctgggtgtggtggtgcatgcctgtggtcccagctacttgggagactgaggcaggagaatcacttgaacccgggaggcggtggttgcagtgagctgagatcacatcactgcactccagggtaggtgatagagcgagactctgcctcaagaaaaaaaaaaaggaaaaaagaaaaagaaaacaattagctgaagcaaattttgagactgagcctgaatccagaggtgggcagaataccccacctgagcggcagggccctggcagagtgggaggtgaagactcggacccctgtgtgcagtcagctgtccacggtcactgactgacgctgatcgcacatcagcccagctctcaacctaggcaggccagacatgggtcttcctccaccgcaggctggattcccatcaggccacggaaatcatgacatccctttgtctgctttttgtattaaaccactggcatctctgaccaacattcagatggggtattgatggtgttcctgaagaccttgagtcctggagtagtaaatgccctctgggcttcctgcagtgaagacaggagaggcagcctgtcctctgaacctggggaggagcttgtgtcagcccttaggagctgttggccccggtgcagggccccccccgagctgaccagcctgtgtgtgtgttgtcttctgtgacagaacacccaaacagaaactgaaggaggagccggacagagaagccagggcaggcgtgcaggctgacgaggacgaagatggagacgagaaagtaaaggcgggttatttgtttctgaactccccctcattcttctgctcctgtttgcttgggcgggagtgcgcagggtggggctctgggttcaagtccagccccatccacccaggctccatggggccatccagactctgggaaggtcaccttttcctccttttgggggccgggatttgtggctggatgcctgtgctggatgcctagtgaacactcagttgtcctctgtctttcacactagagagggtctgtgtgagcctgggctgagatgtgcatgaagcatcctctcctgaggcctcactgctgagaagccttgacacacagtcagctctgacgcacatgtcagccacacctttgattctttcccagcctcctacgttctgagtctagctctccccctgccagcctccccagtctagtttagccaagtgcatgcgtttaaaccctaaagcatcatgtggaacactgctgggcctctgtcaaagtacaggatggccaggttgcctgca

SEQ ID NO: 23070 - DNA, 1005 bp, Homo sapiens
gacagcgtttggttgacttgttccttaaagttatagattccttccctcctattttacttaaaattcctcacagattttaaattccttcatctcttatcttcttgccatttacttgaagaaattcatttgtccaatagttcctagattgggccgattgcatccttgtggtgttccacaggtccccttgccttctgttccctataaactgataggattacaggactgatcagattccagctttttattttttgagactgacttttttttttttttgatacggagtcttgctctgtagcccaggctggagtgcagtggcatgatttcggctcactgcaacctccacctcccaggttcaagcgattctcctgcctcagcctcctgagtagctgggattacaagtgcccgccacaacccctggctaatgtttgtatttttggtagagacagggttttaccacgttggccaggctggtctgaaactcctgaactcaggtgatcctcatgccttggactcccaaagtgctgggattataggcgtgagccactgcacctggtctgaggctgactttatggatggtgctgtgtccctccatcagaaaggtgtgtgaggtctcttctctgacactagcagctgttgatcggtgtttagacccgtgatttcttaggacttacaagatggcaagacaacattctaaacccgtcattcagagaaacattaaacttgaagcctctttcaacatcctggtgaatgagggtccacttcaggccagctggaggcctagggtcttgttccactaatggttggcctcactgtgtgtgacagccctgccaaacggaaacctcaggaagagtctgaaagagccaaatcggatgagtccatcaaggaagaagacaaagaccaggtagggccagtgctttcatttcctgactctaccttaacttggtgtatttgatgattgtgacttcatatgtgttctgtccaagtaaataaaaaccctgtctaggg

SEQ ID NO: 23071 - DNA, 2041 bp, Homo sapiens
tatacacacatatatatacacatatatatgtatatatatacacacatatatatacacatatatatgtatatatatacacacatatatatacacatatatatgtatatatatacacatatatatgtatatatatacacacacacacacatacacataattgtgttacagagctgctatgtaatctcacaatcatcagaaaaatgacccccaaaaggggaaccttgttcagatcagatgacttcttagcattaggcattccagtaggacactctagactcttgcggggagacaaaagccagcttagttttttctaacactcatatgttaaacttgtttgtgtccaaaacttctttagaactgtgatattcttacaggcaaatgaagttgcttaacaagtgtttgtattttctcccctatttcttcctcccaggctcaaagatttggaaagagacagcttaacagaaaaggtaatctccaccttaaaatttttcttattaccaaatctgactgacacactttgtggctcataaaaagaaatttgttttctttaaatggattttgcattttttcccatggagtttcaaagataatttggatattcttgttaaatgtcagcactaatttgctgctaatagttgggtggtggtggtgtttttttttgttgttgtttttgttttttgagacagagtctcactctgtcacccaggctagagtgcaatggcatgatctcggctcactgtgacctctgcctcccggattcaagctgttctcctgcctcagcctcccaagtagctgggactacaggcacgcaccaccatgcccagctaatttttatattattagtagagatggggtttcaccatgttggccagactggtcttgaacgcctgctcgtgatctgcccaccttggcctcccaaagtgctggaattacaggcgtgagccaccatgcctggcccaggttttttttttttttaaccaatctcagttcctaaacaatctactctggattgtaacttgtcctggtaacactgttttattgtgtttttgttattgttttgagatagggtctcattctgtagcccaggctggagtgcagtggcacaattttggctcactgcaaccttcgcctcccaggctcaagtgattttcccactcagcctcctgagtagctctaactacaggctcaagccaccatgcccagctaatttttaaatattttttgtaaagatgggattttgtcatgttgccccaggctggtcttgaactctggggctcaaagcaatccacttgcctcggcctcccaaagtgctgggattataggtgtgagccactgtgcctggccgacactttacagaagcacagtattattcttataaaccatgatatgtctccatctcacctccagctttcccatttttcaccactttggagacaggagtgaagtgatcctaatggaaattccctgaacacatttcatgactgtttagtgttttgactgagacagcattgcctgccattcactcattgtgatgtgatcaggcagctcaataatttgtgtattagtccactagtgaatagcttgggaatgtgggtactgctaaacctatatccttcccttaggaatgtgtgaaggagaaattgaatctcttgcacgaatttctgcaaacagaaataaagaatcagttatgtgacttggaaaccaaattacgtaaagaagaattatccgaggtaagtcagttctcagcatcctagcctctagaaaaatgtctcctcctagtaacttgtctgtgaccagggaggcagcaagatccccagctgtcctcattgcctgatgatgatgatgatgatgatgatgatgaaggaaacacatgtgtttccttgttctctgacacttgtttacattcactgctacttaaattatcctttcctgctgtaggagggctacctggctaaagtcaaatcccttttaaataaagatttgtccttggagaacggtgctcatgcttacaaccgggaagtgaatggacgtctagaaaacg

SEQ ID NO: 23072 - DNA, 1026 bp, Homo sapiens
aggtgcatgccaccacacccagctaattactattttttgtagagacaggttctcgctgtgttgcccaggctggtctcaaattcctgggctctagtgatccttccgcctcggcctcctgagcagctaggagtacaggtgcgtgctgtcatacccagctaattactgttttctcgtagagacagggtctcactgtattgcccaggctggtcacaaattcctgagctctagtgatcctcccgcctctgcctcccgagtagctaagactataggtgcatgctaccacagccagctaattattctttcttgtagagacagggtctcgctctgttgcccaggctagtctcgaattcctgggctcaagtgatcttcctgtcctggcttcccgagtgtagagattacaggcatgagccactgcgcccagccatggtctgctgtatttcagacgagcatttctggcgtagaggtgttagagtaatctaacattttataatttcttcctatccaatctatactagatacctctgctgggttagttttcttaacacggctctgatgtcattggttctacttccccttgactgctttggtgtttgttaactatggaacaagatggataagtgtgatgcttttgccctccctccgactgtccccagccacctctctggaggtgcctttccctccctgtatgtggccagtctcacgtttgtttcttgtgtgtttccagaaccagccacttctcaatggtgcccctgtttgagcagcttcctgtgcccggttcacacagagctgtcaacttcttcctgaggctgttataccctttctcttgggaatcccgcaggcgtgagctgtatttgccttattcctctgtggttgtttatatatatctttttttttttttttttttttgagacggagtttcactcttgttgtccaggctggagtgcaatgacgtgaccttggctcaccgcagcctccacctcccgggttcaagcgattctcctgcctcagcctcctgagtagctggga

SEQ ID NO: 23073 - DNA, 1025 bp, Homo sapiens
ggctaactttttcttatttttagtagaaaccggggtttaccgtgttggccaggctggtgttgaactcctggactcaagtgattcgcctgcctcagccccgcaaagtgttgggattacaggcatgagccaccgtgcctggccttttaattcattcttaagcctgctctcagacagctaggcttgcttctccacaataaagagtgttgaattttgtcggtgtatcccgcatggtgccattataacactgaaattagtgattatttcagggtctgttaccagagcgtgtctgccgtattcactgtatctgcagcttggagcacagtagactcaaatgcttgcatgccagctcttcccctgtacagcctggattaacactgatgctagcagactcctttgcacaactgattagctttcgtaactaccacagctttcttactgctagtcattctgtgatgggattaagctaggtcttgaactccttaactccagttccttggctactactgagtacatactgaataaggcaaaattgacttacctcttttgttttgctcccctgtggtagaattctaggggtacagactgctgggtttcaaatgccgccctacttgccagccgtatggctaagttattgaacttcttggtgccttggtgtttcatctataaaaagggggtggggctgcctgctcgacaggggtgttaggaagactgagcttatcagtacagatatgttgagagcagcacctgtccaaagcccttcatcactggttattacgtggtactgtgtgtacagtggggatgctgtgggtttggttccagaccactgcagtaaagtgaatctagcaagaaagtgagtcacacacacattttggtttcctagtatgtgtaaaagttattagactaggccgtgtgcagtggctcatgcctgtaatcccagcagtttgggaggccaaggcaggaggatcgcttgagccaaggagttcaagactagtctgggcaacataggaagaccccccccatctcaa

SEQ ID NO: 23074 - DNA, 1056 bp, Homo sapiens
gtgcctgtaatcgcagctactcgggaggctgaggcaggataatcgcttgaacccaggagccgagattgcaccgttgcactccagcctgggcaacaggagcgaaactctgtctcagaaaaaaaaaaaatttttttttttagagatgagggtcttgctttgttgcccaggctggtcttgaactcctggactgaagcaatcctctgcgttggcctcccaaagggctgagattacaggcgtgagccacagggcccggccattattcctcaagagttcttaaaagtggatgctgcaggagttaactgccaggaagcaggaattcctgctaaggtctgctgcttgccaaagcctttcccttcaacaggggttgccagtaggccactggctcaggggctctgttggccctgtgcaaatattttgtttggctgaattggaataccattaggtgagccttacaatccaccactgaccctgggttccacatttctttacactcagattgcttcactgtaggcattggagttttggaggactgcttttgaccatgtggtagacattgaaattgtagtttatatgactcactccacagacttttttttttttttttacattttgaaaatatttcattaaatgaaaaataaacatggtatccaacagtacttgaaacttagatttttttttttttttaattgaggcagggtcttgctctgtggcccaggctagagtgcaatggtgtgatctcagctcactgcagcctccgcttcccgggtttaagcaattctcctgtctcagcttcccaagtagctgggattacaggtgtgcaccaccacgcccagctaatttttctttttccccctcgaggctgagccttgctctgtcgcccaggctggagtgcagtggccgtgatctcggctcactgcaacctccacctcccgagttcaagcaattctcctacttcagtgtcccaagtagctgggattacaggcgcccgccaccaagcccaggtaatttttgtatttttattagagactgggttttgccatgttgaccaggctggtt

SEQ ID NO: 23075 - DNA, 1055 bp, Homo sapiens
ccactgctccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggtaggtaccatgggggggaacacggactcagggggacaggcagggcgctgggtggggggtcgcttcccctcggggtggccggtggccgctgctgacagacgggcgcgcatgcgtggggtggtgcggcgcgcagcggcagttggcgcgggcagggtggcacttccggtcgcgcgtgcccgggctgtttggcgccaaaatggaccgtggattcccccgtagctccctggtggctagaaactaggcggggtgggggttctcttttgatccccaaatacagcaagctttgggttcgtttccggggtccccttcttcaagcagcggtgggccgggctcttgactccagcttggtcgcacaggaagtgggcagcccgcggccaacggacacccctcgggcaccggcacttcggcctccacttccggtgtccggcccggtccccgggggcgcttctgtggtggggggtccctcagtgcctttcccccaaagctgtgcatctcgatggcggcctccagagacggatgtcacccgtcggggcctgggctgggctggctcatgttcgagagcccagccttccgtggggtactcattctgtcagttgggactgtgtggttcttgctccttgggaaagtccatgttttggcaggaactttaaccgtgcattgcagcgcagggcccgggaagcgtgaaggctgcatggttggtcttttcctgtaaatctgtgcctgtgagccgtg

SEQ ID NO: 23076 - DNA, 1049 bp, Homo sapiens
aacaaaaaggctgcgtgtggtggctcacgcctgtaatcccaacactttggggggccgaggcaggcggatcacctgaggtcaggagttcaagaccagcctggccaatatagtgaaaccccgtctctacctaaaaatacaaaaattagccaggcgtggtgttgtgtgcctgtagtcccagctacttgagaggctgaggtttacttgtgaggaaaggattacttcagcccaggaggcagagattgcagtgaactgagatcgcgccactgtactctagactgagtgacagagtgagagtctctctcagaggaaaaaaaaaaaaaaaaaaaaagcatcaggaccgggggggtcctgcatttgatacccagccttgcttctttgctgtgggtaagtgactttgtctctctgaacctcagtttcctgaactgtaaaatagggctattaaaggtaggagaattcacttaagaggtagacagagtcgctgtacataagcaggaggtttcttttttagagtgattgaaatattttaaaattagattgtagtcatggttgtttgtacagaagtcattgaattatgtgcttaaaagggatgaatcttatggtattctaaatcgtatctcaagaaagcaaggctggggcatggtggctcacatctgtaatcccagtactttgggatgccaaggcggggtcatttgaggccaggagttcaaggctagcttgggcaacattgcaagacctcatttctccaaaaaaaaaaaaaaaaattaaaaacaagctgggcttcggcatggcgtggtggcttatgcctgtaatcccagcactttgggaggccagaacagatggatcaccggaagtcaggagttcaagaccagcctggccaggccagacatggtggctcacgcctgtaatcccagcactttgggaggccaaggcgggcggatcacgaggtcaggagatcaagaccatcctggctaacacggtgaaaccccgtctctactaaaaatacaaaaaattagccaggcgtggtggtgggcgcctgtagtcccagctac

SEQ ID NO: 23077 - DNA, 1095 bp, Homo sapiens
gtctggcctagccaattagagactctcaaccccaggctgcagtacgcggttcttggcatctgggtgagcgtggctgggctgcctccttcccatctggggggtgctacctgctggggccaggatggacgggagccaccagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgaggttggtcggccccgcccctgcttctggagcttgccccttcctcttcagcttgggctggcctgagcgatccggtgcagtctgctctcacgctccgcccctgctcgtttgcccaggctgtcttgtccttgcactgacctccgaactgtttggcttgcttggccacaccccctcctcccaagggaccacgcacagccggctcggcccctcccaactcgccctcctgcccagctttgctcgtctagccccgtccctgctttctggctcagcctccttttgcttggtgccacgtgccatccggccctctccagcggccgggtagccaccggcctgacctgactgtcccccagccctcctggctgctcaggtcctgccgccgcccccggccgaaccccgccccactgaaactcacgagccctgccccgtccccagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtgaccaggcggggtgcagtctgagggggtgctggggtcacttggaacaggcaggg

SEQ ID NO: 23078 - DNA, 1030 bp, Homo sapiens
aatcctggctcctcaggaggctgaggtgggagaatctcttgagcctgggaggtccaggctgaagtgagccaagattgcaccgctgcactccagcctgggcaacagagcaagaccctgtctcaaaaaaaaaaaaaaaaaaaagagagatcaggtagccgggcacagtggctcatgcctgtaatcccagcactttgggaggctgaggctggcagatcagctgaggtcaggaatttgagaccaggctggctaacatggtgaaaccccctctgtactaaaaatataaaaattagctgggcatggtggcagggacctgtaatcccagctactcgggaggttgaggtgttgaggcaagagaattgcttgaacccaggtgggcagaggttgcaataagctgagatcacgccattgcattccagcctgggtgacgagggaaaatccgtctaaaaaatacaaacaaataaacaaaaaagcaggtgtgtgcctgctgctgcattgtgtctccatgtaagtggctgtgtgtccagagttagtgtccccacaagagtggctgtgtctgacacttgtcctagctgtgtgtgtgccctctaagtaggtaatgagtgtcattgttcccgggtatgggtccagagtggccccaggtggcctgatagtccccctggaccaccttccagggagccatttgtgcaggccaagctgcggcccgaggacggcctgtacctcattcactggagcaccagccacccctaccgcctgatcctcacagtggcccagcgtagccaggtgagcccagggctgggggctggggctggggctggacacgttccctgcctggtcccctgcttactgctcccacctctgccacctcctgccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgctt

SEQ ID NO: 23079 - DNA, 1033 bp, Homo sapiens
ctgtaatcccagcactttgggaggctgaggtgggcagatcacctgaggttggaagtttgagaccagcctaacatggagaaacctcatctctactgaaaatacaaaattagccgggcatggtggtgtgtgcctgtaatcccagctactcggggggctgaggcaggagaatcgcttgaacctgggaggcagaggttgctgtgagccgagatcgtgccattgcacttcagcctaggcaacaagagcgaaattccatctcaaaaataaataaataaataaattaattaattaaataaaagtggaggtcaggccaggcttggtgactgagtactatagtcccaactatttgggaggctgaggcaggaggatcacttgagctcaggagtttgagctgtggtttgccactgcactgcagcctgggtgacagagcaaaactgcattacaaaaaaatgtgggagcagtaggatgtgctgaaggtacccaggtgaatatgtgggtaaaggacaaaggtgagggtgcctctagggttttgggttttagttcatttttgagacagagtcttgctctgtcaccaaggctggaatgcagtggcgtgatctcagctcactgcaacccctgcctcccgggttcaagcaattctagtgcttcagcctcccaagtagctgggattacaggtgcctgccagcctcagggtttttttgttgttgttgttttgttttttttgagatggagtctcactctgttgcccaggctggagtgcagtagcacgatctcggctcactgcaacctccgcctcctgggttcaagcgatcctccagcctcaacctcctgagtagctgggactacaggcatgtgccaccatgcccggttaattttttgtattttagtagagacggggtttcaccgtgttagccaggatgttttcgaactcctgacctcgtgatccgcccgcctcggcctcccaaagtgctgggattacaggcgtgagccaccgcgcccggcctagcctctaggatttttaacctgcgtacctgga

SEQ ID NO: 23080 - DNA, 1071 bp, Homo sapiens
aacctccgcctcccaggtcaagcgattctcatgcctcagcctccggagtagctgggattacaggtgcgtgccaccacgcctacctaattttttgtatttttatagagacggggtttcaccatgttgccccgtctggtttctaattcctaggattataggcgtgaaccacggcgcctgcccaacaaaatagtcttctattggaagtagatgccaactaggactttcaccctagagagaagtgaagtcaatgactggcttcaaaggacagcctgactcttgttaagggctaatgcagctggtggctttcggttgaaaccaattctcatttactattctgaaaatcctggggacctttagaatgatgttaagtgtacttggcctctgagctataaatagaacaacaaagcctgggtgacagcacatctgtttactgaatattttaagccaacagttgagacttcctgtgcagaaaaaagtttcatttcaaaatatgactgctcattgtcaatgcaactggtcacccaagagctctgatggagatgtacaaggagatgttttcatgcctgctaacacagcgtccattctgcagcccactgatcaaggagtacatttgactttcaagtattattattattatcttatttatttatttattttgagactgagtcttgctctgtcactcaggctagagtgcaatggtgccatctcagctcactgcaacctctgcctcctgggttcaagagattctcctgcttcagcctctcaagtagctgggattacaggtgcccaccaccacgctaggctaatttttgtatatttagtagagacggggttgtaccatgttggccaggctggtcttgaactcctgacctcaagtgatccacctgcctcggcctcccaaagtgttgggattacaggcatgagccaccaccgcccgacctgttctcctatttttaaaaattgccacaaccaccccaaccttcagcaaccaccaccctcatcagtcagaagccatcaacattgaggcaggaccctccaccaggaaaaagattatgacttgccgaaggctca

SEQ ID NO: 23081 - DNA, 1096 bp, Homo sapiens
gccggtgcacagccgcctgatcaacctgccccagctctgtgaatatgggagcatcttgggggctggagacatgacacccctttcctcagtcctgccccttgctgactcaggcagctggaaaatgaaataaggggttcctagagcctgcgaagggtgccttggggtaggggtgtcacagcccgccacaggacaagttgcagctagttttgcaaacggcagggagcatggagatcgggaagggctggtggctggacctagcccagttggcactgtgcctccccaacccacctcccactctgctccctctcctacctacctgtcgttctcggccctggtgatggaaatccgcggtgggatcagcagcggcagggtggtgggccgtggcggcagagggaccccagggtccgagggctcaggctgggcccagcccaggccaggaccggacgagaggcggcggcgagggcgacgcaggtcggcccccagcatgttggcacggtcggattcgggggtctccctcgacctctggggagggacaaagtggaataggggcgtggcctggctgggaagctctgagcccctctccccaagaacacccctacctagctgtctaagggagtagttaatggcggtataggctccccttcacgtgtgagccactcgctgacccctcacacagagggtgccctgccatcccttaggtctgagagtgccccttctcagccataatttttgtggggtcccctctcgatgccccagccttggggtctgtcacatctagacattctgtctcaagtgtgagacctctctaacacatcacctttttagggtctcttcccaacctccacgtctaagagggcccctcttggtcttaatgtcaatgcccccctcccatccctcacatctgagactctcaagacctcaccacccctagcgccccctcccacctcctcgccaaaatcctctcctcatttgagaagcctttgcctgctgtccctgggccggctgagagcctcttagggcagcaggagaaaaaatggaatcaagggggtaaactgaggcacgaggggaccaaactcctcacagcttggaggtagtg

SEQ ID NO: 23082 - DNA, 1041 bp, Homo sapiens
agctactcaggaggcagaggcacaagaatggcttgaatcacttgaacctgggaggcagaggttacaatgagccgagatggcaccactgcactccagcctgggcgacagagcgagactccgacttcccatcttaaaaaaaaaaaaaaaaaaaaaaaagaagtgtaaagatgtgattatgtggcagggggtaagggttaaaaagaaaacaagaacaagttttcctctgcttagccagcttacttcaaggacagttataacactgaaaagtcgaggccaaaggaatgggctccagacagcctcctccggagcaaagttgaaaagaaaaattcctttactgtctctccttttctgaaccattaaatatgactgtttgccaatggttgtatttagtaagatttgtagactctgtttttcttttgacacagctgcaaggccaacagctgtgcaaagccacaagttatgctaagtcagcagttatgctatagattacatgacctgtgactgtatcattaactgcttttgttttgcttctgtaagtttgcctataaaaaccacactcagtctttgttcaatggtcagcttttcagatacaaatccactgagccggtgtacatctaaataaatcctcctgtttcccgtgtcagtctctctggtcctttgtttcctgcaacaattacagaaatgagtgcctagccgggcatggtggctcacgcctgtaatccccacactttgggaggccgaggctggaggatcccttaagcccaggagtttgaggccagcttgagcaacatggcaaaacccagtctctacaaaaattagctgagcgtgatggcctgtgtccatagttccatctacttgggaggagtaggtgggaggatcacttgagctgtggaggtccaggctgcagtgagccgtgatggagtcactgcacttttcagcctggatggcacagctagaccgtctcaaaaaagaaatgagtgcatgctgtaccctctgcttttctattttatttacattttactgtggatttttaataggtag

SEQ ID NO: 23083 - DNA, 1027 bp, Homo sapiens
cagggcaggcctccctgaggagggtgagggaatgagccttgttggcaacaggaggggtgggggagacctaggaaaagaggcttccagaaacgacgtaagcttcatggcaggaacttgcatgaactgcagggcggcattaccactggagcgagtgagctgcagggaggtcacaggcgaggggacagatcacacaagcctcccatgctgtggcaagaagagatcttttttttttttttttgagacagagtctcactctgtcacccaggctggagtgcagtgatgtgatctcagctcactgcaatcttcccctcccgcattcaagcgattctcctgcttcagcctcctgagtggctgggattacaggcacgtgccaccatgcccggctgatttttatatttttattagggacggagtttcaccgtgttagccaggctggtctcaaactcctgacctcaggtgatccacccgcctcggcctcctaagtgctggaattacaggtgtgagtcactgttatctggccgagaatggatctttaagtgttttcggggtccctctcgccatcatgagtggcgagggcggaagccaggaggctggggtggaggcggccacatggtggggactgtggatgtggagagtggcactggattctggaacgtgctggggaagtagaagagactggctttgtggctagataggtgggggtggggggagtgggaggttaggagcggaggcaggctctagggatttctgcctggactaacgggatggatagagttgccacgtatccacgggaccagcttggcagtgagggcagagggcaagggtgtggatgaagccggagatgcccacccgggagcttgaactggagcctgcagtgctcagggcagagccctgggctctagaggaggcataaggccctgggcttgaaggaggtcatactatgggtgaacgcagacatggaaggggccaagaactgggcctggctgctccccatggctgaaggggtcagagagtcaaagaggaggtg

SEQ ID NO: 23084 - DNA, 1031 bp, Homo sapiens
gggccagaacctccccccgatacggcttccaatttctctaccccgaagcctaggcggctgtgaaccctgacccaggagtgagacccatctctgactcgaaccccgcccccgccctgaactcagacctcaaacccgagcctctcgtccccagaccctgaccccatcccagcgtcaaccctaagttgcagttccactttaggaggaagggaacagatgtcctccggatgcctccaaactgaggaagttgggccccaccttgggggagatcaatggctcagcagagcctccgcccccagatgagcatcggtttagcttgggcccagtcgagttctttccacccctcaaacgtgcgtgtgtcccatatacctcctccacagaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcggtgagtccctgtgtcctgcctccttgcagcccccagctgacccaggctctccgggcaggcactgaatgcccgcaatgtgcagctcctgcaggagcagcagcagcagcagcagccgggattctggaccttcagctactatcagagcttctttgacgtggacacctcacaggtcaggctggggaggcaggtgggatggggctcagagttatgctcagggttcagccactcttcccctgggcagggtgctggtgatggtgggtgctggtgaacgaactgtggtgctctcaaagggttatggtgggactggttatggatcgggactatgggaacacaggggacacacacaatctggtgggttagagaaaggcctcctgggggaggtgaggaattggctgagacctaaaggagacagaaggcttccctggggaatagggtagggaagcaggagtatatgttccaggcacagggaacagcatatgcagaagaccaaaga

SEQ ID NO: 23085 - DNA, 1045 bp, Homo sapiens
gagaatggcgtgagcccaggaggcggagcttgcagtgagctgagatcatgccactgcactccagcctgggcaacagaacaagactctgtctcaatcaatcaatcaatcaataagctgggcatggtggtacacacctgtagtctcagctacttgggaggccgaggtgggaggattacttggtcctgggagattgaggctacactccagaataggtgaaagagcaagaccctgtctcaaaaaaaaaagaaaagaccaggcgcggtggctcacacctgtaatcccagcactttgggaggccgaagcagacagatcagttgaggtcaggagtttgagaccagcctggccaatatggtgaaaccctgtctctactaaaaatacaaaaattagcagggcatggtggtgtgtgcttgtaatcccagctactcggtaggcaggggctccagaatcacttcagcctgggaggcagaggttgcagtgagctgaggtcgtgccactgcactccagcctgggtgacaaagcaaaactctgactcaaagaagagagtgtgcgtaaatagagccaagaccctgggcctcccagctgcagttagcgcaggggcagccctctctcgaaagccggggtccttaacgacctgccctactcagctcaccagagagctggaagagctcaaggagattgaggcggatctggagcgacaggagaaggaggtcgacgaggacacgacagtcacaatcccctcggccgtgtaggttctgccaaaacgtgtgcctgcctgtgcctccttgtgcagtccggctcttggttgaagttggtgctgggtaactttcttttttttttttttttttttttgtcttcctgtacaggtacgtggctcaactttaccaccaagttagtaaaattgagtgggattatgagtgtgagccagggatggtcaaaggcagtatcctttttggggagccattttaacccttgtgcactgtaggtagggacataaaatggtgcatagcaggaccctgtaaaaattagccgggtgtggtggcgtgca

SEQ ID NO: 23086 - DNA, 1023 bp, Homo sapiens
gaaacaccgtctccggtaaaaatataaaaattagccaggcgtggtggtgggtgcctgtaatcccagctactcaggaggctgaggcaggagaatcacttgaacctgggaggcggaggttgcagtgagctgagaccgtgccattgcactccagcctggatgacagggcaagactccatcccccccccccaaaaaaaaagtatcccctcagctgtgtgagaatatgtcaggtaggagcaccttataatgaacagccatggggtagagattactactcagggaagaattcaagaagacttggttgtccttcgggagggcggacagacagcgggtgggaaggctgtgtgagccagccagagcctcagctgtcctaacaggaaatcagcaggccccatccgaaccagaccgatcaagaaatagcagcataagcaagttaacttagaaatgtggaggccagtgccagagaaaacagctaaaacttgaaagtggctgcttcagagggacggagaggcttggagaagggtgtgtgcgtgtgtgttcatgtttgcagaaccatatacatgtcatactctgattaaaaataatgtaagtttctaaaacttaaacatgggccctttgggaagcattttttttttttttttttttttgagacggagtctggctctgtcgcccaggctggagtgcagtggcgtgatcttggctcactgcaagctccgcctcccaggttcacaccattctcctgcttcagcctcccaagtagctgggactacaggcgccctccgccacgcccagctaattttttgtatctttagtagagacggggtttcaccatgttagccaggatggtctcgatctactgacctcgtgatccacctgcctcggcctcccaaagtgctgggattacaggcatgagccaccgcgcctggcctgggcatttaatctgcattctctgagttggcaggtttctaggaaggaacagtagccatctttgttttattttggtttgctttgggtttttgagaaagg

SEQ ID NO: 23087 - DNA, 1116 bp, Homo sapiens
aggtgagccaggggctgctcagcctgctgggcgccaaccgcgcggaggcgcagcagcgacggctgctggggcgccacgagcaggtggtggagcggctgctggaaacgcaagacggtgccgagaagcagctgcgaggtgagggtcggagcgtggtcgcgggcccacgggggaaggggcccgggtgctgggagggggcgaccaggcccacctcaaaaccccttctctcctggactctcccatctcctgccctatgccccctgggacggccccctctgagccttagtttcaccatctgagaaatcggctttatgacagcaaccatcccccaccccccaggggtttagtggtaaatataggagtctggaggggttggccccttctgagctctccgtgagcaggagctgggggtctcagggtttgaactggggctcaggagtcaaagctccgggtttgaatcctagcacccatccccatgtccgctgtgagacttgaggtgagtttcttaaattctctgtgcctcagcttccttccttgtcaaatggttgtgacaatagcccatcccttcttcctgaaggcattcagatgttttatggagcatctgctgctgccaggccctgggctcaccgcaacctccacctcccgggttcaagctattctcctgcctcagcctcctgagtagctgggattacaggcgcttgccaccgcactcggctaatttttgtatttttggtagagacggggggtcaccacgttggccaggctggtctcaaactcctgacctcaggtaatctgcctgcctcagcctcccaaagtactgggactgcagacgtgagccactgtgtccggcccatcttcactatctgtaactgcacagttcagtggccttaagcacattcacactgctgtgcaaccatcagcaccatcatccatctccagaactttctcatctttccaaactgaagctctgtccccatgaaacactcactccccatccccttctcagaccctggcacccaccagggttctactttctgtctcaaatttgactcctctaggaaccttacgaggaattgtacaatatctacccttcctagtggaatcatacaatatctaccc

SEQ ID NO: 23088 - DNA, 1063 bp, Homo sapiens
caaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttc

SEQ ID NO: 23089 - DNA, 1064 bp, Homo sapiens
aagatcatgcaccaggtgggcccaggaccccctccccagaccccaccctcagccccactcctcatccccactcctcatccccagggatctgctgaccttgacccttctcttccccacagagttccggctgggaggtgagtcagccttggtggacagccacctgcctctgggacccccgtgatgactggccagcagccatcagtgaacaccagggggcaccagaggagcatggccgctggcccttggggctggggctgtggccacaagggacccaccccattatttccctcccttccccaaaaatgcccccaccccccgccccagatctcgagggcagcttgtgactcacccagctgggagctctccagagacacccctccctctgccagggccagcttggtcactgcaggggggtggcggggtgactcttgactccctcatggtctcttggtctctttctcatctctccccagtctatcacgtggctctccctatcttggtatctcactgtctcttagtctctgtctctccctgcgtacccagcttccagcctcccccaggctctctgctcctcatttctggttaatgtgtcctcccgctccagcccccccgaatcccgcttcttccctgcttaggtctatttttaggcatctcctagtttggggagaatgttctggccaaagatggcagaaacccagagcccaggcaggcaggctgggtgggagctgggtggggagggcaggtcctcttcgcccccgcccccctcccgtctctgatctctccccccacggaatgattctcacggggcagtgttaaccaggaccctgggggttgagggaactctgacctctgacctctcccatgacattgtctctctgtcccccacacctctggccccaccatgtctgccccatcctccccggatcggccttggtaagtgaacatccagccattctacttcctttccagtcatggggtggtgtttttagggtggtagggagggggttccttcttccaaacttagggctggggacaggagcaggggaatgccatggaacaaggga

SEQ ID NO: 23090 - DNA, 1048 bp, Homo sapiens
ctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttctttttttttttttttctttttgagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaa

SEQ ID NO: 23091 - DNA, 1029 bp, Homo sapiens
gcccacctccgtctcccaaagtgctggaattacaggcgtgagccaccacgcctggcaccccccaaccttcttcttttttttttttttttttttgagataatatcttgttctgtcacccagcctggagtacaatggcacaatctcggctcactgcaacctccgcctcccaggttcaagtgatcctcctgcttcagcctcctaagtagctgggatcacaggtgtgcaccaccatggccagctaatttttgcatttttagtagagacggggtttcatcatgttggccaggctggtctcaaactccagacctcaagtgatccgctcaccttggcctcccaaaatgctggtattacaggcgtgaaccaccatgcctggccttaatttttatattttctttagagactgggtcttgctatgttgcccaggctggtctcaaacttgtgagctcaggtacccacctgcctcagtctcccaaagtactgggattataggctgtcttaatacttttctgtagtttctagtttctccagtaaatttctctattgaatgacatccaaaaaatgtattttttttcctttttaaaatttttatttgttttagagacagggtctccctatgttacccaggctggtcttgaactcttgggttcaagtgattctcctgccttggcctcctgagtagttgggattacaggcgcataccaccacgcctgattaatatcagaaaaataagctgggcacggtggttcatgcctgtaatcccagcactttgggaagctgaggcaggtggatcatctgaggtcaagagttcgataccagcctggccaaaatagcgaaaccctgtctctactgaaaatacaaaaattagcctggcatggtggttcacacctgcagtcccagctccttgggaggctgaagcaggagaatcgcttgaactcgggagacggaggttgcagtgggctgagatcgtgccgttacactccagcctgggcgacaagagcaaaactctgtctcaacaaaaagaaaaataaa

SEQ ID NO: 23092 - DNA, 1025 bp, Homo sapiens
ggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggtagggaccctcagcttggatgtcatgggtacctggggtggggatggaaataagaggggaaccgggaagtgccctaacacccctgtggtccccataccctgcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccaggtacgtgggtttgagtgccactgccctctggagacttgttcccaggacctcagtcagcgcctatggctacaccttttccagggggggaaaaaaaaaggctaggcatggtggctcacgcctgtaatcccaacactttgggaggccgaggtgggcggatcacgaggtcaggagttcaagaccagcctgaccaacatggtgaaaccccgtctctactaaaaatacaaaaaaattagccaggcgtggtggtgtgcacctgtaattccagctactcaggaggctgaggcaggagaattgcttgaaccgaggaggcagaggttgcagtgagccgagatcatgccattgcactccagccagggcgacaaagcaagactccatctcaaaaaaaaaaaaaaaaag

SEQ ID NO: 23093 - DNA, 1039 bp, Homo sapiens
ctcctctacccactgcctttgcctgcccggggtgagggagcccctctgctccacccatgccccccatgatggcacatctgtatgaggctgaggcatggggggcagtgtgaagaacaggggcaggttccaagaaaaagaagaaaaacccttcccacagccctaataaataacagaagggtttgggatgacctgggcacaggcaaggggagacacagcaccctgaaccccaaaacctctgaagtggggcaagccctacttaagtaggggattaggagagagtgggtgagaggtggagaggccgcacacagggaggggctgagaggaaaaggggtaccccaaggaccctgccatgggggagcctgccccccaccctacagctgggctcgctgattctgagagaagactcaatgacaaacaatgacctcatctccctcctctcctttgcacatgcttagacacgggcggtcccccattgactggaatcatgcccacccactctagaaattctggaaaccaagggctcctattggctgttcagtcgctgaacactggctggagttgccctcttgcaggaggattctaagaagtgaggggaaggctcccattggttggagccaactccttttggttaaaattctgagaaccaggggttctcattagccaggcaatggccaatggggtcaagctttggcccttaaaagggcaatagtaggggcaagtgcgcaccttccatttgtgcccatcgggatatctcagagggccagagaggcagatgtctcctaaatgtccttctagccatcttctaatgtctgggtctggctggcttggggggcaggggactttggcactcacgtggcacacgcacacacacgcgtggcagggaagaagtggggactgggcagattctgggtgggtggtcgggcctcacagcaggtggtcacggctggcaaacaggtaagggctgaagttgtcccggtggaagggggagggatagagtccactcagggtgtacaggtcccgcagcaggggcgtgggcagc

SEQ ID NO: 23094 - DNA, 1018 bp, Homo sapiens
gctggagtacattggcgcagcctcagctcactgcaacctctgcctcccgcgttcaagcgattctcctgcctcagcctcccgagtagctgggattacaggcgtgcacccccatgcccggctaatttttgtatttttagtagagacggggtttcgccatgttggctaggctggtctcgaactcctgacctcaagaggtctgcctgcctcggcctcccaaagtgctgggattacaggtgtgagccactgcgcccggcggggttgcagatttaaatgtaaagatgaaaccatacccgggcctgggcctggccttttatttccttatttatttgtttatttatttttgagatgcagtcttgctatattgcccaggctggtcttgaactcctggactcaagagatcctcccacctcagcctccagagtagctgggactacaagtcacacacagcctggtttgtattttagaagaaactgtctctaggatgtgtgtggcttgaagaatggatggggtacacattgtgatacaaggttggccaagagttaacaattgttaaagctgatgatgagtccaaggaggttcatgactcttgtcaacaattaaaataaaaaaaaggaagaccaggcatggtagctcacgcctgtaatcccagcactttgggaggccaaggcaggtggatctcttgaggtcaggaatttgagaccagcctgaccaataggccaaaaccctgtctctactaaaaatgcaaaaattagccgggcatggtggcgcacgcctgtagtcgcagctgcttgggaggctgaggcaggagaatcactggaacccgggaggtggaggttgcagtgagccgagatcgcgccactgtactccagcctgggcaatagagcaagactgtctcaaaaagtaaaataaaaataggccaggcgcgatggctcacgcctataatcccagcactttgggaggccaaggtgagcaaatcacgaagtaaggagttcgagaccagcctggccagcatattgaa

SEQ ID NO: 23095 - DNA, 1053 bp, Homo sapiens
atctcttgtaccgtgtgcctagaggaattccagacgcccataacgtgtatccttggaaacctgggctttttccagagggtggggagggggctggagtccggaccctgctcatctggcccactgtgtgccctggtgcagggccaaagccgtccagaggaacaggtgccacctagtgatttctgtggggtgagaagatgcagggcagggttccaatgccaatgatcgcccttgacctaagtggcccagatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacatcccttgctgtccgtgatgtcttgggttctgcgtctgcctgg

SEQ ID NO: 23096 - DNA, 1059 bp, Homo sapiens
gtcctaattaggggagaaaaaaatcaggctggcgagagccgcagaaagcaaagagataaagtaaataagctacaaatctgcctttcttcatggtccaggacatataaacaaaaagaggcagataagttataggtctgctttatggcccaggacatatggccctcctgctcagataacatacataactcaaacttcctgcttatcaacaaacgcttcaatttatcaaacaccacagcggccagaaaaatgcaaattagccccctgctgccttggcgttatcaatcagccaaagttccagtccataaaatcctcagcaagcctgtttccctgcattcagcttctcttctgctgacctgcctgttgctgcctcgcaacgaattttcatactttctccgataaacctgccttcctttacctacaattgtcttggtaaatacttttacccccggcgcaccactgccccagatagtcatagctcacccgcgacgaggcaagaggcgaggaggcaaaagaggagtgggtaacctgtctttgcttccactttggcagaacttgttctgtagcttcttaaaacacaacccaaacgtcgcttctctgctcgaaatccaataaaagtccttaatacggcccaccaggctccatgggatcagtcccttgcctgcctgcctgcctaaccaggtctattactacctcagcactctaactgcggtccgcggaccagcagcatggacgacactggggaccgagtcagaaatgcagaggatcaggccttccccaatgacctgctgaatcagaatcttttaaaaagatctgtagtttcttgtgaaagtttgaaaagaacgacttactagcttccactttataaagagtattttatattcctcacctgtgggatattgatcagagtgtgctgtggagacccggtgagttcgaggggctggggctggaactgggagaagagacaagtgaaacatccccgagatgatgcagccgaaggcgaggccgctttcgcagcacttgtatggcctgatggcccggcccacggctcctggcgtgcag

SEQ ID NO: 23097 - DNA, 1050 bp, Homo sapiens
agagtctcactctgtcatccaggctggagtgcagtggtgtgatcttggctcactgcaatctctgcctcccaggttcaagcgattctcctgcctcagcctcctgagtagctgggattacaggtgcacaccaccatacctggctaatttttgtatttttagtagagacggggtttcaccatgttggtcaggctggtctcgaactcctgacctcgtgatctgcctgcctcagcctcccaaagtgctgggattacaggcataaaccaccatgcccagcacaaggacaaatattgtatccttcccgttatatgaggtgcctagaatagccaaattcatagagaaagtaggatagacattatcaggagctggggggaagggagactggggacgtgtttaatgagtacccaatttctgtttagagtgatgagagaatgctagagatcaatagctgcgttggttacaccacatcgtaaatttatttactacaactaaatggcacattttaaaaatgatcgaaatggcaaattctctgttagtatattttacctccaaacaatctaaaaactaaagaaaaaaacatgattcaagctactaggcatgaaaacaacatctgggataacaaattacactgagtggaataaacagcaaatcagatactgcagagaagaagacgagtgaaccttgtgacctagcagtagaaactatcccaaatgaagcacccagcaaaaaaaacaacaacaacaaaaaacagaaaatcagtgagctgtgtagtgggaaaattacaagtgacataatatgcaaataacaagactctttggcagaggaaagagcatgacaaaaaatatttcaacaaatactggtttcacatttgccaaactggatgaaaattataaacccagaaatcaaaaaagttcaacaaaccatgagcatatatgtatataaatctacaccaagcacatcatcagtaaactacttcacagcaagaacaattaaaatagctttaaggcaacaggaaaaagacacattaactacactgaaccaaagataggattc

SEQ ID NO: 23098 - DNA, 1025 bp, Homo sapiens
tgacctcaggtgatccacccaccttggcctcccaaagtgctaggattacaggacagaaataatttggtttcctccataccagaatttgattggctgactagccatgtgtccccaaggaatggaaacgggttggagaagaaaaggcgtgtcccaagggattagttttttacaataatgatataggagactggtcccaccccatagcatccagctgctccctggggaggcctcaccgccacacctcaggctctttgggaggaacgacctaggggctgatattcactagactttcccaagagacttggcagctgtaggcatcttgggccagccccaggtagtcctgaaacccaggatcaggaaaaggcagagggtgggctgaggtcgcatcactgtaaagtttccaaaggggaatctcaacccaagacattctcagaaggtgtctgtgcctagggcagataaaaagagacacaaagattgtttacagcggagtgtcaggtggtttttctctgaaacgttcacaaacacaaaacaaatatttttaaaacggccatatactgccctctaaaaaaatgacgattaaaatactgcctgtgtttgaaacatagcctggaggacgaagaagtgatactgttgtgaactaaaggaaatccgtgttataaaatgcggaaagggatcaggaaatcccaaatttgctgccagccttaggagaaggtagcctagggaccacagtcgcggatttgagaccctgcttcgcgtatatttgggaaactcagataaaatacaaaagcccctggtgagaaagagggaactggggaccccacagcctacagctcctctcacacgaaccccatactcgaggcaggatttcccccatgaccctctagtggcccccgtacaatctggggagacacggaggcagcgggcgtgactggggcagcgggcgcggagctgaccagagagggcgctgggcctggggccacagtcagttgcacagggactggaccggacggctaggggtctcggct

SEQ ID NO: 23099 - DNA, 1032 bp, Homo sapiens
ttaaatacatagaccagtgacactataaaacaaccacacaaacaagtctgcataataaccagctaacaacatgataggatcaaatctacacatataaatactaaccttgaatgtaagcaggctaaatgccccaattaaaaggcacagtggtgacttggataaaaaagcaagatccaatggtatgctgtcttcaagagacccatctcacatgcaatggcacccttaggctcaaagtaaagggatggagaaaaatctactccacaaacaaaacagaaaaaagcaaaaggacatggtttggatttgaatctccacccaaatctcatgtcgaattgtaattcccaatattgaaggtggggccttgtgggaggtgactggatggtggtccttcatgaatggtttagcactatccctgtggtgctgttcttgagatggtaagttcttgtgagaaccggtcatttaaaagtctgtggcaccttgccctgctctctcttgctccttctctggccgtgtgaactgctgctccccctttgccttccaccatgattgtcagtttcctgaggcctccctagaagctgagcagatgccatccttccagtaccatgcttcctgtgcagtctgcagaatcatgggccaattcaacctcttttctttataaattacccagtctcaggtatttctttatcatgctgcaagaatggaataatacaagaaaattggtactgagaagtggcgcattgctatcaagatatctgaaaatgtggaattggttttggaacttcttaacaggcagaggtttggaagagtgtggagggctcagaagacaacaggaagatgagggagtttgagactttgtagaggcttgctgaatggttgtgaccaaaatgctgatagtgatataaagttcaggctgaggaggtctcagatggaaaggacaatacttataagtatttattgggaactgaagcacaggtcacttttgtttttccttagcaaagagcttggctgcagtgtgcctctgccctagggatatgt

SEQ ID NO: 23100 - DNA, 1024 bp, Homo sapiens
attacaggtgtgagccaccatgcccagcctggaaaattttttctaaaaatgaatgaatttgaagctgggctgcttcattttctttgcttgcttttaacatttgttgtcattctaacaatatcttaagggacatagctctaggttgtaagtgcaaatgaccttagatttcttttggaattattgtactgatcttcaatgatctggtcttcacattttattcctaaaatgcagacccataaaagtcatcataagttattacaaaattatagaaaaattattagattctatgttcatgggacactgtggccatggctgatttattcaccaaagttcagttgaaccttgaccaacatggttttgaactgcacagttcactcatgcacattttcatcagctcttgccatctctaagagagcaagaccaaaccctccttttttgctcaggttactcaatatgaagacaaccaaggaagaacaccttgataatctacttgcacttactaaagtcaacatatcttctcttctaatttttttgataaccttttcaaaagaaaagcttactgtattataagaatacagtacataacataccaaacaggcttggcatggtggctcatgcctgtaatccctgcactttgggatgctagggaggaggaatgcttgaggccaggagttcacgaccctccaccttacaaaaaaattatacaaaaattagctggggatggtggcactcgcctctagacctagcaagggaccctgtcttaaacatatatacacatacgcactttttttttttttgagacggagtctctctctcttgcccaggctagagtgcagtggcgtggtcttggctcactgcaacctctgcctcccaggttcaagtgattctcctcccttaccctcccaggtagctgggattacaggtgcatgccaccacaccaagctaatttttgtatttttagtagagatggggtttcaccacgttggccaggctggtctcaaactcctgacatcaagtgatgcac

SEQ ID NO: 23101 - DNA, 1033 bp, Homo sapiens
caatggcgtaatctcggttcactgctacctccacctccttggttcaagctattcttctacctcagcctcccaagtaactgggattacaggcatgcaccaccacacccagctaattctgtatttttagtagagacagggtttctccatgttggtcaggctggtctcgaactcccgacctcaggtgatccacccacctggacctcccaaagtgctgggattacaggtgtgagccaccgcgcctggcccagactggataattttaattgtttcatcttcacagttgctgattctttgttatgttagcaagtagtgaattggctcacttccagatgtacacacaagccaatagcatggcaccagcttttgaagaaagaaaagctttactacaagtttgactggcaaggagaaaggaagaaatgctcaaatatgtctccctgagctgggggctttggcaagttttataagcgtggggtaataagacatgaactcactgcatcttgcaatgatctcatgccaggttaatgtgactcgattggatcctgccatgggatgataccggggcccaacctgattagatcctagattccaccatgtggtatcttttttttttttttttttttgagacagagcctcactctgtagcccaagctggaatgcagtggcatgatctcgctcactgcaaccttcacctctggagctcaagcaattctgcctcagcctcccaagtagctgggactacaggtgtgcgccaccacacctggttaatattttgtatctttcacagagacagggttttaccatgttgctctgggtggtcttgaactcttgagctcaggcaatccacccacctcagcctcccaaagtgctgggattacaggcatgagtcaccgtgcccagcatctactttttactttaatctccacacctcagtccaagcatataggttccacccatggttacacatttggttcatctgggcatgctcagattatgtgaccttgagtgttgggtccatggcaactgaaaactcagc

SEQ ID NO: 23102 - DNA, 1051 bp, Homo sapiens
cacccaccaccacgctaggctaattttttatatttttagtagagacaggatttcaccatgttggtcagactggtcttaaactcctgacctcaagtgacccacaccagtgtctcccaaagtgctgggattacaggtgtgagccactgcacccggccttctaatctttttccagccttcaaattttttttttttttttttttgatacagagtcttgctccaggttggagtgcagtggtgtgctgtcggctcactgcagcctccaactcccaggttcaagcgattctcctttctcagcctcctgagtagctgggactataggcgtgtgcccccacacccagctaatttttgtatttttagtagagacagggtttcaccatgttgaccaggctggtctcgaacttctgacctcaggtgatccacctgccttggcctcccaaagtgctgggattacaggcgttagccactgcgcccggccatttttgtatttttagtagagacgggtttctccatgttggccaagctggtcttgaactcctgacctcaagtgacccacctgcctcagcctcccaaaatgctgggcttacaggtgtgagctactgcgccaggcctaatatctttttttttttttgagacagagtcttgttctgtggccaggctggagtgcagtggtgcaatcttggctcactgcaacctccgcctcccaggttcaagagattctcctgcctcagcctcctgagtagctgggactacaggcatgcgccaccacgcccagctaatttttgtatttttagtagagatggggtttcaccatgttggccaggatggtctcaatctcttgacctcatgatctgccaccttgggctcccaaagtgctgggattataggcaccacgcctggccctaatctcttctcaaagtacttttttctttaatgaatgtcttaaataaaaacttttttctaaccacaaacttttttttaaattattttattatgtaatttttttttagagagttggtcttgctgtttggacccggctggagtgcagtgatat

SEQ ID NO: 23103 - DNA, 1051 bp, Homo sapiens
tgggattacagatgtgagccactgcaaccagccccaatgatctgttttctttctttcttttttttgagaccaagtctcgctctttcacccaggctggagtgcagtagcacaatctcagctcactgcaacctacctctgcctcccaggttcaagcaattttctgcctcagcctcccgagcagctaggactacaggcacccgccaccacgcccggctaatttttgtatttttagtagagacggggtttcatcatcttggccatgctggtctcgaactcctgactttgtgatccacccacctcggtctcccaaagtgctgggattacaggcatgagccaccgcgcccggcctccaatggcctgttttttaacaagcccttcagatgattctcatgcatgagaactagttcatcagagcaacctgttaaaatataatgcaaaaagatatcactaaaatgtaaatataattagtaactaaattggaacactagagaatattgatttgattcagagacatcaagaaaggatgaacgggggaaaaacacaaaaattgtgctgaaaagatttttgttttctttatttgcctcaatctgtttgacacatgctaaaatctgaggctatgggtcatgcagtttactcacacattgcagtgctcataggacttgacttttttttgagttttttttgagatggagtctcgctctgtcacccaggctagagtgcagtggcgtgatctcggctcactgcaagctctgacccccgggttcacgccattctcctgcctcagcctcctgagtagctgggactacaggcgcccgccaccacgcctggctaatttttttgtatttttagtagagatggggtttcattgtgttctccaggatggtctcgatctcctgacctcgtgatccgccagcctcggcctcccaaagtgttaggattacaggcgtgagccaccgcgcctggccaggacttgacttttaagttaattttttgatgttgttgacaatgttatttttggttttgtctctacatgctaacagttcatgaattt

SEQ ID NO: 23104 - DNA, 1056 bp, Homo sapiens
caagcaattctccttcctcagcctcccgaatagctgggattacaggaacatgccaccatgcctggctaattttgtatttttaagtagagacagggtttcaccttgctggccaggctggtcttgaactcctgacctcaggtgatcctcccgcctcggccaatgaaagttctgggattacaggtgtgagccactgcacgcagcctttttcttttttttttgagacatggtctccctctatcacccaggagtgctgtggtacgatctcagcttactgcaacctctgcctccagggctcaagagatccttccacctcagcatcccaagtagctgcgactacaggcgtgcgccaccacacctggctaatttttgtatttttggtagagatggggtttcaccgtgtcgcccaggctggagcatttttaaaaaacttttatttacttttattaccccagagaccatgtaataggtttctcaggtcttttattggatgatttcaaatggaatttcagggcttagcagtgtaaatactaccaagggaaaaatttgggaaaactcttccattttggctgcagaaaaatgaatatattttcacaagaatgtgtggtaggtatttggttgaattataaagctttatcaaaactttagtttctcttctttttaggctggagaacttgggacagtggataagtctggtctgttcctgttatctggacttggcagattaatgcaacattctgtgggactttgcaatagctaaagaacttaaatatcctttgtttactaaaggcttcattattatggaagtagtaactgatgtttattatctgagatggatagatacttgtgcttttcttgttgagctataaaatagaagtgacttacaatttccttccctcctgtaaacactgaatttgagtgattttgatagattcatcacacatggagttttgtttgtttgttttatgttttaaatccacgtaaggcatgaaagggtaagcaaatggccttgactggggtggagaggcttgaggccagtgactccaagtggaggccaat

SEQ ID NO: 23105 - DNA, 1034 bp, Homo sapiens
atgaagtgagtatagattctcagtactgtgattttcacccttcctcctctgtacatgtgggatggatcaggcctcagtggctttagaggatgtggctgtgaacttcacccgagaagagtgggctttgctgggtccttgtcagaagaatctctacaaagatgtgatgcaggaaaccatcaggaacctggattgtgtaggtaaggatgacatcgcatttccacttatttaattggagacatttgtttcttggtcattcgtgctgttcaaagatttggaatatggaaaggggatatggttggccctggaaaaaaaaaaacagggtttaggggtgccagctcctgtagcagttgtacatcctcatataactttttgtccacatcttagcctactattgatgggcagcattatcagtcacataagcagtgattaatacatatattttatgtcgtattattacatcgtatattctcacagtaaagtaagctagaaacagaaagtgttaaaaagataatcataaggaagagaaactgtatttactgttcattaagtggaagtgcatcatcagaaaggttttcattctcattgtcttcacattgagtaggctgagtaagaggaggggctggtcttagtgtcttgggtagcagagactgaagaacattcatatatatatgtatatacaaatggacttgtgcagttcaaacctctgtttttcaagagtcaggtgtacttcagtgaatgcattttgaacgattgcagtgtacatcaaaatgttactgtttgtctataattttgtaaaaatttgtaatgatttttctgtgtataccttttaggaatgaaatggaaagaccagaacattgaagatcaatatagatatcccaggaaaaatctaaggtaatttatactcacaagagaaagatatgtccctggagccgttctgagaatgatatgaaaatttaaaaacaagcaaagaaaatgaacaagcctagcttaaatttatttattcttagaaaattttctccaaaatatatacttaa

SEQ ID NO: 23106 - DNA, 1029 bp, Homo sapiens
tcttaagttgccttggatatttgacatgatcattttgctgttgtgcagactgaatgacccaatatgtaccacccaaaaaatctatggatgtttagagggtaattttcaaggaataatggaggtgagctgcagacagggaatcattttgcataatagcctaatttaatggaaaggaagaatatttggtgtcatcatataaggaaaaatttaatgccttcttacaagagtagtagtttgaatctttttgtttcaatgcttccagaaagtccccagatcccaatttggtattcacatgtttgggaagagtggggggaaagtaaaatatttgtgtcttactaaatttgagcaaaggaaataaaatctttgtccattttttttcagtggtaacttatgttagtacttagcactgtgatttcataattataagtatctcatttgattgctcaaccaatcagttctcccatcttacagatgaagaaagttaagtacagggcacaggatcctacccaaactcacgtaactcagaatcatggaatctctggattttgaagtcctaatgtgtgccaccacctgtactgggcactgccaaaaaaaaaaatttttttttttttgagactgtcttgctctgtcacccaggctggagtgcagtagtgcaatcttggctcaactgcaacctccacctcctgggctcaagtgatcctcccacctcagcctcccaagtaactgggaccacaggtgcacaccaccacagctgacttttttcttttttcgtagagatggggttttgccatgttgcccagactggtctcaaactcctgagctcaagtgatccacctgcttcagcctcccaaaatactgggattataggcgtgagccaccatgcccagccaaaaactttaaacttagaagaacattgcaaggtttgtataattatatccttttaaaatattcatattttaaaacttattttaaaatttgttttgcaatacttacacactttttctgccacatgggatggaagtgagaaca

SEQ ID NO: 23107 - DNA, 1034 bp, Homo sapiens
ttgagcactgagtgaacgagactccgtctgcaatcacggcacctcgggaggccgaggctggcagatcactcatggttaggagctggagaccagcctggccaacacagcgaaaccccgtctccaccaaaaaaaatacgaaaaccagtcaggcgtggcggcgcgcgcgcctgcaatcgcaggcactcggcaggctgaggcaggagaatcaggcagggaggttgcagtgtgccgagatggcagcagtacagtccagcttcggctctgcatcagagggagaccgtggaaagagagggagagggagaccgtggggagagggagagggagagtatcgtatagcatttctctaagatgctgtgtatcctgtcattggagagcataagacttgaagtgatcatactaaaaatgtagaaataatttccaagtattcatggtggtgttaaatttatgaagaagtaagtgtggacgaagatttgagttctgatgacaaagttacaggataaatggagaaaattatatatgaacttttaatgaactgagtttatatccccagtgctgtcagtctcacccatcctcccctatacatgtgggatgtttcaggactcagtggtctttgaggatgtggctgtgaacttcacccaggaggagtgggctttgctgggtccctctcagaagaaactctacagagatgtgatgcaagaaacctttgttaacttggcctctataggtaagaatgaaattattccctcacttagtcaattagagaacaagtgtttcttgctcatcagcaaggttccaaggtttagaatgttgaaagggaatactttggtaaataaatcagacaggataacagctcatcctagatttagaatctaataatttttctgtaatttcgaataggtttaatgatttttctgggcctgcattttaggggaaaactgggaggagaagaacattgaagatcacaaaaatcaggggagaaagctaaggtgagttgtacttacaaaagaaaatactgtcttatgagagaatcttag

SEQ ID NO: 23108 - DNA, 1043 bp, Homo sapiens
cctgggtagtgtttcttggcctggacttatctgtgtgttttagagtgaagctgtgactgctgctgacctggcatacaaggtgctcatgggaaagactacctgccagagcagtcatttttgaaaaagagacaaaagagagggggaaaggcagctgttagatggtgggccgagtccacactcctaatagcacagggctcccaaggacccttaagtgttgctgctgttgctctattgcagcaaggatgctgaccctcaggattatagggcacactcatgtttcctctgcagcattgcaaagggttcattcaaagccagcttaaggcccaggtgcttaaactttataaagcaaccatgagggacaggcccctaagcctgataatagtgatttgtggctctctggagggaaaagaacacccctcccctgtagagaggattttgctgtcaaaatatatccagggacaaaaacaaaaacaaaacaaacatgttaggaaggaaaggaacaaaagaaaaaaatgctgaaaaagaggtccacaatttgacccaattggaaattccaaatagactaaaggaatttagacggcaaaaaagataaaagagcctctatatcataggttctgtattaattttaacatcttatgtaatgtattaattaacacactataggattagccaatacaagggctcaaattatggttatacctgggagacccactaaaatttaagcaaggtatcccctgataatcttaagggagttactgaatataaaatagaagacaaataagtatgtctcatcttagccatcataactgtgcctaaattccccatgttcatggcacccagtgtcctaaaatacgccagaatgaacaggtaaactctaaaccagtgagtcataagtgaaatttaaattaaatctttggcacttacaaactggcttgacagaatgagaccctgtggaacttactccccagttaaattagttatgatggctcaatataaattgaacagggccttgaagggttgaaaagtattatgtaaaacttgtt

SEQ ID NO: 23109 - DNA, 1041 bp, Homo sapiens
gtggtgtgatcatagctaactgtaacctcgaacacctttcttggctcaaatgatcctcccacctcagcttcccaagtacctaggactacaggtgtgcactgtcacacctgaatttgtaaattttttgtagatcctcactgtgtccaggctggtgtttttttttccctttggattcctttatttgctgactattacagcagctgaattctagtttctgttaacactttttaatgttattccatatgtgagtgtgttaaattttgtttcttgggtttgaaaatgtaagtcgattgaaaggtatgatgcaactaaggcaagaaaattctgaaaccaggccgggtgtggtggctcacgcctgtaatttcagcgctttgggaggctgaggcagaaggatcacttgaggtcagaagttcgagaccagcctggccaacttggtgaaaccctgtcgctactaaaaatataaaaattaaccagacatgtaatttttggtgggtggctgtaatcccagctactcgggaggctgaggcaggagaattgcttgaaccccgggttgcaggggaggttgcagtgaaccgagattgtgcactgcaatccagcctgggcaacagagcaggactccatctcaaaacaaaaaaaaagaaaactctggaaccaaacagaatatttgtttcttttaggcaagagaacctcaagataagagatgaatgtatttacattctcaggtacatttttcatttttagatcggtttttgtatgtgcatgtcatagagtacttggaaatttaaaagaggccaggcatcgtggctcatgcctgtaatcccagcactttgggaggctgaggcaggtggattgcttgagcccaggagtttgagactagcgtgggcaacatggcgaaaccctgtctctacaaaaaaaaaaaaaaattagccaagtgtggtaattttagctgggtgtagtcccagctactcaggaggctgagatgggaggatcccttgagcctgggaggcagaggtggcagtgagccaaaattgagtcagtgtg

SEQ ID NO: 23110 - DNA, 1075 bp, Homo sapiens
atggcttgagagagtaaggaaaggagcctggactgggtgtttactgtgattgggggtggggcagtaggagagttcatttcccctcgaggggaaaagcttcttaggtgggactctccagcaaggcccaaggagggaacgcctcagctttctcagcttgtccaggtattgtaaacaaaaaataaaatccaaagcaccctcctgactgaacagaccccttcttggccaagggaaccccataacaaccctaaacactgaattcccaggccaggcgcagtggctcacacctgtaatcccagcattttgggactgaggatggcttgaggccaggagtttgagaacagcctgggcaacacagtgagaccccatctccacaaagaaagtaaaaattaactgggcatggtggcatgcacctgtagtcccagctactcaggaggctgaggtaggaggatagcttgagcccaggagttcaaggctgcaataagctataatatgactgtgccactgcactccagcctggttaacagagtgagaccctgtcttgaaagaacaaaaacaataaaaactgaattcccagccatgggaagggaggtcggacacaccctgttataacccctcccttttggagtttaggcacaactgaccagcattaatgttaaaatagagaccataaaactaacaaaactctttatgacaataagataccaaattataaataagacctaaggccatgctctccaagggttaagtcacaaactctaggtcattccgacccagtgtattggttaacagattttcttatctttttttttttttttttgagacagggtctcttgctttgtcacccaggctggagtacagtgacataatcactgctcaccacagcttggacctcccaggctcaagtgatccatgtagtggggaatataggcatatgctgccacacccagctaatcgtttttactttttttttttttttttttttttgagatggagtctcactctgtcgcccaggctagagtgcagtggtgcagtcttggctcactgcaagctccacctcccaggtttacgccattct

SEQ ID NO: 23111 - DNA, 1052 bp, Homo sapiens
catgaaattttaaaaataagtaaacaaaccagtaagcccagcttcagatttatttattcctacaactttttcaccagaaaaagaaaaagtggcatagatgttcagtgttgcaaaatcattcacttggaaatagtattaagaaactgtatatatggatatcacttttttggtgatagctactgtcaagctctcttgcagagcattccatccattcactttcaaacaattcatacaggcctgaaaacttaccctttccgcgattatggtaaaaatgtaagtcgaatacctattaataaatataaagtcacaaaccactaaatcttgctttctattttttccagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgat

SEQ ID NO: 23112 - DNA, 1056 bp, Homo sapiens
tccacccaccttggcctcccaaagtgctgggattacaggcatgagccactgcacccggctatttcagtttttagaagtggtcccttccctttccccttccccttccccttccccttcccctcccctccccttctctcttttttttttttttctgagacgaagtttcactcagtcacctaggctggagtgcagtggtgtgatatcagctcactgcaacctccacctcctgggttcaagccattctcctgcctcagcctcctgagtagctgggattacaggtgcaccccaccacgcctgactaatttttttgtatttttacaaagacaaggtttcactgttttggccaggctggtcttgaactcctgaccttgggtgatctgcccgccttggcctcccaaaatgctgggattacaggcgtgagccaccgcgcccggccccttcttttcttttttgtggtggagtttctctcttattgcccaggccagagtgcaacggcatgatcttggctcactgcaaactctgcctccgggattcaattgattctcctgcctcagcctcccaagtagctgggactacaggatgtgccaccatgccctgctaattttgtatttttagtagtgacagagtttcactatgttggtcaggctggtgtagaactcctgacctcaggtgatccacccacctcggcctcccaaagtgctgggattacaggcatgagctatggtgcccggcccttttttcttttccttcctttctttcctttttttcctttccttccttcctttccttttttcttttctttcttcctttccctttctttccttcctttcttccttgagatggtccccctatgtcaccaggcatgatctgcactggcgtgatcatagctcactgcagcctacaactcttgggttcaagcgatcctcctgcctcaacctcctgagtagctgggactacagacacgtgctatcatgcccagctaatttttaattttggttgaggtttcattatgttgcctaggctgatcttgaactcctggcttcaagtgatcctcct

SEQ ID NO: 23113 - DNA, 1031 bp, Homo sapiens
gaggtgattctgtggaacccctggatactttcagagtggagactggtgaccagaaagaccaaacccatgactagagggttgttgctttaagctccattccctaccccaggaaagagtggaggctggagattgagttgtgtaaaaatttttgagcaaagacattcagagagtacttccaggttgatgaggacattgatgtgctgggagggtggtgcaccccaagatgaggagcgttgcctatatccacccccctttccctgccatttttcagctcttatttgcctgttcctgagttatacttaagtaacatgttttgctaagttctttgaatagttttagcaaattattgaacccgaggaggagattatgggagctcacgatttgtacacagttgttcagaagtgtgggtggccctgcggcttgtgactggcatgtgaactggcatgttgtgagactgagccctgaacttgtaggtctgtcctaattctgagtggtgtcagaactgaactgttagacacctgctgttagaactggtcggtgtttacacttcgggtgtcacagaaaggacaccagaggtcagaaccttaaactgactccaggtaaacatctggtcactggtgagaatcgagaccgtgaatcacatcatgaggagaggagagtagggtgcgtggagctcccaggatgtttccctcactcatttcttttttttttttttttttttgagacggaattttgctcttgttgcccaggctggagtgcaatggtgcgatcttggctcaccacaacctccgcctcctgggttcaagtgattctcctacctcagcctcctgagtagctgggattataggcatgcgccaccacgcccagctaattttttgtatttttagtagagacggggggtttctccgtgttggccaggctggtctcaaactcctgacctcaggtgatccacccgccttggcctcccaaagtgctgggattacaagcatgagccaccacacccggctccctcactcatctcttaggagtgg

SEQ ID NO: 23114 - DNA, 1027 bp, Homo sapiens
cgaactcctgacctcatgatccgcctgcctcagcctcccaaagtgctgggattacaggcatgagccaccgcgcccggcagaatcctgggttttaaaaagggagaattattgacgggcatggtggttcaggcctgtaatcccagcactttgggaggccgaggcgggcagatcccaacctaaggttgggagttcgagaccagcctgaccaacatggagaaaccccgtgtctactaaaaatacaaaattagccgggcgtggtggctcatgcctgtaattccagctactcgggaggctgaggcgggagaatcgcttgaacccgggaggcggaggttgcggtgagcggagatcacgccactgcactccagcctgggcaacaagagagaaactctgcctccaaaaaaaaaggggagaattattatgaggctagatcatgtgatgcttttacagtgcacttaacaattttttttcccaaagacatttctaagtgtctaaaccacactttttcttaaaatcctgagtagcttctgttgcaatagctattttttttaattgttgttttttttgagacagagtctcgctctgccaccaggctggagtgcagtggcgcgatcttggctcactgcaacctccgcctcccaggttcaagtgattctcctgcctcagcctcctgagtagctgggattacaggcgcgtgccaccacgcccagctaatttttgtatttttagtagagacagggtttgaccatgttggccaggatggtctcgatcacttgacctcgtgatccgcccgcctcggcctcccaaagtgctgggattacaagcgagagcctccgcacccggccggaatctatatttcttaatttttaatttttaattttgtagaggcgggttcttacagtgttacccaggctggtgtgaaaatcctggcctcaagggatcctcccgaagtgctgagattacaggcttgagccaacgtgcctggcctttaaatgtcttaaaaggaagtaaattctgacacatgctacaa

SEQ ID NO: 23115 - DNA, 1022 bp, Homo sapiens
atggggtctcagttctttttttttttccttttttctccttcccttccttccttccttctctcatatctctgcttttctttcttttgctttctttctctttcctttctttttctttctttctctctttttcttttctttctctctctgtcttttcttttttcaacacgactgagcctcactgtcgcccaggttgctgtgcagtggtgtaatcacagctcactgccacgtggaactcctgggcacaaaccatcctcccacctcagcctcctaaagtgttgagatgacaggcatgaggcacccagtacggcctcattcaaattttctaagtccgcttatggaagcatgcacctgcagtcccaactacttgggaggctgaggcaggaggatcactccccagaagtcaaggtgacagtgaactatgatcgcaccgctgcaatctagcctgggtgatagagcaagacctcatctcaaaaaaaaaaaaaaagtttgacaggtggtggaacacactagaacttcaaaactttgagactctataattctgatttacatgagtttgggaaagaccctgtgctctctctgcctctgttttttcatgtgtaagatgggaggaatcccagcactttgggaggctgaggtgggtggatcacctgaggctaggagttccagaccagcctgaccaacatggtgaaaccctatctctaccaaaaatacaaaaattagctgggcatgttggcacatgcctgtaatcccagctactcgggaggctgaggcaggagaattgcttgagcctcggaggcagaggtttcagtgagctgagatcgcgccattgcactccagcctaggcgacagagtgagactctgtctcaaataaataaataaataaataagtctatgaaacatttatttctggaattttccactaagtatttttggactgtgtttgaccatgagtgactaaaaccacagaaagcaaaactttggatcagaattgactactgtattaccataattaattctgaata

SEQ ID NO: 23116 - DNA, 1032 bp, Homo sapiens
ggaggctgaggcaggagaattgcttgaacccaggaggcggaggttgcagtgaggcaagattgtgccactgcactccatcctgggcaacaagagcaaaactctgtctcaaaaaaaaaaaaagaaaaaagaattatgtgggccaggcgcggtggctcacgcctgtaatcccagcactttgggaggccgaggcgggctgatcacgaggtcaggagatcgagaccatccttgctaacacggtgaaaccccatctctactaaaaatacaaaaaattagccgggtgtggtggcgggtgcctgtagtcccagctactcgggaggctgaggcaggagaatggtgtgaacccgggaggcggagcttgcagtgagccgagatcgcgccactgcactcccgcctgggcaaaagagcgagactccgtctcaaaaaaaaaaaaaaaaaaagaattatgtggcggtgactgaaggttgaccttgatgtaggccttaatggggtttatggccagggttgggggacatttgtaggactcacctctgctcaggtacagactgacatccacctcacccgtgtgcccgcagacacccttggtgcaggaggtgcaccagaacttctcagcttggtgttcccaggtggttcgcctgtacccaggacagcggcacctggagctagagtggtcggtggggccgatacctgtggggtgagtggcacaggctgggagaggggtgtggaagcaagggcagaggggtttatccaaggctcacaaccttgccatcccattgggtacagcgacacctgggggaaggaggtcatcagccgttttgacacaccgctggagacaaagggacgcttctacacagacagcaatggccgggagatcctggagaggaggtggggggtgactgagagcactgagggggtggtctgtggtgtgttggggcccaggggtggtgagggaaatttgctgattacatgagtgtgggagacagaggacgaagggagagtgaagggcgggggagccaggcagggtgcagtggctca

SEQ ID NO: 23117 - DNA, 1033 bp, Homo sapiens
ccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccac

SEQ ID NO: 23118 - DNA, 1033 bp, Homo sapiens
atggtctgtttctggcctgactccccaccaggctgggacatgtcaaggacagggctcagggcttgaaaccatgcacagggatgctaagatgtagctccagtttcttgaatgactgcagccctatctcacccaaggttagacatggccgtcggctcccccttgcccaggggtcagtgccagttgctcggcctggcatctgcagcccagcctgaccccggatcttgccgcacctgccgccaccctgaagcctttgtttcctgactgatgcatgcgcaggctacacctcttaacatatgctgttccctttgcctggaatgcccttcctgcctcatcttctctctagcccaagctgggcacggtgtctcaggcctgtaatcccagcactttgggaggccgaggcgggtgaatcacttgaggtcaggagtttgagaccagcctggccaacatggtgaaaccctgtctctactaaaaatacaaaaattagccaggtatggtggtaggggcctgtaatcccagctactcaggaggctgagacatgagaatcacctgaaccctggggggaagaggttgcagtgagctgagatggcgccactgcatttgcctgggcaatagtctcaaaaaaagaaaaaagggccgggtgtggtggcttacgcctgtaatcctagcacttgggaaggctgaggtgggtggatcatgaggtcaggagtttaagaccagcctgaccaacatagtgaaaccctgtctctactaaaaatacaaaaattagctgggtgtggtggcacgcacctataatcccaactactcaggagactgaggcaggagaatcgcttgaacttgggaggcggagtttacagtgagccaagattgcgccactgcactctagcctgggcgacagagcaagacttgtctcaaaaaaaaaaaaaaaaaaaaaaaaaagatcctagccttcaggccctggagtgactgaggtaaggacagggctgagatggggcaggcatctaggtatgaagtagggctgggggcacctcacctc

SEQ ID NO: 23119 - DNA, 1050 bp, Homo sapiens
gcaaaactccatctcaaaaaaaaaaaaaaaaaattagcagagtgtagtggcatgcacctgtagtcccagctctttgggaagctgtggtacaaggattgcttgagcctgggatgtggaggctgcaataagccatgatcgcaccactgcattcatgcctggatgacacagcaagaccttgtctcaaaaaaaaaaaaagagttcctgggccaggcacagtggcacatgcctgtaatcccagcactttgggaggctgaagcgggcggatcacctaaggtcaggagtttgagaccagcgtggccaacatggtgaaaccccgtctctactaataatacaaaaattagccgggcgtggtggcacaagcgtgtaatcccagctactagagaggctgaggcaggagaatcacttgaacacgggaggcagaggttgcagtgagccaagatcaagccactgcactccagcctggatgacaaaagtgaaactccgtctccaaaaaaaaaaagtttctgggtggggtgtgcctttcctggactctgaagtcaggctgacccatggacacaaactttaatctgtactcaacttgaacttgctctggtttcatctatgcaatgggggtgatcacctggagccagagttgggtgttgtacttgctgcagcatctatcaccatgggcactggggaggaagagctatgtggctttgggtgagtctcttgacctctctgagccttacctgcaaaaacagaacgatcccagtctgggacccccatgggctgtggcaggtgtgtgactgctgctcctgtcctgcagggctgggtgtggtcactggcagcgcaggaccaccgcgtgtgctccggctcctgggacagcacagtgaagctctgggacatggcagcggatgggcagcagttcggcgagataaagtgtgtgggggcctgggcagggggcctgcggggataggaccctgtctggccacagccaaagccctgtggtctgtgtgtccctagggccagctcagccgtgctgtgcctctcctacctgcctgacatcctggt

SEQ ID NO: 23120 - DNA, 2063 bp, Homo sapiens
caggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactccttagtctgtggcttcctgtgtccttggctttggtagtgaagaaatgtcgggggcaccggggatacttgagagtgggaagatagacgaatgtgaaagatggaagattaaatttgtaacatatatgaaatgtgcagctcattctctgggacttcagctcactaagggtgagccattagtgtcacagcccaggttcaagatgcccctctgccgtactctaaactgagtggtaaggggtgaggccttgccgcactcttatcatcagctgaccctgggtcaaggttttcatagaaggttcagcccagccccaggccgagggtaatttaattaatattagttacaattactcaggcaaatgagaagtagtttcagctgtggggggaaaccacaatcttcagaataaaatctttcttttttttgagaccgggtcttgctccgtcacccaggctggagtgcagtggcgcaatcatggctcagtgcaacctcaacctccctggctcaaccagtcctcccacctcagccacccaagtagctgggactacaggtgcatgccaccatgctggctaatttttgtattttttgtagagggggttttcgctatgttgctgaggctggtcttgaactcctgggctcaagcaatccacctactttagcctcccaaagtgctgggattacaggtgtgggccaccgcccccagccaaaataaaatcttactgcaaccttggtgtggcccaaagaccaacgtgggaaaatttaaaaatactgacacacatccaatattcaacaaataagtcctgcattctagtgagaggatagagtataaaaagtggaactgtgctaagtcctatagagaaaaacaggaaggcagagagaatggtgggggaaacggttgaaatcttatgtagggtgacctgcaaaggccacactgagaagacgatgtttgaacagagccatggagagaagagtgtcaagtagagcaaacagcaaggactgcgcagatgacctacgtggattggttagctgcctggctcaaaagaggcttgcagtaaatacctgcagtttttttgtttgagacggagttttgctcttgttgcccaagctggagtgcaatgatgccatctcggctcactgcaacctccgcctcccaggctcaagtgattctcctgcctcagcctctgagcagctgagattacaggtgcctgccaccacacccggccaattctttgtatttttagtaggaaggggtttcaccttgttggccaggctggtcttgaactcctgacctcaagtgattaacccaccttgcctctcgaagtggtgggattacaggcctgagccaccgcacccggccaacatgctgttttagtaagtgtgatgttaggccgggcgcagtggctcacgcctgtcatcccatcacttcgggaggctgaggcgggcggatcacgaggtcaggagtttgagaccagcctggccaacata

SEQ ID NO: 23121 - DNA, 1014 bp, Homo sapiens
ttgttctgcccctgcctacccctcaccaccaccctccccacagattctccacggcttcaaagaccaagttggggaagataactggcagcagttctctgagcaattcccgccgctgctcaaggagaggctggcggctttctatggggtctaggtgatcatggagactgccaggtaaggagactgcagctggcaagtcagcactgtcttgggggccgaaaggtcccaggccatgaccttcctcctccccctgcaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgag

SEQ ID NO: 23122 - DNA, 1327 bp, Homo sapiens
gtgcataggtgcatatgcaaacactatgccccccccaccgccccccacctgttttttgagacagagtctcactctgtcacccaggctggagtgcaatggtgtgatctcggctcactgcaaccttcacctccagggttcaagcagttctcctgccttagcctctcaagaagctgggactacaggcgtgtcccactatgcctggctaattttattgtatttttagtaaagacagggttttgccatgttggccaggctggtctcaaactcctgacctcaagtgatctgcctgcctcggcctgccaaagtgctggagattacaggcatgaaccactgcgcctggccctaacactgtgccactttatatcaaggacttgcacatccgtggatttttatatctgcagggacctggaaagaatcccccacggacactgagggatgaccgttggggcactgccatctcccatttgcagatgtgggctggaggctagggaggttaaggaacagctaggagctctagaactggaaagtggcagaggctggacatgcaccagggactgtgccccctgagctgtcctggttagaaggaggggagcctagccacactgatcttacttgaatccccaggactcgatgcctgaggtccggcagagctcctttgccctcctgggagacctcaccaaagcctgcttcatccatgtcaagccctgtatcggtacgacactcgccttgtccctaacccatgaccccagccccggcctcaagtgatggagagcaatacccggggatgactgtgaccacattgggatgtattcgtactgtctgatggggcctgctggactaggtcctgcagcttaccctggctggccctccttctcagcacccctgtttctccccaccagccgagttcatgcccattctgggcaccaacctgaacccagagttcatctccgtctgcaacaacgccacctgggccattggtgaaatctgcatgcagatgggtgagtgccctgcaagtggcaacacgcgccccccattagcctgttctcaacctgggggcgggagcctagctctgactgacagcttccttcaaggcaagtctcttgggggtcgtcaggggtggagccaagcagaaaggtcatttgtgattggcttctctaaagaggagggataggagggctgttctgattggaccgttttgtgtagttggctaaaagactcattcggattggttgggtgactttggctttttttttcctttgacttgggcagcgtgttgtcaccttagcgactccagagaagcctctgttgtttggagggtgtgggtctg

SEQ ID NO: 23123 - DNA, 1001 bp, Homo sapiens
ctttacctggctctgtgaaatgagtctgggccagtgatttaaactctaagcctcagtttccctatatgttgtgtgcggctgactcttctctccatacggtgggtgtggctgggcccaatcaaactgccccctcttggttccctttccttgtaggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcaggtgaccctggacccctgatcccacagcccccactctcccccggccaccctctgggaagtgatgacacctgtgactgttgatgtggaactgatttatcgcgtattcgtactggctgatcctgagttgccctccccaactgcccatggcccagtgtcacctgccatggtccactgagcccccgcttcatcctccctcccaccagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggtgagaccccagagcggctcccgcctcccgatccccgtgcccctgggcatccagtgacctggtggcaaccccgtgttgcacgccagggacgtggccgtgacctcgacaggcagacagacagacccggccccgccctcgccctgctcccagtctagtgggggagaaagacagttatgagacagcgtggtaagtgctgtgcttcgggaaccaggaggtggtaacccaggctcccggggggtggggtgggg

SEQ ID NO: 23124 - DNA, 1589 bp, Homo sapiens
gcagagactagattccgataattccccagagggaaatggatcaatttgcacctagcagtaccatcatgctctgcagggtctgctctgtggctgattggggggctggtcactctgttggcacctgtttgcctcctccccaagctgtgcctccccccaacttttgccacggcccctgcatccccataaacagtccctctctgtgcaggttgatccccatcttggtgaatgggatgaagtactcggaaattgacatcatcctgctcaaggtcaggcagggcccacccagcatgggtgggcatgggcgtgggtgtcgcggctgtggtccccaaagtacttaacagtctgcctgtcccccagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgagtgtgtgcccctgcctgggggtggtggtggggtggcaagccctggactccctcttgggaggtgactagaagctgaggcagaagctgattagaagctgatcgtggccgggcgcagtggcttacgcctgtaatcccagcactttggaaggctgaggcgggcggatcacgaggtcaggagatcaacaccatcctggctaacacagtgaaaccccgtctctactaaaaatacaaaaaattagtcgggcgtggtgtcgggcgcctgtagtcccagctactcgggaggctgaggcaggaaaacggcatgaacccaggaggcggagcttgcagtgagccgagatagcgccactgcactccggcctgggcggaaaaagtgagactccgtctcaaaaaaacaaaacaaaaaaaaagaagctgatcgtgaagattctgagcatgatctctgatcctgggagtgcagtcaaggagggtcggccacctgcctgaggggccgccctgagcctccccattgttcccccttccccagggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggtgagtgcgcctgatctctgagccctgtgctggcatgagactgtagggctggcccacattactagccacaccaatgcctcagttctccctggaggcctactcaccccactccaaacagctctgagatctcaattctccccttggttcctgggcctgaaaggaacccctggagccccacagtgcaaggcctcttgttcattcttgcaggcaggtagttctttcatgttgtaagcataattacagcaacaatgataataacagcaggcacagctgcatgcttgcctcgtgcacttatgtagacaaacatccttggccctcaccaccacctgatgagctgggtgccggatcccagtttcgaagatggggaaactgaggtacagaaagattgatg

SEQ ID NO: 23125 - DNA, 1022 bp, Homo sapiens
ccatctcaaaaataaaaagtaacttttagtcctgcaaaaaccccctcccaggccagtagtaggatgtggacttcctgagctcattctatgtgccaggctctttgctaagtcattgaaacttactgatccaggctgagcacagtggctcacgcctctaatcccagcaccttgggaggctgaggcaggtggatcacctgaggtcaggagttcgagaccagcctggccaacatggtgaaactctatctctactaaaaatacaaaaatttgctgagtgtggcagcgggcacctgtaatcccagctgcttcagaggctgaggcaggggaattacctgaactcgggaggtggaggttgcagtgagccaagattgtgccactgcactccagcctggactacagagtgagactccatctcaaaaaaaaaaaaaaaaaaaaagagagaaaaagaaacctactgataaccttagttaggaggctggttttctttatctcttctgagggctggaagcactgaggcacacagaatgagggggtgtggctaaagttccacaatcctcactgtgtacctacccattgcagggagcacctttctctcgttgagtttccacccttgggaaacactgccatctcatggcagcaaataccatctctgcacttaacagaacccatatccagctctgtcaccagatatgtgcactgtcctggcacctcagatgcctgctgtatgtaactcctggatatctaataggcagtacaagcatccctgccaccttcctgcccttacctcctttccctctctcatcatgcctgtccttacgccaggcctttgcaccatagagtcccctgcctcagatgccctttccccagaaacctggatgattcctccctcgcctccttcacctccttcaggccttggctcagatatcaagatgtcacctcaacgaggcctgctctggccacccaatttaaagttgctaccttcacctacagccctttctcaccatcttttctgctgtatttccccc

SEQ ID NO: 23126 - DNA, 1173 bp, Homo sapiens
ttttttcaagatggagtcttgctctgtcgcccagactggaatgcagaggcgcaatctcggctcactgcaaccttcacctgctgggttcaagcgattcccctgcgtcagcctcccaagtagttgggaatagaggcacgcacacatcatgcccggataatttttttgtatgtttagtagagatggggtttcaccacgctggccaggctagtctcgaactcctgaccttgtgatccacccgccttgacctcccaaaaagtgctgggattacaggcgtgagccaccgcgcccggccccttatatgaatttgacgtgtctgaggtgctctgtgtcattgtgggcttattagggagcgggatcccccaggagctggcagcctggtcccagtggtcagagatagtgtcaggtacataatgaggggacctggctgggggaaggcctctgtcttccaagtcccttaacagcctggcagaaactcaaacaactcaatcagtttcctgacttcaacaactacctgattttcgtcctgaccagactcaagtcagaaggtacgccctctgctcccttccatgcgatcgggaccctgctttctccccctgggcccctgaacctcagccttcctcctcccagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggtgagaggggcagcgggggttggcctctgaggacacactgaactctcacttctcagcatgttaagtgtagtgcttcatggaatgctctggcaccctctatggtagtactattactattgccatttgatagatgaggaagctgaggcgctgagctattaagggacctgtctgggtaagcagcagaagtcagaaacagctgaggcagtgcagggccacgctctggaaccactccctcctgaaacagtccttcttggctctgagacagtcatgcaacatctagaattttgtgttcggccttgggctgagtgctaagggtatagcagttaaaataatgcaggtattcatgtttcaggtgcaacggaattaggttttcagcagagccttttctgactcttg

SEQ ID NO: 23127 - DNA, 1050 bp, Homo sapiens
gagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtaaggagccgtgggggtgggggcgggcgccacggcctgtcttggcagcgggagtcggggcccgtgaagggggatcgggaccgaagtccactttccgttctgaatgaggggcccgtccgggtcacccgctgagggtgtggaacttggattcccgacaactggggtctaggggcgggagtggggactccaggagcttgcccgtgggaactgggagctgaggaattgcctaggaatcagcactgtggagaatgaggaaacgtggatatcaggattcctgtttgagtggtacccggaccttgggtcatgggaccaccactaattgtgaggaaagggagtaaatttaagtctggactctgagctatatgtgttagactcagaccacgtactatgtaaggacaattacttatctaggacaattgcttgacttccttgtatcttattcgaccaacctccatttattgagcaatttacctcgtgctaggcattgtgctaggtgctggtatgcagtggtgagcttacagacaagatcgctgctttcctggagcctctgggtttgcctaccctcattttccctagttgcaaaaatagacatcatagcatctcttgatgtggtgagggttttatgaggtgatcctggaaaagtggttagcacagagcctgtcttccaggaagggctaaactggtggttctcaattggggcagttccctccacccc

SEQ ID NO: 23128 - DNA, 1865 bp, Homo sapiens
gaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtgatcaaccatttgttcatccattcatctatggagtactcaccctgtgccaggcctgggcattcagcaaggaataacacagacaaaaacctgccccacacagccatcattctagtgacaagcaacacatacacaaccataaaaattaacttccaggctgggcgcagtggctcatgcctgtaatcccaacactttgagaggctaaagtgggtggatcacctggggccaggagttcaagaccagcctggccaacaagttgaaaccccatctctactaaaaatacaaaaattagctgggtggggtggtgtgcacctgtaatcccagttacttgggaggctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttggtgtgatggaggaatggcagagagggcagaacagagcaagagggcaagatttgtaggagatgaggtcatcaggggcctggcaggccatggtgggggtgtggattctatttttaagtgctgtggaaagtcaaggcagggttttagcagagcaaagatgcaacctggcttgggctttataaagctccccctggctgcatggagagaaataaaatgtaggcagcaaaagtggaagaggagaggcagctggtgcactaatccaggtgagaggtaaagatggatgggtagggctgaaggatggtggggcaggtggtgagaagtgacttggttctggagacatatgaaggaagatggtcaggcaggccgggcacagtggctcatgcctgtaatcccagcaattttagaggctgaggtgggaggattgcttgagctcaggagcttgagaccagcctgggctacatagcaaaacctcctctctacaaataaaaaaaagtagtcgattgtggtggcatatgcctgtagtcccagctactgggaggcagagataggaggattgcttgaccccaggaggtcgaggctgcagtgagccaagattgcaccactgcactccagcctgggtgacagagccagaccctgtcttaaaaagctaaagcaaaaaaaaaaaaaaaaaaaaaaagaaacaaagatggtcaggcagacaaaaggggcagacagccagacaggtcacccctagaggaaggcgcacgcagacagaataggatgagatgagcagggaaggagaagtgaggtggagagaggatgggacctacagattcagagtgggaggcctctgaacttgtccacagttccttgttcctccctaggtcagcaatctgaagatggtcttacggagcctagtagagtactcccaggatgtgagtaactgtaaagggattcagggggttgagttgggagaagggtgggcccatgagcccctgacacccccttctccccaggtcctggcgcatcctgtgtcagaagagcatctcccagatgtgagcctcattggag

SEQ ID NO: 23129 - DNA, 1050 bp, Homo sapiens
tactgtttgcttagctgccatgaaaaccggttccagcctcatcccttgagccttaaaaaggagcagctctgaaccattagcagctcaagcaggttgtgaacaatcacacaaaaagaaacacctggtgctctcatcgattttaattttagggtctgaaactgttgagagcatccaggagaggctgagacaacaaggtgaactgggtacgaggaggtgtgggagccccaatgtcagtgctgcattcatttagatattcagcaaactgatgaaacctttggggtgctgcaaaacaaatgagtagggtgtagtctgcaccctcaaggtgtcgtgcgctggaggggactgatgttcataaactttggcagctttgtgaccagcaaggcctaggtatagcggggggtagagaagcaaaagttccaaatgttccattatgaaggaggcaggaagggaaagtcattccaggcaaaggctgacatgtttggggaaattgtggtaggtccccaattgctgcagatggaggggctgtagaaaacagtaaggctagatcgggcttggtggctcacgcctgtaatcccagcactttgggaggccaaggcgggcagatcacgaggtcaggagttcgagaccagcctggctaacatggtgaaaccctgtctctactaaaaatacaaaagttagctgggtgcagtggtgggcacctgtaatcctagctacttgggaagctgaggcaggagaattgcttgaacccgggaggcagaggttgcagtgagccgagatcgtgccactgcactccagcctaggtgacagagcaagactctgtcttgaaaaaaacaaacaaacaaaaagaaaacagtaaggctgcactgggcacggtggctcacgcctgtaatcccagcaatttgggaggccaaggcaggtggatcacctaaggtcaggagttcaagaccagcctggccaacatggtgaaaccctatctctactaaaaatacaaaaattagctgggcatgatggcaggtgcctgtaatcccagctactcaggaggctgagatg

SEQ ID NO: 23130 - DNA, 1035 bp, Homo sapiens
ggctaaggcaactacgtggtcagtgaaggcatcatggaggaagaagtgccacctaagcaaaatctagaggtagataaagaggtaaaccatgagagtatctggggaagggtgtcccaggtagtggtcacagtcagttcaaaggcccagaggtgggaatgtgctttttgtattaggagaagagtgaggaggctggtgtggctgaaggcggagggtgagaggtgatagagcagttggcgcagggccctgtgggtcatggggagaacttgaacttttcctctgaagaagatgggagccatggaaatctgagcagaagggtgcacgtgctgacctcatgataaactctgttccctcccccacaagcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccatctggtggctttccttaggggtgaggggtcttgttgggtccccctagctcagtgtgccacttgatggtcaaaattctgggtactgggctgggcgaggtggcccgcgtctgtaatcgcagcactttgggaggctgaggcgggcgggtcacgaggccaggcgatcgagaccatcctggctaacagggtgaaaccccgtctctactaaaaatacaaaaaaaaaaaaaaaaagtatgggtactgagccaggcacagtggctcacttctgta

SEQ ID NO: 23131 - DNA, 1029 bp, Homo sapiens
ccctggacgccacgcacctggctgagttccaccagatcgagggcgtggtggcggatcatggtctcaccttgggccacctcatgggcgttctgcgggagttcttcaccaagctgggtgagcaggggggcaggggtgggccatggtggtgaggcagcgggcaggtgtgttgatcaccagcattatcctccaaacccctgctctcctgcccgccccccacttcctgcaggtatcacgcaactccgcttcaagccagcctacaacccatacacagagcccagcatggaggtgttcagctaccaccaaggtcagggtaggccctggtactggggtgggagggaggtctcaggctactatggtttggcctgggtccccccattgccatgcctgtaccccacctcccaagctcaccacctagacccagaacctgtaccagcagtgcccagaaactcaacacgcactgcccgtcttttctgtcctgcctctgcaggcctgaagaagtgggtggaggtcggaaactcgggggtcttccgtccagagatgctgctgcccatggggcttcccgagaacgtgtcggtcattgcctggggcctctccctggagcggtaagtgcccaagtggaaactcggggtgtccagctgcctcaaataactctccaggtataggggcctgcgtggtttcagcaccacccattcattcatccaatggacaaaactttcatcgtgagtacaaactgaatgctcagccccgtgctgtgaacatgacagcttatgtccctccctctgaatctggggtcccagtggagcgagaaggatgataactagcaagaccaacaagtacatcaggccaggcgtggtagctcatgcctgtcatcccagtgctgtgggaggccaaggcaggaggatcgcctgagccaggagtttgagatcagcctgggcaatagagcaagtctccgcctctacaaagaataaaaacaggccaggcgtggtggcacatgcctgtaatccaagcactgtgggtggctgaagcagg

SEQ ID NO: 23132 - DNA, 1051 bp, Homo sapiens
ttcacaatattgaccaggctggtctcagtctcctgatctcatgatccacccacctgccttggcctcccaaagtgctgggattacaggcatgagccaccacgtcctgctaattttttttttttttttttttttttttttttttttttgagacaaggtctcactgtatccaggctggagtatagtggcttgaccatagcctactgcagccttgaacttctgagctgaagggatcctcttgcctcagcctcccaaatagctgggactgcaggtgtgcaccacgacactagctaatttttttaaaaattcgttggtagagacagggtctccctatgttgcccagcctgggctcaagtgatcctcctaccttagcctcccaaagtgctggaactaaaggggtgagccgtgcccggcctttaatgtatttagctatacatggcaactgtattggacagtgcagttctagagttctgtgggacatagttcttggagaggatggcagtaggatgtgctaacttatgtgggcgtggctgtcaggatcccagctggaagtcgatgtggggcactcagccccagcactcagagatgacggaagcgcctctgactggtgctctcccatctccctcccaccccaggtccagtggctcctggacaactatgagacggctgagggcgtgagtctgccacggagcaccctctactgccactacttactgcactgccaggagcagaagctggagcccgtcaacgccgcctccttcggcaagctcatccgctccgtcttcatgggcctgcgaacccgccgtctgggcaccaggtagggccatccgtctactcccagcagtccctggggaattggtgggcatgccaaggcccacccccactccgagtcatctcaggcagtccagtccagcccagtcccgccggcctctgcgaggctcctcgacagccccgctcactcccactctaggcctttgcactggcggtgccttccacctcatgtgcttctcacccctccttacttgcacgtcccctgactgcctcaactaaaact

SEQ ID NO: 23133 - DNA, 1010 bp, Homo sapiens
acgatttgcagcctcaagcctgtgtcaccggtgcccatcccgtcacgcgatatctgaaggagagaggcttccccagcctgggataggtagcttggctcaggggaaacatatctgcattcctgatggtcttctccaatcacagcgtcgccttctctagtcccttccaatcacagcatcgccttctctagccccacccccttcctgcttcactcactgcctgatcaccttctgttatgatctctcatttacctttgcacgtggcttcttgcctgtctccccaactagacggttccgggggccggggcttttcattcttgtccattgctgtgtccaaagtgtgtgaaacagtgcctagcacacagtaggcactcgaagtacttgccaattttatttttttaatgaagtgtgtagcattccaagttccctaacccttcggtatttttttttttttttaattaaaaagacagggtcggccaggtgtggtggctcatgcctgtaatcccaggactgtgggagactgaggcgggtggatcacttgaggtcagaagttcgagaccagcctggccaacatggtggaacaccaactgtactaaaaaaatacaaaaattaacctggtgtggtggtgagccctgtattcccagctccttgggaggctgaggcaggaggatagcttgaacccaggaggcggaggttgcagtgagccaagattgcgacactgcactctagcctgggtgacagagcaagactctgtctcaataagtaaataaataaataaaataacaaaaataaaaagccagagtctcactgtcacctaggctttgctgcagtggtagtatggttatagctcactacaaccttgaactcctggactcaagggatcttcctgcctcagcctcccaagtagctgggattgcaggtgtgcaccagcatgcctggctaatcttcatattttttgtagagatgggttttcactatgtggcccaggctagtcttgaactcctggccttcaa

SEQ ID NO: 23134 - DNA, 1060 bp, Homo sapiens
aagccacagcccctgggcctccatccctggtcctgttctggggggcatccagagctgcacacattcatttattcagtcattcagcaaccatctaccaaagcaacctttttgcagcacacattgcatgctgggtgtgcaggagtgagcaggctgtggcccccgccttggagaagtaggggctcttgctcaggtcatgtgctcttggtgtcactttgtgtggtagacatagggcaggacagagagatcgagagctggacctgatgtgtgacaaagaccatgcttccatatctccttccactgtccccctcaactccctctctttgttcacccacaaccactcgggcctgtgcggctccctcccctgccaccttcagagtctgagccaggccacctcttgactgaccacactgtctttctggatgtttaatttttttttttttttttgagatagagtttccctcttgttgcacagctggagtgcaatggtgcaatcttggctcactgcaacctccaccttcagggtggttctcctgcgattctcctgcctcagtctcccgagtagttgggattacaggcgcccaccaccacacccggctaactttttgtattttcagtagagagagggtttcatcatgttggccaggctggtcttgaactcctgacctcaggtgatccacccgccttggcctcccagagtgctggggttacaggtgtgagccaccgtgcctgcccctgcccccctccctttttttttttttttttgaggtggagtttcactctgtcacccaggctggagtgcagtggcatgatctcagctcactacagcctccacctcccaggttcaagtgatcctcctgccccagcctcctgagtagctgggactacaggcgcctgccaccatgcctggctaatttttgtatttttagtagagacggtttcactatgttggccaggctggtctcgaactcctgacctcaagtgatccacccgcctcgtcctcccaaagtgctgggattacaggtgtgattacactgcacctggcctaatgctatgtttttaa

SEQ ID NO: 23135 - DNA, 1076 bp, Homo sapiens
tacacaccagtcttttggcctccctgctctggtttcctcatttgtgatgggatcatcatagctcctctctctcaggggacgcatgcgagggtctcatagccaggatggccttgagtgggcacttcagggaggtcagctgggggtgagggcctggacatgtcacctccccttcctagagcagccgccctgttgttttgggcaggatccagggactggcccttttctttatttttgcttttctttctcatgacataagctaaggcacgcaggacctgtgttgagagcaggccatcttggacagacctgttgccctctgagcatttcccacagtaaacatagtgacgatgttttgactggtttagggtctgcctgagggctgggtctctgtctcgactgactcagtgctctggtgggaatggcagcacagcctgggcattaggctagattcgtgtgtttttttggtttagagatggggtcttgctatgctgtccagactgacctcgaactcctgggctcaagtgattctcctgcctcagccttgtaggtagctgggactacaggcgcctgccactgtgcacagctagtgtgtttttaatgtgctctgtggtggacggaggcctcagtgggagcccggatcaaagctggccctggtccttctcagagtgggaatggaaggggtgagatcatcagggcatcctgaggggctgtggaaggggtgggtcaagatgggattggggaccatcaggtcataaagagtcatcaaaacatgtagcaattggccgggtgtggtggctcacacctataaccccagcactttgggaggccgaggcaggtggatcacttgaggtcaggagttcgagaccagcctggccaacatggtgagaccccatctatactaaaaatataaaaattagctgggcgtggtggcgcgaacctgtaatgccagctactcaggaagctgaggcaggaaaaatcacttgaacccggaggcagaggttgcagtgagctgagatcgtgccactgcgctccagcctgggtaacggagcgagaatccatctcaaaaaaaaagtaatgaa

SEQ ID NO: 23136 - DNA, 1071 bp, Homo sapiens
ccagctgatttttgtacttttagtagagactgggtttcgccatgttgaccaggctggtcttgagtgcctgacttcaggtgatccagccaccctggtctcccaaagtgttgggattacaggcgtgagccactgcgcttggccaaggccggccctgttctgaagtcagccgcagctgccaggttctcagtgcagcctgggcctgctcccagccctgtcacccctggccacagaagggcactgtcccactgatgagcttacatctggtgtcaagacccataactgctcccagacagagggcccaaaaagcccctgtggccccatgcagctcacaggggctttttggactcaaaacaccttcccactgggaatgctactcagccgagaatcccaagtccagatggcaggcacgtagggaactggcacgggtccctgggaggcagctttccccatgactctgctttccggcaataaactgacgagtcaggagcatagaacacccagagttcaaatgcagccctgccaccacttccccgctgtgtggcctggggcaagcaccttaacctctctgagcctcagctccctatctagcagacagaacccaaacccagacatggttgttggaaagtttaaaatgaaataggccgggcgtggtggctcacacctagaatcccagcactttttgggaggctaaggcaggaggattgcttgagcccaggagttcaagaccagactgggcatgataatgagactcccatctctgaaaaaaatgattatatatatatatatatatatatatatatatatatatatatatatgtatgtatatttcaatatacatatacaatatatatacatgtgtacatatatgtatacagtgtatatgtgtgtgtatatatatactatatatgtatatatatgtacatgtagatttcaatatataagtaaaaaaatacacacacacacacacacacacacacacacacacacacatatatatttagacagagtcttgggtctcccaggctggagtacagtggtgcaatcttggcttactgccacctccgcctccca

SEQ ID NO: 23137 - DNA, 1037 bp, Homo sapiens
ccgccttcccaaagctccctctccaggccggccatggattcaaagccaggcactgtgacacagggtcagacaccagcccaacaggaggagaacaagagcactcttgggggaagtggtgtttatgtgcactttcttcccgtaaatatttttgtgatcggactttataccaggcactgctataaagcagcaatgtaactagcagaaatgtaacctgagccacagaagcaattttaaattttctgtttgctccatcataaacagtaaaaacagccaagcacggtggcgcacgcctgtagtcccagctactagacaggctgaggtgggaggatcacttgaacccaggagttcaactccagcctcgacaacacagccagaccccatctctaaaaaaacacccaaagtttgtaattaaaagagaaaatgaaagaaacaggtgtcattcatgaaattcattttaatgacatgtttggggcttttttttatgtttttttttttttgagacagagtctcactcttgtcgcccaggctggactgcagtggcgtgatctcagctcactgcaacctccacctcccaggttcaagtgattctcctgcctcagcttcccaagtagctgggattatgggtgccaccaccacgcccagctaacttttgtatttttagtagacttggggtttcaccatgttggtcaggttggtctcgaactcctgacctcaggtaatccgcccgcctcagccttccaaagtgctgggattacagatgtgagccaccacacctggcctaatgatatgttttaattaagccagtatatctacagtattaccctttccatatattatcaatgtgaaaatatcattaatgaaacattttacattccttttgtttttttcccagtcctccatgacttcggaaatatttcctttttttctgtactgaagtatctttaaaatccagtgtctattgtatgcttacaacagttctcaactctgatggtaaatttttcctggaaagataagaaaaagcagggaagttgaaaaag

SEQ ID NO: 23138 - DNA, 1043 bp, Homo sapiens
gggggctcctgtgtggagacacctgactgcccaatgccaggcacccccatcccaccacccctcccaacggcccgcccctgcccccagcacagctgccagcagcttccaggccccaggccagggccggatctggcccctgccacccgccttaaggaatgtgccctctgccatcttgattttccgccccctgtcctcaccccgctgaccccacgtgctccccggggccccctctgccggtggcagaggggatgccccagaccttagccaagcaggccgcggggagggcgtgccctgagcctaccgacccctctgcccacagaacacagcccacttggatcagtttgaacgaatcaagaccctcggcacgggctccttcgggcgggtgatgctggtgaaacacaaggagaccgggaaccactatgccatgaagatcctcgacaaacagaaggtgaggtggcctgtcctcgctcagggcctgcctgtcaggcctttgcctggactgtgcccactccttagagtgccctatccacccgttcactcacttgcttttttttgattcagagtctcgctctgtcgctcaggctggagtacagtggcgtgatctcggctcactgcaacctccacctccctagttcaagcgattctcctgcctcagcctcccgagtagctgggattacaggcgcctgccaccacacccagctaatttttgtatttttagtagagatgggttttcgccatgttggccaggatggtttcgaattcctgacctcaggtgatacacctgcctcagcctcccaaagtgctgggattacaggcgtgagccaccgcgcctggccgcttggtttttttgtgggggacaggatcctgctctgttgcccaagcaggaaagtgcagtgacgtgatcatagctcactgtagcctcaaactcctgagctcaagagatcctcctgagtagctgggactacaagcgcacactaccatgcctggctaatttttttttgttgtttgtttgttttttgttttagacagggggtcttgctgtg

SEQ ID NO: 23139 - DNA, 1062 bp, Homo sapiens
gcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttc

SEQ ID NO: 23140 - DNA, 1032 bp, Homo sapiens
acatttcattgatcgtaagtttgcagagacaccacctcacgtgcatggcttcacatgtattactctccagtgaacagcgcaggggctttaaagtccatttaaagaaaaatgccaaggatataatagtgtcagctacactcacaatgaaagagatgaggggtggccaggaaagcactgtttagcgggtgactcctccttcttagccctgaggatgatgctgtgctggggctgaaaatagaagaaccctggtgggaaagagagagcaggcaggaaacaaaaagtgcccacacaagtcctctgggcttggtgtgttagttcgttcttatactggtataaagaaatacctgagattgggtagtttataaagaaaagacatttaattggctcatagttctgcaggctgtacaggaagcatagtagcttctgcttctggggaggcctcaggaaacttacaatcacagcagaaggtgaaggggaagcaggcacgccgtacatggctggagtaggaggaaaagagaacaggggaggtgctacacacttttaaacaaccagatctcaacagcacggaggggatggtgataaaccattcattagaaactgcccccatgatccaatcacctcccaccaggccccacctccaacactggagatcacaattcaacatgagatttgggtatggacacagatccaaactatatcacttggtttccagctccactgccccttcccaatttgggggtgtctatgacaccatgaccctggagcatgcacccccacccccgccaccccgtctatgtgtttctttcccaatgccctgtttctcctctgaaggtgtaacaaccgcacccagtgcgtggtggtcgccggctcggatgcctttcctgacccctgtcctgggacctacaagtacctggaggtgcagtacgactgtgtcccctacagtgagtcatcttgttccttgtgcggatgcgggcccttctcgcatgagtgagtgaggaggagacaccttgacccatcacacatgtgcacaca

SEQ ID NO: 23141 - DNA, 1034 bp, Homo sapiens
atgaagggggcccagatcccagatccccaccttggttcccccaccccccacccaaggcactcagactcccacccactcgagcacgcagagggttgccatggcaactgcaggctagggcaggctagaggcgccccctctcccccagcagccgcttctcctcctgttgctctccccatccccatcacagggcacccgaggacagagtctgggcctcagtggcccaccctgccgcaccgacccttgacttgagacagacgcagggcttagatgcgaacatacaggcaggtgtgcagccccgtttcccatgggtgagatagggtcgcctatggctgggtgcaatggattcctgggtacacctgtaatcccagcactttgggaggctgaggcgggaggatcgcttgagcccaggaattcaagaccagcctgggcaacatggtgaaacctcatctctacaaaaaacacaaaaattagccgggcatggttttgtgtgcctgtagtcccagctactcgggaggctgagctgggaggatcacttgagcctgggaggatgaggctgcagtgagctgagagtgcaccattgcactccagcctgggcgacacagcaagatcctgctgtctcaaaggaaaaaaaaaaaaaagagaagaaagaaggaaagaaaaaagaaagacaaataaggtgaccagagactactgaggtgcaaggtggggacggacacaggtgtgggctcacctggcttcccaggtgtagaacgtccaggcgtgaccagctctgaggttgcatagacactcaaatacagtgtgggcccgggggtgggggctcttctggccccccaggatccccccacagctcaccaagcccaacctggggagccagccctccctgggttcaagcccccttaccagttgagtgtccctgggtatatctcttcaatgacaggacctcactttcctcctctgtaaactgtgggtacaagcatctctccttcctaaatggttattaggattacatgagttacacgtggaagctgctcggg

SEQ ID NO: 23142 - DNA, 1080 bp, Homo sapiens
cctggcccggtttcttgcaaaactttctgaacccgctctgactactaagtggttaaaaatatccactccacccaggcaattttgctaagcttatgtcagggggagaaagggagactccggagagctcacaaatgaagcaaattgctgaaaatcggatttttactgtcttatctcggagccacatgagaggagaggagattgcaatttctgcgggaactttctcacatccccgagtttgaagagagcaagtggcaggggaggaggtgcagagagaaggctgggagagggaaccagaagagaagagagaggtgtgagaaggaaaaagcaagtagaggctgggagcggtggctcacgcctgtaatcccagcactttgggaggctgaggtgggcggatcacttgaggtcaggagttcaagaccagcctgaccaacatggtgaaaccctgtctctactaaaaatacaaaaattagctgggtatgattgcgtgcgcctgtagtcccaactacttgggaggctgaggtgggagaatcgtttgaacatgggaggcagaggttgcaatgagccaagatcacaccactgcactccagtctgagtgacagaatgagactctctctcaaaaaaaaaaaaaaaaaaaaagcaagaagacagagggggaggaaagaatacacaagagaaaaggaaaacagccacgtgagacattaaggcagaactgagaaaggtagctgggtgcagtggctcatgcttataatcccagcactttgggaggctgaggagggaggattgcttgaggccaggagttcgagaccagcctgaccaacatggcaagaccccatttccactaaaaagaaagaaaagggccagacacagtggctcacacctgtaatcccagcactttgggaggttgaggcagccagatcacctgaggtcagtattacatgcgtccatatgacgagaccaccaaacaggctttctgtaagcaataaagctttttaatcacctgggtgcaggcggactgagtccaaaaaaggagtcagcaaaggggtggggcagttttataggatttgggtaggtagtggaaaa

SEQ ID NO: 23143 - DNA, 1051 bp, Homo sapiens
acggcctgcagcagtactacgtcaaactcaaagacagtgagaagaaccgcaagctctttgatctcttggatgtgctggagtttaaccaggtgatacttccatcagcctgtcctggggctcaggaccttcgggaggtcactgggccacagggactgtgtggccctgactgccactccttccctcaggtgataatcttcgtcaagtcagtgcagcgctgcatggccctggcccagctcctcgtggagcagaacttcccggccatcgccatccaccggggcatggcccaggaggagcggtgagtgcgagccgcccgccaaggctgcagggagcaccaccaggagcccagtgtctgacggcctccacttgtttctcctgcaccccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtgagcagcctcacgggcatgttgctttcccctggcggtggggtggggccccagccctgcttttcctcaagtcctgaggtagtatctgtggcctgaccctgatcctgtctgcctgcaggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacagtaagtgccttgggcagggccaggggtctggggcagagggttcctcccccggcccttcagttcactgcatctcatgtcttacagtcgagcagagccggtaaccaccacgtgccagagccgcccacccggagccgcccgcatgcagcttcacctcccctttccaggcgccactgttgagaagctagagattgtatgagaataaacttgttattatggaagcctggctcccaccccatctatttcttggtcatcttggc

SEQ ID NO: 23144 - DNA, 1035 bp, Homo sapiens
aggcacttggtatgcattagattaataaagcaaagaggtaggcagactttgtattaattccattttccatcttctcagctttatttttattggcccaggcccaataggaggcctttcatgagagcacttaattattcccctgtgcagaccacagagagtgggagaagctggggctggacagatactgcttgctctctcgcaaactcagttcccaccagcatcctggcagccccacccctgggatctttgggctcctgccccatgaaagcccagtgggttccttggggagtgatagggagggggcttctctgggctgagtagtctgaggaggttcactggagctgaggcttgcgtgtggagaaggaggcatttgtgcagagacctgggggcagagcattcctggcggtgacagccaggttcaaaggcttggggcaggggctccaggggtctgagcagctgaacaaggctgggggtggtgtgggatgaggtgagcaggggtcaaaccaaggggattgcctggcctgtggtgagagttgggattttaactctgtgagccatgggaagcccttggaggtggagggtgttctgtctgtgggtgtggccagaggggcatgggggagagatggggtagcttgggggtggggaggtggagacagggcgaagctgcgaggtgcagcccaggtagagctgatgggctcactcatggaaggaggcggcagagaatgccatttgaatgaagcttcatcatccttctgtgcccactcgcgggaccctgcctctctctcttctcagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgagggtacgccttctgggtgttatcctcttgccca

SEQ ID NO: 23145 - DNA, 1022 bp, Homo sapiens
gccaatggcctgggctggatgctgagtccccatgaggcactgggaggcttgtgcccctgtgaattgtggggaactggaggccagggctggatgctgagttcccatcaggcactgggagacctgtgccccagtggattgtgggagctgatggccagggctgcatgctgacatcccatcaggcattaggaggggtgtacccccagtagattgtgcaagactaggggtggatgctgagttcccaacaggcactgagagacctgagctccaatggactgtgggaggccagggctggatggattgattggatggatggattgagaggcctgcatcccagtcgattgtgcaaaactgacgaccagggctggacgctgagttcccatcaggcgttgggaggcctgcaccccagtagattgtggggagctgatggccacagttaaatgctgagttcccatcagacactgagaggcctgcacctctacagactgtgggagctgatggccagggctggatgctgagttcctgtcaggcattgggaggccagtgccccatgagatggtggaggctagaggccagatacgagatgcacttctccgtgatgccttggagaaactcaacgctgtgggaggcaggcttgcctggtgccaagcactgtggggatagatgggagggggtcaaggagggcaatagtgggtttgagcaagaagtagacgcaggggtctccctaagtgggatgagtttctgtgtcctccacaagcatttcctgagcactcactgtgtgccaggctccgttccctgaaagcagcaatgaattttttttttttttttttttttttttttgagatggagtcttgctctgtcaccaggctggagtgcagtggcacgatcttggctctctgcaacctccacctcctgggttcaaaccattttcctgcctcagcctcccgagtagctgggattacaggcgcccgccaccagacccagctaatttttgtatttttagtagagacaggatttcaccatgt

SEQ ID NO: 23146 - DNA, 1065 bp, Homo sapiens
agtagctgggattacaagcatgcaccactacgcccagctaatttttgtgtttttagtagagatgaggtttgcatgcaccaccatacctggctaatttttgtatttttagtagagacggggtttcaccatgttggtcaggctggcctcaaactcctgacctcatgatccgcctgccttggccttccaaagtgctgggattacaggcatgagccaccgcgcctggctagggcttttctttgtttttttgagatggagtctcggtttgtcacccaggctggagtgcagtggtgtgatctcggctcactgcaacctccgcctcctgcattcaagtgattctcccacctcagcttcccgagtagctgggatcacaggtgtgcaccaccacgcccacctgtgtattgtatttttagtagagatggggttttgccatgtaggccaggctggtctcaaactgctgacctcatgtgatccgtcaacctcaacctcccaaagtgctgggattacaggcttgagccaccatgcccagccccagctcagggcctttctactggctgttctctctacttgggacgttcttgccccaaatcattgcatgaatgcttcctcctgtggttcaggtctcaagttcagcttcacgtgctcagagacgccctcactgatcttgtctatagaacttgtcttgctttgtctccatatcactattaaaaattatatgaggctgggcacagtggctcatgcctataatcccagctcgttaggagtccatggcaggaggattacttgagcccaggagtttgagaccagccgggacaacatagcaagaccctgtctctaaaaaataaaaataaaaaaattagcagggcatggtggcaagcacctgtggtcccagctactcaagaggctggggcgggaggatcacttgagcccaggagggcaagggtgcagtgagctctgattgcaccactgcacctcagccttggcaacacagcaagactctgtcaaaaaaaaaaaggaaaataaaggaaaaaatttatattagacatttacacatttccctgctccctg

SEQ ID NO: 23147 - DNA, 1035 bp, Homo sapiens
ttggtaggggggcgtctctgctgttggcagtgagaggtagaaacttggggttcttccttgctctcccctgacagacaaaaaagttcctcccccatggcttccaagctgtttccccctgtaagggaagctcgagagagagtctgctgttcagccatctgactgcttctaaatctgcttttcaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggtaaggtgccaggtggggcggtgtctgtagagggcgatggctgctttttgaagcagtttagtatttgctgaaccaatgtgttggggtgtgtggtgcgtgccaggcttggggcacaacagtgaacaggactgaccagggcgctgttgtggagctttcgtggtggggacgtgtagatttgggggccaggtcttagctgcagaggcctgatgggtcttatctatggcagacggcctctgggcaagagctgagcctcttgagccagcttccatcta

SEQ ID NO: 23148 - DNA, 1049 bp, Homo sapiens
aggctgagagagaggccacgccgccggccagtgcagagctgggccttgggtgggttgcagacaagaaaggctgggagtgctgcctggagccccaggtgcaggtggaggggctgagggttactctgggagaaggtggattctgaactcggactctggagagcggggctgtagagagctggggacgggcatccctgtgggaggggaggcaaggatccggcacgggatgttgaggtgcctcagggtgatggggagccaccttctcctgtctggcccttggtgtctggagttgcctttgtgcaaattagaaaaggaggccccttcaggacagtgcatccgtcaaaggcatctgccatccactgccatctggatgtgaatgggggacaccccaagccgtgccttcctgaagccgtgtgcctcggtcccctggggatccccggaattggggtggggagcctccagcctggttgagccccgcccactccctgcagagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgagtgagcacccccacaccagcccccaacaccccggcccgcaacaccccatacccccagccttccacacccctggcccacccaagccccccacatgcccagcccgcccaagcccccctcccacccccgccaacacccacagcctgcaccccacccaggcctggcccctggcaggatgtggctccagaggccagggacctgaactgccactgaggtttctagccgggccccaccttagtcccagagagggctctctaggggcctgtttgatggggacagggcaggtggctgaagccacctaggggagtggccaagcccaggttccagtgggaagccctgccacctgcgtgggcagaccccagacccaagccacaggcactcggacatgtcttctt

SEQ ID NO: 23149 - DNA, 1177 bp, Homo sapiens
ccgcaggagcggcccccgccttacctggcagtcccaggacatggcgaggagtacccggcggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaa

SEQ ID NO: 23150 - DNA, 1024 bp, Homo sapiens
tgcatggacacacgcactgtgtccccacacctgatcgcatgcacacagttctccactagctcagacccagccacaccctggacccttctggcaggacagttagactatgccacaccctagagggacacagcccttagggatggcgatgttggacagggcagcacatgccttgtgccagttgcccctcccttcaacacacaccctattccagcaacgcccagcgctggctgcttctggagatgctgtgctcactcgtgggtacatgccttggtccctctcccaagagcaccacgcaggcctgcctggctggagtagatgcccatcagggaaaggaagacccgtggccctaggatcccctgccccttccccttctattacccctgaacctgggcatgaagccccagacctccctgtaacactcagcacccttacttcctgtctcagcacaccccattctgcacatcttagctctggcagcttcccgagcccccacatctggcataagacagcccctcctcctgccttcccctgctttgtggttcccagggctcgagctggcagggacagctgcagcctcaacagctggggctggggcggggggggggggggcgtgggaactgtggatggggggactccctgcacccgcagagacgcccccatccccatgcagctgttgcctggtggagggagggagggggtttgtcacttgggcctggggttcctgggcacctggctgatcctccaccttccttcacccccacacagcccccccttgcctggacggaagcccgtgtgcaaatggaggtcgttgcacccagctgccctcccgggaggctgcctgcctgtgagtgcctggctcagagccaccagtgggccctgtgtgtgggggcgggggggaggggcgatttgtcttctccctctgcctctgtgttcaccatggatgtctctaccacttcctacatgtgtgtggcttgggcaacctctcgtgtttccccattggaaactgagcaggggctctgcactc

SEQ ID NO: 23151 - DNA, 1029 bp, Homo sapiens
ggaggcaaccatccttctgcctgtctgtctgcctgtctgtctgtcctggccacaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcagcttaaatgtatgttaattgaaatgaaatacaatgaaaatgcagtgctcagtcccaccagctgtatttcatttttttccccttgagacagagtcttgctgtgtcgcccaggctggatggagtgcagtggacgcaatctaggctcactgcaacctccacctgccgggttcaagcgattcttgtgcctcagcttcccgagtagctgggactacaggagcgtcaccaggcctgactaattttagtattttcagtagagatggggtttcaccatgttggccgggctggtc

SEQ ID NO: 23152 - DNA, 1142 bp, Homo sapiens
gcgggagccacgcagactcatagcaaccaccccaagctgaagctgtgacgcagagcccggtacccatccttgtggaccctggctgaggtggagggtgtgctctagcagaaccctggccagactccagacagtattcttcccctccaccctactccatcctgtcccccctactccatcctgtccccccactcaccaaaggacttgggccacttctcccaccttgcctgcctcaacctaactcctcctttcatttaagctcagggttaaccagatactcttagatataagtctacatcccccaaaataggatcctcaccccccatgcacatacacacacattcctgtccaagaaagcccacaggtggctgctctgcctgtgtgtccacttgtgtatgtacatgccccagccacaaggcacgggtgacgcccaagaagagcccctaagatgtaagatacaagtatataatttatatgtatgcagagacaaactgattgaaacatttctagcactgtttattctcctacatcccctctttttgacctgaaaggtcctttattgtctttggatctgccaaacctccctgtgagggtgtggttcaggcatccagccagaggtccccccacttcttcgatgtccatgcccactcaggcactttctcatataccactgtgccacttcaagtgtgacgtatttaggttctttggggtttcttccatctcatcccacccactcatttttgttccttgttttgttcagacacttccccagcctgggtccaactgctgagctggatagttttctctgcagcttcctgctgaagatttaactcagccatggccttctccacacctccctgatgggtgtctctctacctgggttgtaattagaactgggatctatttaatttctccagccatttcccaacccttcccacagtactagaaatcttagtcctataccagagtaagaggtgtgtacaagcccccactgtactgtatgcacggatcgcttggccaataattatgtcagtgaatctgagacttgtattaaacactttagacatttgtagaagggaattcgtagacttttcacttacatacgaaaggtttttttttttttttgtgcagttctcattgcaaaa

SEQ ID NO: 23153 - DNA, 1023 bp, Homo sapiens
tctctgttctgcaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggtgggcgggtgtctgggtggggcatggggactcttggggccacaccagtccccaggctgactgggaccctctgcccaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccgtgagtctggaggcctggtggggaccctggtctaaggattagctcctgagggagctgggaaagggggactggagcctggacagggaggggcagcgggggagccccgtccctgctggtcggcatgtggtcctctggactcagctgtagggccctgagtgctgtgtggacggggtgagcgctatgaggggtcagccacggggagggctacggggctgactgctggtagcgggtatgagggcttgtagctgcagggtggctaggtcatcctcctgactccctccttcctttctcctccagatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgc

SEQ ID NO: 23154 - DNA, 1072 bp, Homo sapiens
agtggagaggggactgctctcctccaagtgtgcactttcctcattattctcaggggcgcagatgctcaggctggcgcaggggagaggctagggagggagccatggtgcccagaaggcctggcgaccagcccctgctgagagatggagctaacatcctgtgtttacggccaacggggttgccgctaggctggtgcagctgtcagtgagctggcgtgctgcagaccacctgagagctggccctagggtctcaggcagactggggagtggggatccacagtgggaaacctgtgttttggcagtagactcctgcatgttctcccacgggcctgtcccatccctgggattttattctaactagaaataaatgctaaccctcaataatcagtgcatgtaaataacttgatcgtgccaaggaagattgaggacccttcacggcagctggggagagccatgttgctctgaggtgtgtgtgcacagatggggtgggggtaggtggcacctcgggccttgtcagtattcctcttcccttggacagcctggtgccctctgcttcccaggtgagtgaggagacttgccttgaagtgggctgaaggaccctccaggactccagatgcccacattctctaccacaactgcatgcagaatgccgtgggcagctcactggcctcctggccttccctgtcgccatccttcaccctttcatctctaaccgttactctccccacactgcttttgtaatccatcagccagcaggaggcactgcaccccatggctgcccaggaagggctggctttgccacccgaagctagggcccccactcgcagcagagtgactggggtgaatggctgtattcttggatccaattagcattcctggtggccgctgacttttcactttccatgccagccaagcctccagcttgccttcctctgggtttttgcacctcctgttttctagttgacttctcctaccaggggttttgtagtcttctcatctgaggatctgagtgaccaagtggaaaccccagatgctgaaattgtcaggggacctgattaactaaaatgacatgacg

SEQ ID NO: 23155 - DNA, 1050 bp, Homo sapiens
ctcacaggtgggaaaagggatgtgcaggtttgtgagacgtggcttcattgtacatccttccccatgaccttcatagttcccagagcctttgctggctcctagtgggctctcaccacctcactctgcctcctctgttggtttgtggtctcctccctgctggagggtaagtctttggggagaggagacattggaaccctttcagtcaaagcatggggtggtccctctggccaacttggctagctaccgccagggaactcagtccttggagaccacagccagagggacttgtcattctgagcggtgcccatctgctgactgatatctcacgggggctcttctcttcctttgtagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgtgagtagtgtgggcagggcccagggtggccgtcctggaggtcgtctcctgcatgtctcctggtcagggcagttcctggggggagggtaggagatgcatttggaatcatggtgagagctgcagggcccttgagtgagtggtttcagcagttctgatcagttgaaatcagggagaaagaatgagctaattggcttaacaataactggtttcttagatattggaatcctggggaaaattgtgtagaggttgaagcagtgggagaaaggaaggcccacagatctacttccagttccatggtgagttgaagtcagagcacttggccatcctagccccttcatttctcaggtgtggacatagttgatcaaggataagtagacgta

SEQ ID NO: 23156 - DNA, 1027 bp, Homo sapiens
gctgtgaaagaggcccattagctctgtaaatacagagcgtatcttagttctttgcacttgtccagtaaacactacaaaggaatgtgtggaagtgcgtcaggctttgatgggtaaaagacttgaaaagcaaccgcagtaccccaaggcgattttaaaactctgtgaagccagggtttgggggggttcggtggcagtggctcagtgcttctctgtatcgtgtgtacgttgtttattcaggaaggtagggagcagcagtatagtccatctgatgttttcttagcagcggctctcaagtagatttaggactgcagaaggagcagcttggaaggctctgcagtctgtgcagcctggtcaacgggagggcacaactggagaccatgccaggcctggctgccatgctatgttgtgtcttttgttaagaatgtagctgagggctaatgtaactgagggctactgctgtatcacatcctgtgactttgtgtgtcaaaggggaaggaacttttaaacgtctatctgttagaagctatgctggctgcttttatgtatcttttgtttactcctcacagatacaaggtagatgttacgaaatccacctagaagatggacctggggctgaggtgcctgcccaggggcaggatctgaacaaagatcttctggctttgaagtatctgtttgtttcatgtggtggctgttggtggggggggcttctgccgtcagagcctactctccatgagaggtgggcagaaagggttatatgcctagagaaccagggagaaacagttgctcttcagattagagaagtctctgtcaacacaactcctttgttaagggaattttcagaggatttagagtaagttgatttgtctccctttatgcccctggattttccaacttaaagctctgccgctggacggagtggtgcttcagaatctcagtgtggctggacggtcaggagactgcactttgggatgctgcctcacatccagatccttttggctccctgtccacttcagcggccatagtttac

SEQ ID NO: 23157 - DNA, 1030 bp, Homo sapiens
cgcttaactgggaaagttgttgctcgtacattgtctgccagcttactacaagcatcatggccaggctgggtttggctgctcagcacatcccctggcagggcactggcggcctggaaaatgtatagcaggcaggtgctcagtcagtcctagagctgatttcatgtgatatctgatgcatttattatagaaatgaaagcataaaaatgtgttttaactgtttcctactcccccggcacagtgacaaggctgattccaggcacagcttggttaggccagcacttgtaactatggtggggagcctcgaggcactgagtgagctcagcctccttgggcagaaaagcttgtttagttattgccagcacacactgtgtgttcctgtgggcaaacaaacagacggctggagatccgggggacctggtagtcgtcagcatttatgtcaccaccgtatgccttctctgaatgacttgcggaagaatagagtgggttgggattatgtggtaagtgtaaaaaagttagcgatcagagggactttgggtttacctctggagaggacataatgaaggtaatccttcactgtgacggatgagtggatatttctttgtaccctgagctctttcatcctaccttggtggtcaaatgtgagagcaagtgctttggggctcagagggcatcactccaagcattctgcatggagtctgttgtggtgaatgttcttgctggcatcttgatcaaggactttgtcatcattagccatcaaatgcttgttggtccttctcaaccctgtaatgttgatacttaaaaaactggaaacatcctgacagaaacagtcgagaagtggttgtgtgagctctggttatcgcattacagttaaagttggcagataggttctgtattcagtgccccatcaaaaacagaacacagactatataaggggaatattgtttgtaagtaactctgtgggctaattgtgcaaataggtgctagaatgctgggcagcctttttccttcttcgtggctttgttgcatttta

SEQ ID NO: 23158 - DNA, 1065 bp, Homo sapiens
tagttgggactataggtgctcacttccgcgcccaggcttttttcctttttggcattgtcttgtcctggaaagggcatgagatagactcagtgttgcattttgtgcttaaagatctctgtacctctgatgtgttttatatgggcaattagaacttgctgaaaatggaatatactacctaagcaggtgcacagatgagtaccactgtgactagtggtactgaagctcaaaatggacattcacccactggaatttggagacattggcagtgatctggagcaggttgcttaatctttgatcctgtttccctgtcagtgagattgggtagcagaagcactccatccacctgtcagagttagctctgcttgttactgatgagggtcaagcacagcagagggaattgctcctacccaccctgcagcgctcttacttcactgaaggtgctgtaggtgattgacggtgcagtgttttggttagcctttcaattttgagtgattctgatttgtgtcactcaacttgaggagacttggcctgaccagttcagtcacctctgcttcctgtgtgtgttcctttccctacttcatttccttgcccatcctgaattttgagtttaccggttttgtgtttgttgcatgtataggtatacctcgttttattgtgctttgcagataattgcggtttttttatttacaaattgagaatttgtggtgaccctgcattgagcaagtcttttatcagtgccatttttccaacagcgtgtgctcacttcatctctgtgtcacattttggtaatgtgaccaacgtttcagactattatatctgttatgattcgtgatcagtgattttgggtgtcattatcatagttttggggaaccacaaaccatgtccatctaagaaggtgaattcagtctataaatgtttgtgttctgactgctccagctactgactatttcccatctcttttcctctcctcagacctctctattccttgagacacaactgtcttaaaattaggccggttaataaccctataatagcctttaaagtgttcagatgaaaggaagggtc

SEQ ID NO: 23159 - DNA, 1036 bp, Homo sapiens
ctcaggctcccaagtagctggggctacagtcgtgtgccaccatgcccggctaattttttgtatttttagtagagacggggtttcaccatgctgggcaggctggtttcaaactcctgacctcgtgatcctcccgcctcggcctcccaaagtgctggtattacaagtttgagccaccgcgcccagcccagatgtttaaagtttaaggagtttcagcttatgttttttgccccctttttaaaaatttatgtcctcaatttttttcttacaaatttttatttttgccactttcttcatccagtgtcacagcttatactattacttttttttttttttaggtagactctcgctctgttgcccaggcgggagtgcagtggcgcaatcttggctcactgcaacgtccgcttcctgggttcaagcgattgttctgcctcagcctcctgagtagctgggactacaggtgcacgccaccacacccagctaatttttgtatttttagtagagacagggtttcaccacattggccagtctgctctcgaactcctgacatcgtaattcacccgcctgggcctcccaaagtgctgggattacaggggtgagccaccgcgcccagccaacctaccgttttaagagacgaggtctccactgtgttgcccaggctggagtacagtggtgagtcacatgcatgaccccactgctgataggtatgggagttttgacttgccccctttcttttttttcttcactacgcgacccacccccccccccccccccggccccgcaactttttttttttttttttttttgagacggagtctcactcactcttttgtgcaggctggagtgcagtggcacagtcttggctcactgcagcctgtttcccgggttcaagcagttcttgtgccacagcctcctgagtagctgagattacagatgcccgccaccatgcccagttaatgtttgtattttaatatagttggggttttgccttgttggccaggctggtctcgaactcccggcctcaagcgatccgcccgcc

SEQ ID NO: 23160 - DNA, 1076 bp, Homo sapiens
tgtatccttcgaataacttccttttccttctttctcccagcctgtggcagccagtcttctactttctgtttctatgagtttgactaccatagttattcatataagtagaatcagacagtattttttgtttgttgagtatttttcgtttgtttgtttgagatggagtttcattcttgttgcccaggctggagtgcaatggcgcgatgttggcttactgcaatgtctgcctcccgggttcaagtgattctcctgcctcagcctctcaagtagctgggattacaggcacccgccaccatgcctggctaatttttttttttttaatgtatttttagtagagacagggtttcatcatgttggccaggttggtcttgaactcctgatctcaggtgatccacccacctctgcctcccaaagtactgggattacaggcgtgagccactgcacctggccgattcagacagtatttagaattttgttactggcttacttcactaagcataataacctgttctccaggtccatccgtgttgtagcatgtcagaattccactcctttgttgatggagttgggttgcttccacctcttggctgttgtgaataatacagcagtgaacatgagtgtgcaaatatccacctgcctactgttttttgtttttttgtttttttttgagacagagtttcgctctgttgcccaggctggagtgcagtggcacgatctcgactcaccgcaacctccgcctcctgtgctcaagcaattctcgtgcctcagcctctcaagtagctgggactacaggccccttgccaccatgcctggctaatttttgtatttttaatacagacagggtttcgccatgttggccatgctggtctcaaactcctggcctcaagggatccacctgcctcggcctcccaaagtgctgggattacaggcatgagcccctgctcctggccatcttgcttactttttgaacacatgttagaactaagaacgtgggtgcggaagcctgctgaggggctttaaattccccatatcctgcctccacacggaaactgattttggggatggatattgggcat

SEQ ID NO: 23161 - DNA, 1014 bp, Homo sapiens
tttgtattttgagtagagagacggggtttcaccgtgttagccaggatggtctcgatctcctgacctcgtgatccgcccgcctcagcctcccaaagtggtgggattacgggcgtgagccaccgtgcccggccacaattcacacttttttttttgaagacagggtctccctcatccaagctggagtgcagtggcacagtcttggctcatggcaacctccaccctccagtctcaagctatcctctcacctcagtctcctgagtagctacgcctgacatctttgttttgttttgagagtctcgctctgtcacccaggctggagtgcaatgacatgacctccgctcactgcaacttctgcctcccggcttctaagcaattctcttgcctcagcctctggggtagctggaattacaggcacgcgcccccacgcccggctaattttgtatttttagtagagatggggtttccccatgttggccaggctggtctagaactcctgacctcaggtggttcacctacctcagcctcccaaagttctaggattgcagatgtgagccaccgtgcacagcctgtttttggttgttgtttgatttgacggattttcactcctgttgcccaggctggagtgcaatggtgcgatctcggctcactgcaacttccgcctcccgcgttcaagcaattctcctgcctcagcctcctgagtagctgggattacaggcgcacaccaccacgcccagctaattttttgtatttttagtagagacggggtttcaccatggccaggctggtcttgaactcctgatctcaggtgatctgcccgcctcggcctcccagagtgctgggattacaggtgtgagccaccgcacctggccccttttttgtacttttagtagagatggggtctcaccacattgcccaggctggccttgaactcctgagttcaagcaatgtgcctgtcttggccgctcaaactgcagggattacaaatgggagctacaagctactgtgcctggccga

SEQ ID NO: 23162 - DNA, 1044 bp, Homo sapiens
gcttggaacactcagtagggctgttgtcaccctgttttgacaggttttagagaaaatggggtcactttagttccttgaccatgtggagcttgtcgacatcctcatggatgctgtcattgaagcggttggatgtgcaagcctggaatgcaagggtggatctagaccagacttgggggcattgggcatctccaggaggatggatgtgagggctcctcccaataggacgtcggaaataagagtcccagcagggtcccagacttgagaaagccaggcccctgtgtagtaagaacacagattagtgaatttgctttaatctggggaatggtgaagggcttttctttccaaaacaatgtgtcctagagtgaactctagtgacctagataagtatcatgtttaatagttttgtcctctgttcttggaggctagaaaatttcccacttctctttggaatttgctttgtctgacatctttcatttcattcattctatgcgtccacaccctcacgtcctccattttgtgagcagggttttgggagcaggactggctcattttggcacattatatttgtgtgtggaaaatgtgaagtgcgaacgaaagttcaagcacatactcaaggctgagctgtggtactagaaggtgccagtggtgggtccacctggagtgagtcaagcagtggttgaggtgacttgaaaatatcccctatcgatggttcaggcaggatagcccctgagttcctaaggcagagattcttaaatttggtctgtgtaatcttccctctccctcatcatggagtttttccggcaagcacttgatgtttctggttattgagcagttacttgtgctgagtgccagggattgtctgggtgctggaggtcagcggtaagcaaggtggatgatgcacaccctcctgcctgcccattagttcatgtgctaggagactgcagggcaagtgatgcagcctgcttggcttttactccatgattacagattatgaaatataaatattaatacattaaacagttcttactaaatcattacattcac

SEQ ID NO: 23163 - DNA, 1049 bp, Homo sapiens
gtttcatcgagttagaccaggatggtcttgatctcctgacctcgtgatccgcccgcctcggcctcccaaagtgctaggattacaggcatgagccatggcgcccggccgcttctcggtcttgaggtgcttttttttgagacagagtcacccaggctggagtgcagtggtgtgatctcagctcactgcagcttccacctcccgggttcaagtgattctcatgcctcagcctcccaagtagctgggactacaggcgccggccaccacgcccggctggtttttttgtatttttagtggagatgaggcttcactatattttcagactggtctttaacttctgatctcaagtgattcacgtgcctggtcctcccaacatgctgggattacaggcgtgagccaccatgcccggcccttgaagtgctgcttactgtagggtagaattgagttctagctcatgggtgcttcccccccccaatccccttaaggattctgtttccaagagaatttcctgcctgcctcaggcacaccaagtggaactcggtcaacatccatgtccaatgcgtgtgctggatgtacttggtaatcagacactgttctgcattcactgcagacatgacagtgagtgaggcaggtgtttcagggatcctaatgtctccggtggtgattgttgcacaagatcctaatacccctgtgctagaaaggtggtgattcatttaacaggtgtgccctgaaggattttacttttacatcttttctttgacttcgtaaaatgacacgtgatctcattcagtaggaaattggctctgaatacctgtggggggaaaaaaaaaacaaagccagtccagagaaaatggtagaagtggttaaactccacgcacagtgctactagtaagctagttgaaaagtacacaatcaaaatagaatagatgactacagcatgattatgctaccctgaaaccgcactgcatataggataagacctacactcctgtcatgtagcaccctgggctcctgggttctgtgacacactgttgcctcattccgttcatttg

SEQ ID NO: 23164 - DNA, 1046 bp, Homo sapiens
cttgatggttttgaatactttttatttttattttttaagacagggtcttgctctgttgcccaggctggagtgcagtggcatgatcttggctcactgcagctttgacctcccaggtttaagtgatcctcccacctcagcctgctgagtagctgcaactacaggtgtgtgtcaccatgcctagcttatttttattttttggtacgaggtctcactttgtcatccaggctggagtgcagtcattcactgtagcatcggcctcctggcctaggtgatcctcctacttcagcctcccaggtagctgggactacaggtgtgagccaccatgcccagctaattttttgtatttttgtggagatggggtttcaccatgtttcccaggctgcaactcctgggctcaagtgatctgcccaccttggcctcccagagttctgagattacaggtgtgaggcaccgctcccagccttttttttattttttgaagggacgaggtcacactatgttgcccaggctggtcttgaactcctgaacttgagcaagcctcctgccttctttgtctcccagactgctgggattacacaggtgagccactgtgccaggctggttttcacatgtatcttacttttctagacatttacaactttatgacttggaaacagggtggatcacccattttggtttgtccttgcaaaaatcctccagaggtttcacagagttgtcaggtaacgtgtcaacagtgatgtgaaccttcccagggcccctgtgcccccaactttgtcagcctgtgctctttcctggggataaggaatttgagaatgtaccagaatgggtctgttgcaaaggccgcagatgagggtcttggaactagggctctacactgaagctgctgctgtttgtaaactgtctccatgatttgctgttggtatggagcctttgctccagaaggtaactgaatggttcctagccagcctcattatttatgtggtagtgttggatgtgggtaggcttacaagatttatgctgtggtcccttacgtggcttaatgtgtg

SEQ ID NO: 23165 - DNA, 1050 bp, Homo sapiens
actacactccagcccaggtgacagagtgagaccccatttcaaaaaaaaaaaaagaatccaaggtacatgagaattttccaggagagaagctaaaaagagatttcattgatagagccaactgacagtgaggttgaaggtgaggggtagtgaagaaccagagccttcatgatgggagcagcatatcgaagtcccaaagtgggtgctcatggagagaaggctggttggaagagctcccagttcttccttgtgaaacccattttgctcagtgttcatcccaggactttagcatttggggcaggtggctaagtcccagcccacaacctgacttcaggacctttgccctcctctcagttactaaacacttccatatttgacagttccatctattaaaggcacagaatctaaataaccaattgaagaaacatgactgggccgggcgtggtggctcacacctgtaatcccagtactttgggaggctggggtgggcggatcactttgagttcaggagttcaagaccagcccggacaacatggtgaaaccctgtctgtacaaaaaatacataaattagccaggcgtggtggcatgcgcctgtggtcccagctactcaggaggcggaggttgcagtgagccaagatcgtgccactgcactccagcctggatggcagagtgagaccttgtctcaaaaaaaaaaaaaaaaaaaaaaagagggaggaaacatgactgatgtatattttacctttgcagcttaagcaaggtaaaagtttccagagtcaagtgtgagctcaggcttctaagcgtctttttttttgagtcagggtcttgttctcttggtacccagccaagagattcctgcagagattctctgcagcctcgaattcctgagctcaagagatcctccccactcagcctgccaggtagctgggactgcaatagtacaccaccacacctggctaattttttttttttttttttttttttttttttgagatggagtcttgctctgtcacccaggctggagtgcagtggtgcgatcccggctcactgcaagct

SEQ ID NO: 23166 - DNA, 1034 bp, Homo sapiens
ttgtgtccaccatggacaggcctcgtggctgctgaagtctgacttggctcctccccctgtgacaggttatgaaaactacaattactatggcgcccagaacaccagtgtcaccacaggcgcaacctacagctacggcccagcctcgtgggaggccgccaaggccaatgatggcggcctggcggccggggcccctgccatgcacatggcctcttacggcccagagccatgcaccgacaattccgactccctcattgccaagatcaaccagcgtttggacatgatgtccaaggaaggaggcaggggcgggagcggcggcggtggggagggcatacaggaccgggagaggtgattatggacccaagccctcccccgggaccccacacatccccacctttgtgcgcatgggagtgggcacccactcttgagggagggcctgtccccgcctccctcttgggtgtggcattgacgagttgggctcgtggggggtcagtgatgttacagtaggacttccttgcttttcttcatggcggggcttgggcgtggttgttggctaagctccccgagactccttttttctacatcatgctattcctgtggccaggggctctgtcccctgctcagcagtgttccagggagggtgttggtcagttttggtcatcccagcacttaggtgggatgcagggtggtttggtttgctgttttgaatgtaggggcgtcgaggttatactgagggagtgtggcagtgggtgatcggggtgaccgcccctgatgggctgtgcttctgttgcagctccttccgcttccagccgttcgagtcctatgactccaggccctgcctgccggagcacaacccctaccgccccagctacagctacgactatgagttcgacctggggtccgaccgcaatggcagctttggggggcagtacagtgaatgccgagacccagcccgggagcggggctcccttgatggcttcatgcggggccggggccagggccgcttccaggaccggagcaaccctggcaccttcatg

SEQ ID NO: 23167 - DNA, 1031 bp, Homo sapiens
acagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggtagggacccgccccgaggtctcggtggcggctggcctcctccgccccttgccacggcggcctgctccggcccaggccccagacccc

SEQ ID NO: 23168 - DNA, 1113 bp, Homo sapiens
agcttacctccttttccctttcagatgagggcaccgagggggaagccacagagggccttgaaggcaccgaggctgtggagaagggctccagagtggtaagtggctctggctgggcattttctgtctgcaggcagggcgagctggcctaaagagtggtgctctccctgggggccagaggcaatgctgtgtcagctctgcgtgcatggtgaccagcatggggaggcagtgtggtctggcagaaagcacaggctgcctagctggaggcacagtttccttgttggaaaatgggatgagcccctgtgcaccaggtagtgggaggatgtgaggtttctggcacatagccgggccttgtcatttaaagccattgtaaataactgggctactctgggccaccctgcctataggatagccctgctctgtctatggagcaagcagctgttttactatataccgttgctctaataaacttggtttcttttaaaaaaaaaaaaaaaggcacctgttttaaagttggaatttgaaattgttaggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttggggg

SEQ ID NO: 23169 - DNA, 1086 bp, Homo sapiens
caagttccttagttgagagtgttgggaacagaaggatccttaaataacagatgctcagagccacaggcagccaggcaccagggcagcaagtggcctgggtcatttgcgcagtgctcgcgagctcaaggcttctcggttaggggaggtgcagcctgctctgaccagtcaggtcctgggaataattgtctgcgcctgaattatggccttgtattgtaagcaagtatagatgtaactgcccttttactttttgtaggatatggaacttggaactctgggacaaatagaggcaagtgtcattcctgtgattgctgtcctgtcccttggggttgtcctggctgtgtttctctgccactgccctgcttggccaaggttgggagtggggagggggcatgtttctggggttacctactccttaacaggaggccctcatcagaatgaccagggcccatctagcttcagtggctagggtcttctctctctgtgacagaagatacccttgtatctgtgtttgtctctgtctctgtctgcctcccctctgcctgcccccaccatctgtctgtctctgtctccctcactgcaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtgagtggacacctgcctaggggttgagactctgcaggggcggctcctgcctgctgcccactgcgttttcctctctgagtgcccctctgtgtctgcttcctccccgctgcttggtgctgctgtggctcccagcagggtccgttgcacttcccgtctctgacttgtgtctcctctcacccaccctcaacccctgccgcactgcctggtggtcagcctttcccagcttgcggtgagaggaacaagcccagactgggcagacttcact

SEQ ID NO: 23170 - DNA, 1728 bp, Homo sapiens
gatcagtaggccacccctggtcccccattgtctctgcagccccagctgtcttgtctggtggagattcctcacaagtgctgtgaagccacctccctgtccctggctccctggctccctgcctctgtgtggcctctccagcctcctgaccctggtgttgtgttgaattccctctctgagtgcctcccaccctcaccctcgagacaggcagacgttccccctcacaagttctgcccagagagatcttttctttgagatcccctgggatgggagtttgggctcagatttgcattagaccccagacctgtccatgctgtagtgtgtggaagcagctgctggcgtctgctgtcagtggcagcctcagtgtccctgcactggactggtgctgggggttatggtggaacctcagctttcctggggtgagtcgcttcgcagagtgagagcggacatcaaggataaggaagaaggccatcttcttagttctgggtatagacagcctgaaatttgtctgggctgagcctgtctccccaacccacaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaagggtgagtggcccaggtggcatggcaggggatgctggccaggctggttacactcacaggagcactctcgtgccttggggttaatgtggggcccaaggttgcccgcagttttccctctggcaccttgaggcaccaaggttggcactcagctgtcttctctcttgaacttctactgtcctgggcatgcgtggccctgagctgcaccctcacggggcgagggacagcatccagaagcagtgggtgtggtggtccagagctcatactcagacccagctcatttgctgaatctggcctttgctagctgtgcagtctctcgcatgacaccatttcttcgtctgttgatcctaaggttgttattgactagtgacgggccctggggtggactccagggaggtgagaggagcaaaatgaatttggcccttgctcttgagggccattcaagttggggaacggggagacagagaagcagataggcaaggataaaggctctgtggaagagggtgcaggagactgcaaggaccagtgtttcgggcaggagttgagccacagagggtggttagaacttagttcagtgaggcatgtggctgtcaggtcagcgtttgtgtgaacctgttgccagggcaccccgtaggcctgaaaggttgtgaaaggtgtcccactggctggatgacagaagggctctatctcctgctgtgtgcccttgggcacaacttttccctctctgagtctcagtttctaacccttattggcaaagcagccaagctattctctgcgttgttagggtcattgtgaggtttggggggcctgacggaggcaaaacacttccatggagcctgggtgagtgggactctcaggggaggagaagcgggagagctgggccgtgggcctcacagcctgctctcccggcctctgtgttgcccttcagcccagagcctgaccacctgcgaggtctgcggtgcctgctttgagacccgaaagggcctgtccagccacgcgcgctcccacctgcggcagctgggagtggc

SEQ ID NO: 23171 - DNA, 1959 bp, Homo sapiens
cttcaatgcatgaagcagattttctcaaaattcggtaaatatttttagtggaaaatctcaacgctgcgatcgcagggacctcagattcttatctcccggggctgtgctgcttgacacagctttgatctaaggcagagtgcgcgcggggctggtgcctgcaggactcccagcctgcaggtcccttacgtggtcccgtgtgtcacattgtaaaaaacaaactcccctcatgtgtcttagatgggagccagaggaagacgttgacgtgtgttggggaaaagcactctttcaagacaagtccccgagcagtgatgaattttagaacctatactgttttctttctcccctctccccgcagctaagctttttttctggcaggatggggagggtggaataagacatgtcagtggccttggatgagctctgctggagtggtgccccgcccgggccactgctctcctaggcagcgtgactctcagaaacctggcagttgtatgggcatctgtgttgtgtaggatgaatgacagttgtggttgtgtgggatcacctgttgtgtagggtgaatgacagttgcataggtgtctgtgttgtgtagggtgaatgatggttttgtgggatcacctgttgtgtagggtgaatgacagttaggtgggtgtctgtgttatgtagggtgaatgatggttttgtgagatcgcctgttgtgtagggtgaatgacaggtgggtgcctgtgttgtgtagggtgaatgatggttgtgtgggcaccacctgttgtgtggaatgaataacagttgtgtgggtgtgcatgttgtgcaggatgaacgagagatgtgtgggatcacctgttgtgtagggtgaatgacagttgtgtgggtgtctgtgttctgcaggatgaatgacaattgtgtgggcatcctctgttgtgtaggatgaatgggagttgtgtgagtgtccatattgtgcaggatgaatgacagttgtgtagccatctcctgttgtgtaggatcaatgatgcttgtgcatgtgtgtcccctgttgtgtaggatcaatgatggttgtatgtgtgcgtccactgttgtgtaggatcagtgatgcttgtgtgtgtgtgtcccattgtgtaggatcaatgatggttgtgtatgtgtgtccacagttgtgtaggatgagtgagagttgtgtgatcgttctgtgttgtataggataatagcgaaggtgggcagcttccctgaccacaaacccttgttttgtatttttttgttttctttttgtttttgtatgtatctctcatctgcagaactgcattttccaagtacagcactgaactgaactgtataaacagaacctagccaggatcaaacacacacacacacacacacactctctctctctctcactctcatgtttattactaatatttttattaatcggattgattgagaccatacctcacctgaaccttttatgctcctcctaagcaaaaaatttaaaccaagagagtttcctttccaaggtttttatagcattcaccgtttttatggtttgcaattgtatatttctattcaattttttgtttgtttgttgttttttgggtttttttttttttttttttgctttgcacccagctcttgaggatgcttttaagcggagggcttcctgcaaagcaagatagaaaagtcagaaccttgaaaaactttgctgaccaagaacgctagtgcagcagagccagccccatcacagccccgatcccgggtgctaggggcgtgcgcagcctcgagaagaagcttgagaaataggagaattaaagaaatttctatcagggtggagccggccaccaagtttttttttttttttttttttttttttttaacagcacatactgtggtaaaccatttggttcatattgtttttgctaaagtcagtcctgtgtgtggtttcggtacaccgcttgggtaactgttgaaact

SEQ ID NO: 23172 - DNA, 1024 bp, Homo sapiens
gttagtaaaaatgtagttattttctattttattacagacttaattattttctgttttagtaagagtggttactcatccttcttctgcccatagaaagtgattttctccctcctgggacaccccagccccttccctcagacgcctgagatatgctggcccttctgtggctgatggagaccctggctcccctgtgcctcaccggcgctccaagtgagggacaagcatccccccaggtggcggcgcttagtatctgctcatcacaggcctggaggcagcaggtgccggggagaggactgtgcttgccctccaggtgggagaggcctggaagcgtgtctctgtggctcagtgagcagtgcaggcgtgggtggcaggaagcagccccagggagagccctgggagagctctgggggacggcagtggggtccagccaggctctgagcaaggagaggggttcctggtggacgaggtgggccgagttccccagcaggagacctgagtgttgcaggacttggaaacaggaggctgagtcagcggctggggggtcagtgggttctggggactaaggaggcattgtgaggggaggggtgacttcagaggtgagcctgaaaaatcaggcagctggggcagcgatgaagtccctgcatgccttaatgagagcttggagcttccctataggaagtgcctacctacctacctacctgcaagacgtcgccacatatctgcctccctgtctaccacccacccgcctccctgtctctacctgcccatccatccatccatccacccacccgccattcattcgtccattaatccacatatatgtctatccattcatccaactaccattccatccatctgcccacccaccatccattcatctatccaattgttataactatctctgactgtctctctctttaagctggaggatatggtccgatttgggtttgagacagcaggtgtggggtggaggatgtggatgggtgtgatggaggctgaccgagggtccgggccagaggtggtc

SEQ ID NO: 23173 - DNA, 2011 bp, Homo sapiens
atgggtaggctgcctcttagaggggccacctccctgttctgtctctgatgtggctctgactgggccgagcaacctcgactctaggactacacaaggtccgaggcagccatatctctgtgacgggacgcaaatagcccagatcgatgcatctctgtaactagatgctagaggcctagatgactgcatctctataactagctgccagagacacaggtggccacgtctctgactagactccagaggcctaaacggccatgtctgtgcaactaaattgtagagacctagagagtcgcatctgtgtgactagatgccagagcctcagacgaccgcatcggtgtgactggaagctagagcctcaaatagctgtgtcagtgtgactggatgtgtcagtgtgactgtgtcagtgtgactagagccttagatggctgcgtctgtgtgactagaccctggagccttagatggccacgtcggtgtgactggacgctagagccttagatggctgcgtgtgtgtgagtagaccctggaaccttagagggccatgtctgtgtgactagacactagagccttagacggctgcattggtatgagtaaacgctagaagcctagacggctgcatctgcatgactggacactaaaatcttagacggctgtgtctgtgtgactagacgctagagccttaaatgaccacgtctgtgtgattagacgccagagccttaggtggccgtgtctgtgtggctagatgctggagccttagatggctgcattgctgtaactagacactggagccttagatggccgctttggtgtgactagatgctggagccttacacggccacgtctgtgtgactagatgctggagccttagatggctgcgtctgtgcgactagatgccggagccttagacggccgcatctgtgtaaccagatgccagagcctttggcagccgcatctgtgtgactagacactggagctttagctggctgcatcagtgtgactagatgctggagctttagacagctgcattggtgtgactggaagctagagcctcagacagccgcgtctatgtgactagacactggagtcttagatggccgtgtctgtgtgactaggtgctggagccttagatggctgcattggtgtggctagtctacagtcttagacagccacttttgtgtgactagatgctggagcctcagatggccacatctgtgtgactagatactggagccttagacctctgcactggtgtgactggacactgtagccttagacggccacgtctgtgtgactagacgctggagccttagatggttgcattggtgtgactaaacgctggagccttagatggccttgtctgtgtgactagacactgaaggcctagatggccgtgtcagtgtgactagacgctggagccttagtcagctgcatcggtgtgactagatgctggaggcagaggcagccatacctctaagactgtctgctggacgtggtggtagaccttttcccccacatctgcaatctgttgcattcagattctcgagggaaaccctgggagtgtgcctttgtactcttgacctgttctctgtctctaggccttccctgctggggagaaagttaaagacccccggcccctccctccacctctgccccactctgatctttctcttctatgctcttggaggaacacatgatcttttttaattttttttattttttgagatggagtctcgctctgttgcccaggagtgctgctgtggcgggatctcagctcactgcaagctccgcctcccaggttcacgccattctcctgcctcagcctcccgagtagttgggactacaggcgcccgccaccacgaccggctaattttttgtatttttagtagagatggggtttttcaccgtattagctgggctggtcttgatctcctaacctcgtgatctgcccgcctcggcctcccaaagtgctgggattacaggcgtgagccagtgcgcccggccaggaacacatgat

SEQ ID NO: 23174 - DNA, 1057 bp, Homo sapiens
ttgggggaaatgactgtccttagtggtaattcacagatgaccacactgtgaggtgggagcctgagaactagctgtcgcagagtcatcacccaaatggccaagccgcctccaactggctagggacagtgggtctcagctgcctcagatccagtgtcccttttagaaaccaacaaaacacagtgtcccctttatgactctgaaaccaacacacatacagttcctggttagcgccctgacaccctgactgtcatgtctaggggtcagtagagggaaagtaatttataatgcatgctgcaattgacacatgatgtaatgacatggaaatgacacaggaaatcactaatccacctggatcaaaagaaggaactcagaggtcattccatgcgggcagcaaaggggaaggaaaggatgatcaggctcttgaataaccatgagaaaagaagtctagatgtgtctgcgagtggctggggcggggcatggcccaatgtagatgacacaccaggagggactgggaggagggggagcatgaagacagaggctttttccctgcgatggctgccaccgtacgggtcagcagagcaggatgtggtgtcagagccggatggccgctgactgagccacccctaagcttgcttctccttctttctctcagaaccttccacaggtgggccttggagcccacactccttgagagatggcaggagcagagaaggggcgggagtggagaggcagctgcagcccacgagcaggctggggcccgcaggggcagactggggagagacagtggcagtatgaaatcgtcagggcctcgaactgtggggataactaggcatttatcagcaatgttctttgagatctgctcattctccgcagctctgttcacggactgcatttgggtataaataagtctgttagaacggtcccagctctcttttggtaaaaggggaaacttctgttgtaatggcttctgccgcagctacacgggaggtgggaaacgaggtccctcgttgagagggcagcatgggtgaaggaagacatttttcatagatgccaaagg

SEQ ID NO: 23175 - DNA, 1047 bp, Homo sapiens
gcctcaacagcacagggagcctgtcccccaagcacagcctcaagcaaacacaggtacggagccctcagcgggcacagccccctctcagagcacagtaggatgtttctcgggagttcttaacatgcaaccccagaacggtcaagcttgtgatgaaatgtctttaaaaaatgcttgtggccaggtgcggtggctcacgcctgtaatcccagcactttgggaggccgaggtgggcagatctcaaggttaggagatcaagaccatcctggccaacatggtgaaaccccgtctctactaaaaatacaaaaaaattagctgggtgtggtggtgcgcacctgtaatcccagccactcgggaggctgaggcaggagaattgcttgaacctgggagacggaggttgcagtgagctgagagcgcgccactgcactccagcctgggcaacaagagcgaaactctatctcaaaaaaaaaaagtattcatttatctcattatttcaacatggtctcccctatgttactcaggctggtcttgaactccttggctcaagtgatcctcctgcctcggcctcccaaagtgctgggattacaggtgtgagccaccgtgcccagcctgtgtctgcagagctcttgccaagagttttgaaagtcaggttaggggaggtactttactggcaacgaagctagtggggccaaactcactggtaggcacaggtcacccagcgtcataacccacctctctagtgatcttctggtggttctctcaagaccctctgactagaccgattttaccagtggcccctggtggggtggggtgggagggtatagctcctgcccccacgacggcattggtaggatcacagtcatgaaaacgagcatttctgggggcctacagtccacatgctccccctactccaacttcctcatctccaggccagcaatgctcttgtctgggcctcccaagggccacccgattttgccctcatgccaggtttgagtgaagccacttccagccaccagggtctgatatccttcctttgggacctgtggctgc

SEQ ID NO: 23176 - DNA, 1029 bp, Homo sapiens
tatttctgtcaatggatttgcctgttctggacatttcctatcaatggaattctctaacatggtcttttgtgtctggcctctctctcagcatcgtgttttcagggttcatccatgttgtagaatggatcagtgtttccatattccatttactggatggaccacatctttatccattcatctctctggacatgtgggttatttccacccttttgactgttgtgaatagtgctgctaccagcattcatgtacaaggatttgtttggacatccgtttttaattcatttgggtcaatacgtaggagtggaattgctgggtcatgtggtgattctgtgtttaactttgtgaagtcttcccttttttgaaagcactttgaaacgtgtatccttttcagcaaacccacccacctatgatttaattctgtgccagccacaaaggaatgtttctctctcttctcagcacgacaccagcagccctctgatggtcacaccgccctctgcagaggcccactgggctgtgagggtaagtgaacgggaatagctccctccttggctctccttcagatagaattgttccagcagttgttctagaattgttctggaattgttctagtttgatgttgttcagaacattttataggatgattgtgtcagctcttctgtctcagtgtgagtggccacagcacttggatgaaacgcctcttctaatgaacaccttttacaaaggctgtggcccttcactggaattgggagttgcctacctggacaactaagtgtcaggagttggattattaaagggctgcagtttaaatcttgcatctttaggtcacattctgtggtttttgctgcttgtgttggttattcagaatagaagaggaaacggtgagagcttgcaagcacgtggacccccaaatgtgtcccttgctttctcgcttctttccagccactttgcatgttaccattctttcctccctgatgttctgattgctttgtgaaaagcctctctcagcacttgaagtgttatttttaaaac

SEQ ID NO: 23177 - DNA, 1031 bp, Homo sapiens
tttttttgaagagatgaagtcttgctatgctgcctaggcaggtcttaaacccctagcctcaagcaatccttctatctcagcctcctaaagtattggaattacggtgtcagccactgcatctggctaggattcatcttctaaaacatattcccctgttccaaaaacctttcacagctcccattccccttcctccaaaagaactcagtttatggctgggcgctgtggctcatgcctataatcccagcactttaggaggctgaggtggatggattgcttgaggccaggagctcgagaccagcctggccaacatagcaaaaccctgtctgtactaaaaatacaaaagttagccaggcatagtggcaaacgcctataatcccagcaacttgggaggctgaggcacaagaatcgcttgaaaccaggcggcggaggttgcagtgagctgagatcgcgccactgcaccccagcctgggcaacagggtgagactcagtctcaaaaaaagtcagctttgatgaccttagtaagccctgaatcgactccacctaaccttgctgggtccctttcctgcacttctggctcttggcaacactttctagcctcagcatccttagctgtgttgctccggttgctagaacatcactgtgagctcctgccgtatgctgcctgccctgaaggacggtctttgaggcctcccctgtgttgtcctcccttagccccacccgaatgagagttctctcccttgtaccttccgtgggtcccttttgtgaccgctgtacctaggaagcgcgtggtaactgggctcagtgatgaggagagactgccctgggcccaaagagctacaccttcctcctttcccccttgttatgtgttcttcatccaggagcttttgctgtatttcagtaggtgcctccattctaggaggcttttattccccttttacaagtgaggaaaccaagacccacagaaatagagtaacttgctgaagtctcatagttggtgggcgcagagctgaggtcacacctgcgtcctcctg

SEQ ID NO: 23178 - DNA, 1022 bp, Homo sapiens
cttagcctcttcctgttcctttccctatacatttgttgaatgaaggcgtggcctggttttcttcgtttggaaatgtcagcacttctttacacttgctctcgagtgaaaatctacaccatgggttactgttggcccaggtgtgaggcatggccctcccaggcccttactgtctagctcaggagatcacttgggttcacagataactctgggggaaccaagggtataattccaaaatttttggttgggggcaaaagggaagcaccctgcagcaggtggctgtgatctggttggatttaggtgacagagcacacttggcaagcagatggccaggtgaaggtgagcaaagtggataacccagcgggctagcctaggggaggaggggtgtgttttctccacccccactcctgtctgcacttttcccatcagcatctttttcagtctgttctgtactccatgacatcatctcagaatctccttccttatatactcttttctgaccctgaatatcaacgtaaattcgaaaggtctgcacctctgcctctttaggagtgatttttttttcccaacagcatctcagtgatttgtgtgtctccctgtccccctgctcagctctcttctgctttccaaaaagccttccgtggaaatgcatccagatctctttcctccttgtactccccgaggttaccggtggcccctccgtccttaaccccggtgccctgtggctgcagccgatcctcctcgaactccgcaacactggagcccgtcggtcttcactcttcatcctctctcctttcagtctctccttcttgtcccctaatttcagcctccctacctgcatcttatctctctgtgcgctccctcccctggagcttctgtgcagaggacttcaaacctgccttctagagtccagaaggtgtctctctcctgcacctctgccagcctgctggactctggaatgggccatttccttgccatgccccaaagtggtctgggccattctacttcctacttgcccactccct

SEQ ID NO: 23179 - DNA, 1042 bp, Homo sapiens
tataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagacctttctcccgcacatgtgtaagtcagaagtgtgcacgggctgagtgaggagacacatgtcctggtttgagctgtgcagcctggggtcagaggccgtgtccaggggctcacatggcgtccccagcgtgctgacctggtcccatgtccttaccctcgagcagggcttctcccatccaccctgtctccctctggctcactgggatgccaggacctgcctgggtggagctgctctgcagaggctggtggcccctgtcctgctgtgagtggggacagctccactgaaattctatttccactggcctgtggtgtcatagagctgggcatgctgctgggagagctgtcactgagctgggatttggctcagaggagtctggggccctcaccgcagcaccacctgccccaccatggaatgtcacacctggatgctgactgtgtgtgtgtgtgtccatcaccccagtaccacct

SEQ ID NO: 23180 - DNA, 1042 bp, Homo sapiens
ccgggacaggtcaagtgacaggtcttcacgtcccttccccgagctttgatggtttgggcttctctgtagtatagatcaccattgtcctgcgagtgcaggggagtttaacgctgcaaggcacggcagggtgttctgtttcctgtcctccttaaacaggttaagctagttgagtgtcagtgttttgtcatcctggaaagaacaaggtgcttttgtaaggaaagggggaatgtcagaaatgtcagccgtgttgcccctgggaggcctcagatgcagctttgctatgggtcacatacccctgggccaaggcaggggccaccttatgtggcacagcatggctgtgaaatgccctgcagcgtgctgggtccactttcagcactgaggcacagccccgggtcttccagggcgtgactttcccccttgcccgtggggcctggttggcttcgcagcgtggcctttccaggtgactccctgtctgcagggacaggtgtaaggatggcaaggagactggctctggactgagacttggtggttgtggctttgagcctcccatccccagcttcaggacacgaaattgaacctcacaaaagattggacacccccataaagacagctcccacctccaagtgctggccaggagccagatggtggtggctgttttgcaggtaccctctgctggggggggcagttcttgtccctgttttgtaggtgtggaaacaggcccttagtgtctccaggctcagtctttttgcagaccagagggttgggctcaggacaatgggcacgcccctcactgagggtgcccgctaggccagcagtgcatcctgcagtccacactgagaaacagcagcctggcctgcttgacttggccatgtggggtcttaacacgtttaaaagtaatttctcaaggcaggaagattgcttgaggccaggagtttgggaccagcctgggcaacaaggcaagactccatctctacaaagaataaaaataagctggcatggtggtgcacacctgtcgtcccagctacacagtggtctgaggcag

SEQ ID NO: 23181 - DNA, 1049 bp, Homo sapiens
atgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacc

SEQ ID NO: 23182 - DNA, 1031 bp, Homo sapiens
tcactgagttaaccacagtggattgttaggtttaatttccacattgctttaattcgtggctttgcaaaaatctcatgtggcttcccttctccctccttatataacaatttggaatagctttaggattgccaagaaggtaaactggagaaaatttgtgtggtcatagtaacttccaggacctctgcattgaaaacgaaggctctctcaaaacacgttgagccttgctgagcaaacatgtttgcctgagagagagcagcagagccagtgccaccattgaccacagctttggagggacaggagaggtggccttctgtctagcagcatctccaggacccactcagagatggcacccttgacctggactttgatgaagctttgtgaggaccaccaagagtcactgtgttctcatgatcctctgggatggccagtgcaggtgacagctgacaacgggacaaagcgtgtttgctctctaggtgttgacttgccacagagggagacccctgagatgtttgtgatattggagtgaacatggtggccagcaaccgtggatgagggacttcatccacccatcatttggcatgtatcaagtccctgctagttgccaggcactgttctaggcacttaggaggcaacagtgaacaaaaccaaggtccctgcacctgaggagcagacctgcaggtggaggctggaccacatgtgagaaagcgggtgtgttgcaggcagtgagggctaaagaaagtctgagcagatgtgtgggcaggtgggaggaagagctctgtgagccagatgaccaggggaggagctccctcatgcctccctgcctctcccttgctggaaagggcttgctttccagacccagtgaatggtgaggtggtgatttggccctgtcctctgcacagcctgggccagagggtgccgatgaaatatgcagtgacttcggataggcacctcggcatcaggttgttgggtctatgagatgtcactgagggccgtaggaggatttcttcttttctccttgcaggctgtgggct

SEQ ID NO: 23183 - DNA, 1050 bp, Homo sapiens
acgctgtcagcccaacaaggagttaggggtgtgaccgagtgggcacctcctcatcaccctggtgatgattcttctgtgttgagagcactgtgaacacggtttcctatctggtcgggtggtgggctccctcaagttgggaagtaggaagtggcatcatctgtttaggaagatgagctgtccttgggcacaaggatgcctgttgtgtttgtcacgccaggttgtcttctctttagggcgctgttctctgtgctcaccatgggcacttggaatgaatgacaaggcctagcagtgggggggtgtctgcctacctggttcccttgccccttgctgcattggtctcttttttctctacacaaccctttccagtggtgcctgctccccctaagcgttttggctttgtgtagcactgctcacggtcttcggcccttaagactttccccaggtagtctcagagccacagcttcgttggcacctggacacttgctctctcctgtgcctggatgtctagacagcccactccaaagtggatacaccttcttcatctctgcctttgtcatgctgtgctgtgtctgttggtggtgccatgatctactgctctgtagaccaccttagggccatcctggagtccttcttcctgcaagctggacctccagggggtctagtgcagcagtgtcctagtcagtctcctgcctctgtgtgtctgaaaacagatagggatgtttgacttttctggtggtgtcgtgttgctggctggatagagtctcagctctttaggtggcatatagtggagaagacagtctttctcctgggtggaggacttaagcagaatggagttggaaccattgactctgccattcaccttgcaaccttcgacaaggttaggtttgcagcctttgtttttccagaaagatgtaaaaaatgctgcataggaaggcttttaagaatggaacatggccctgtgcctgaagcatcctgggtgctcacatgcatgctacctaataatacacaggcttggtggtagagagcccatctagctcccatggccttcct

SEQ ID NO: 23184 - DNA, 1042 bp, Homo sapiens
cttacccagagtcattaagtgacagtccttagagtcctttcaactctgaacaccaccacgctgccttgaaagttggagagatggctccggaagaggcacgagggggcagcatttttgagctggtaagaaaacgtgtgaggatcctgtaacgtcccctacaagtgtatgtgagattacagattggggctggatttacctatgttacatctaacagggtggtgatatgacatagcctgtcccgtgaacatcttaaggtctctgtcacagacagaaacctgggccagaccacggtgtggcaactagcaaccgatgtggaacttttcatgaatctgtgtgaccagtttgctctctacttcaacattacagcacttttgatattaacttaaaatgccatttattctgcagaaaagcagaatggtgtaaattgcaaaatgaaggactcttgattctgaccctatccaaaatagtagaggaccctaaacccaaacatgtaaatgccacctgatccacaattgcccagattcagggactctcctgtctttactctgtatattgtggccaggacacaggagaggagcagcgtggtgttctctgacttcgggaaatggaaaggtagcaagtatcacctgtgacacaggtgtatgtccttgtctttgactcattctgtccctcaggagaaagtggactttacagtctctcctcactgaggtttctgggtggtcctcagaatatgttgtcctggttggaggtcccagagccctggaggactgtccaagaccagcatgtggtcaggggctttgttctggatacagatgtaaaaaggcaccatggtcacgtcagcccctgggcagctgtgtaagataggacatgtagcttaagggcgccaaggtctcttaggtgaaggaggacacttggctttccttttcttggttttggggtctgcgagcatcttctcagatggagctctagtttaaccaggctgactccaggtgactccagtccagcgggaggggtcccctggccacttccccactatcatctc

SEQ ID NO: 23185 - DNA, 1070 bp, Homo sapiens
actgatctctggactagacagttttttaaaaatgacatcttatgaccgggcgcagtggctcacgcctgtaatcccagcactttgggaggcggaggcgggcagatcatgaggtcaggagatcgagaccatcctggctaacacggtgaaaccccgtctctactaaaaatacaaaaaattagccgggcgaggtggtgggcgcctataatcccagctactcgggaggctgaggcaggagaatggcgtgaacctgggggggcggagcttgcagtgagccgagatcacgccactgcactccagcctgggcgacagagcaagactccgtctcaaaaaaaaaaaaaaaaaaatgacatcttactagtggatcctgtttcctgttcattggtgtctagtttacattattatcttggcagttggtggtaaacctaggcaaaagagtgtggactgtgccaagggaactgtggaaatgttaggggaaataaagctttacatctaattagagtacattgtgtgcatgagaaagaaggtggaaaaggtggttgcagcagaaagcaagttggaggtgtagctcagacctgggttctgtgtcttggcccttctgcacctccacgtcctcatctgtgatatgggtacagtgaaggagacagtcttgatatgggcctataacatgcctgatgctgggcagccactcagtagttgtcactgtttttattaatgttgttgcttttattaaaagactttctcagctgggttttgcaagccttcagtgagatggtggtatattagtcagctagagctgtgtattaggccatcttgcattgctataaagaaatgggtaatttataagaaaagaggttaatggccaggcacggtggctcatgcctgtaatcccaacacttagggaggctgaggtgggtggatcacctgaggtcaggagttcaaggccagcctggccaatgtggtgaaaccctgtctctactaaaaaaaattacaaaaattagccgggcatggtggcgggcacctgtaaatccagctactcaggagtctgaggcaggaaaatcacctgaacccgg

SEQ ID NO: 23186 - DNA, 1049 bp, Homo sapiens
ctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggctctccgcctccttcttcccccgccggggcctggcgggctgggcggggcctggttcgcttcccccctacacccccgcctttctctcctccctctgtccctagctcctccccttgttggagggagcagagagcgggtgtctgagagcggcccgcacatctggcgcgcagcgagcgccccctagacgcgccttggcgcggggccggctgatgtccaggttggggaggggtcttggggtctttgatctgcgtttggaactagctaatgcccccttgccttttgggaaggagagatttcgaggtggaaagggcacagccccagcccaaagcaggaaggaagagacagaaacttagtaaactttttaaccttttggtccttggtttgcctgtccgtataaaatggggagaacagtcgaaaaacttgccccataaagttgtgacgattaagagagtttatgtttacagagcagtg

SEQ ID NO: 23187 - DNA, 1050 bp, Homo sapiens
cctctgaatctggacccctgaccccaccttcacggggttgaggtctgcagagtagaccgtgattccagttcctgttggggtcagtcctcctgtccccagacctccctggcccacgactgagcctcccagcgggctctgtggagggcctgagctatgctgcctgcagcgctggcctctggcccctggcacccagcacatgggccacagggccagctcctcttgctggccttggctctcctgctgtttgaagctccagctttgatttcctcaagcgttcgtccagctagaaagttctctgaaacggctccctaaacggggcttacagagctggggtccccaagggagacagagagggagggatcaatgttgggtcccggcctgaccaacctgctgcgtccaggcctggcctgtggtgagggtggcgtgaaggggcgccaggcacacagagggtgtggggacaggcgtgccctgcgtgcagcctgctcaggattactggaggtgccgctgtagcgtccactcagtccctggggccctcatctcccgggaaccccctgtcacctccccagtggccacatgctcccacctcaggggcttcatggaaaatgtcatttgtcctcatggtctatctctggcctcaggcctgctggggagtcccctccccttccccatccctggggctggatacacagaaatccctctttctgttttcctcctggcaggtagatgaggggctgtgggtggttgtggcgcataggaggccccccccccgccagggagcccccagcctggcctactgccctggtctctgctccacgcctctcctacctcctcctcctcctccaggaaacccttctggctttgtcctttaggaagcctgccccaacccccaatgtgacttagtgtcctctgtcgcctagtcccccccccccgcatccctgggggctgggtctagtcccataatgaggatgccctggagttcctgccttcctcagatgctctgccccacggaggagatccaagcaccctcagtcaccacctcacacatgagga

SEQ ID NO: 23188 - DNA, 1083 bp, Homo sapiens
cttgacaggacaacagggctcgaggggggaggcgcttcttcctgaagtggccgtatcttgccctgaccgccacccccacccgggactgggcctctcatcagcacagggctgggcggggtggggacaggtggtgaggctgctgtgcagcagcgctagaagctctagaaactgcttgctgggtttcgtgccatagcctgtcggagggcgtctgggtgggtccagtctggctgtgtcggatggtgccttggtgcagaaccgcgtgcctcccatctgcggccagcggggctctgtccacttccggtattggaatcaccaggcgtgttgcgtgcgtgagcatgtgcggtcttgtggacacctccaggtcctagacatgagaagcctgttgattcagaggctgcgtggtctccaggggttggtttggcctctgcctccagcttcgagtggacggatggctttccctgagcagcctgcctctgtggccaggcggtgatgctgccgtcacatgtggctgggaggagaggcgatgggaactcacatcgtccccatctaagtggggccctccctccctcagaggcaggccgcaggatgcagagaccccgggctgagagacctctggagcgctgtgggcaggaggcaggggcctccctgcagtgagctcaggccctgcccaggttcctgcacgaggaagcctctgggccctgcctgggagagctgggcgccaagtcacctgcccaggccctgagtccccacagaaccatggtgtgtccgccccacgagccctcgaggggttcctgggagagtgagcacccaaaggggctgttcctccccgcccagcgctaggccaggccacacctacccaggtgtggaggagagtgtctgacaggaggacttggggattcgggcaggtaaggccttttggggtcaaagttagccagatgagaagtgggaaaaccacgtgcaaagttctgggggcaagcccatggcgtgtgttccggaaacagaaagttccatctggagggagtgtcgtcgggctgggagaggaccgccagggcggggcaggatctcgggccctagagagccctg

SEQ ID NO: 23189 - DNA, 1028 bp, Homo sapiens
ctccgcctcctgggttcaaacagttctcctgcctcaggctcccgagtagctgggactacaggcatgcaccaccatgcccagctaatttttatgattttagtagagatggggtttcaccatgttggtcaggatggtctcaatcttttgacctcgtgatctgcctgcctcggcctcccaaagtgctgggattacaggcgtgagccaccgcgcccggcccagtatcattttttaattgcacaaaggttggcgtcatgatagactgtctaactgccagcgaagtgtctagcggaggcagagcctgtcgcctgtaaggaaggccatttaggggtctgggaactgtgggctgaggcccggaggtggtggtccatctcagggcagagctacacctcctgaggggcccatggcgcagggctccagggctacagccaacctctagcctgtctctcttctagttggtggagctgaaaaatggggagacgtacaatggacacctggtgagctgcgacaactggatgaacattaacctgcgagaagtcatctgcacgtccagggtgggtgctgcacccaccaacgggggtgggatgcagggggtgcacactcagcctcctccctccctccctgggcctcatgggaggagtcagtgggggaggccgcctaggactgctcgtccttccaggggtcagtcaggagggacagggcagggtgagctaggccaccaagtctcccagtgtgccctggactttgaccctgtgggagactttcctgctgtgtgtctgttggtgccacccctgacctggaaggacctaggactggggactccctgtggctcaggctggggcagccccctccaggggaggcccaagactcccggactctgctgcctttagtccagcctggatgttgcctgcactctgcgggccatggtagtgtggccctgggatgtccgggatgcccaggtcacggtgggcaggagcagcgccagggcccggtgggtcaggagccaccagccagagcccaagaccggaagt

SEQ ID NO: 23190 - DNA, 1509 bp, Homo sapiens
tgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtggaccagggggctgaggaaggaggcgtgctggggagagcggggcggctcggggagaagggcacgggacccgggattcactgcgcggcctgtcttcaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggtgggggcgggaggggcgtggtgggtagggaggcttggtgggagtccttgcgggcgggggcgggagcctgcagggggcggggctctgcgggaccaggggggctgtagggggtggggttccgcggggcgaggggctgcaggggcgagggacctgcccgggtctggaggcctgtagtgggcgagggacctgcagggggcgaagctctgtggggcgggagggcttgcagggggcggggcctggctgcaggcggaccccgtggaagggtttcgcgaggtagcggggactcctcgggagtcttacaggggcggagcttaaggtgccggaggtctcaggggaggggcctgggggcagcggcttccgtcctggctgtgagcctggaactgaaaaatgcccgaaagtggggcggggcttgagagtctaggtggggcccaggccgggtcgcggccctttcaccactcccacccgtcacctcgccgtgtctgctgacccccaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggtgggcggagccctgggccggggtggggcgggatgggagatggggtctggaggggcccaggatccgggcagggccgagtgtg

SEQ ID NO: 23191 - DNA, 1043 bp, Homo sapiens
agatggagtctcgctctgtcgcccagtctggagtgcagtggtgtgatcttggctcactgcaacctctgcctcccaggttcatgccattctcctgcctcagcctcttgcgtagctgggactacaggcgcccgccaccacgcccggctaattttttgtgtttttagtagagacagggtttcaccgtgttagccaggatggtctccatctcctgaccttgtgatccgcccgcctcagcctcccaaagtgctgggattacaggcgtgagccactgggcccagcctgaactcctgttttaaaagcatcctgtgaagttttttttttcctttttactatataagcagtataactcagggtagaaagcctgcaatgtacctaaaattagcaagtctgttctcattgccccaggtaatttctgttgacacctttgcaccctcctctgtctcgcctgggtgtaccgtgttgtcatagtggcacaatcatatggttttgcgtctcttcttccctgaacactttatgttttaatgctgcaccttctgtgcatcgtggagcctgacaggtcagtattcttcgggcatttttgtgttcttggcactatgcttggttctggggatgtccggatgctgcaggccttgtgtgtgtacaggccagtccactgtcccgtagtgaggctacatagagcgatgaggtgaggtgaggcaggtgacccagcacaggccacggcctggcatgcccatgtgtctgtgagtggagcctggagtatgaggctgcgattttgaggccagggaaggcagctcagccccgcttggcttgctcctctttggacaaattgagctgctggtgatggagggctgtggtcagtccttctcaccgttcttcagatggggagaccgcaagtatataccctactgttaacacccctgtccttcccccaggcccatcgggggcctcagctcttcatgagatgctgttgttgcgccccgtgtcctttttatatgttggtgaaaatgttttcacaaagaggcgtctctcttgaaggatgctga

SEQ ID NO: 23192 - DNA, 1122 bp, Homo sapiens
ggaaaatgctgggcaaccccagccggctgcctgctaagtgccctggcaagggtgcctgggtgagctggggcacagaatgggcaggggctgtgtgcagggcacgcctagcagagggattttattttgcatacatggatgtcctcggagactgggccgtcctgggcgatgcaggggacgtggagagagcccagccctgtgtgatcatgagtggagtcgaaggtggaactcaagctggagggctgggggtggactgtggagcctcttccagggcacgaggggcggtgtcctggaggaggggccatttgatttgggttttgctgcatgagtaggagtttgccaggaagtgggaaatacatagtcaggcaatgatttgttgggaggtctgtttgggctgtgctggcagctgaggccccagaggccagtcttgacctccctccacccttctctcccctcctttttatccacagtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttccacggactcctgagctttcttctcccgctgtctggggctgggccagagacagcctgtgatgcatctggagtcacacagcatggtggatgtggttgagccagctggagctgggggtctcctctccgggcacaacatactcactttacagaggagaaac

SEQ ID NO: 23193 - DNA, 1120 bp, Homo sapiens
tccctcccttgtagcagaattcctagatcctcctgggtcctcctcaaacccagctgtgccccatcttcctccccccatcccgaagaccactcctgtccagctcccatgtggctctcttggtgctaaccccagagagtcccctccccttcttcttctttttttttttttttcgagacagagtctcgctctgtcacccaggctggagtacagtggtgagatctcggctcactgcaacctccgccttccaggttcaagcgattctcctgcctcagcctcccgagtagctgggattacaggcgtgtacaccacacctggctaatagttgtattttttttagtagagatgaggtttcacaatgttggcccaggctggtcttgaacacctgacctcaggtgatccacccatcttggcctcccaaagtgctaggattacaggtatcagccaccatgcttggccccggctaatttttaaaatttttgtagagatggggtctcactgtgttgcccaggctgatctcaaactcctagggtcaggtgatccacctgactcagcctcccaaagtgctgggattacaggcgtgagccactgcgcctggcccttgaagccctttatttactctgcactcctgctctgtctctctggcctcctggctggcctccttctcttctggggccctttctctacccacacttaatccacaccgactcctacatttctctcctagccacgcagctcccctgagtgccattctccatctcccgtgtttgacatttccagcatcttctaaaatatctcaaatcagcccccaatttcaccccagactccctctctagtgatagactagtgtcaacactagtctatcggtgttgacagcaatttggggcaaaacccttgcaagagcccagggggtcttgtctcctctgtctccctctcctcctcatctatgaagaaacatctagaaagtgcctgcatcatccttctctctctgcacactcgctctggctcttttcaccacagtggtggatagaagccaaaaggtgtccatcagagtaaggccatctcggcccggcatggtggctcacgcccataaatcccagcactttgagaggctgaggcggat

SEQ ID NO: 23194 - DNA, 1120 bp, Homo sapiens; identical to SEQ ID NO: 23193

SEQ ID NO: 23195 - DNA, 1014 bp, Homo sapiens
gtctctcgggccgccgcgcgcccccttcagacagtgctgcgtgggggaaccgggtagatgcgggggtgtggccgggctggggtgagtctgggacatggggggcccgagacaggtgggatgtttgagacgtgggggaccgaggcacggccctttccggtcagtttgggaccagggggccccgcgcggtggatggctccggccaccgcgcgctctttccggcagggccgagccagacactgagaagcccaggaccgggaacgggagggctcggcgcaccgcggcctgcgccatgcgcctccctgccatgcgggctgcgccccggcccggagcgaggtccgctgcccgttttctgctgggtccgtgcggcggcggggccggcttgcccgctgtaatcgggaagaggcaggagctgcccggtcgctgccttgtgcctatctggggtcagcgccaccctccgaccagggatggcaagggcctgggtgctctggccacgccagtggtcgctcccttggaggtgacatggcccggggcttcagggttggactgtgctgcctccaagaggcgacagcagaattccccagtttctgcggagaccatcgcccctgcgagagagtgaccatgatggtgacattggcgcctgaccccactcacttccctggggaggggtcgctgtggcaggagctggttggaaggtgtttgggcctttagcttggcctggacacccccgtggaccagctggtgtcaccccgcccgtctggctggagggtgcagggacaatgtgcccagcgccaacaaaggggcctttctctgctggccgggaagaggctggcccttgtgaggtcgatgatgggatgttgtctgactgccactctccccactcccgtccccatatcacccacatgagggagagaccccagccacacccctactgtgggagggggagacagggctgtccagggcccctccctgggtccgcagtggtctttatcctgcttgttgcccctgccttcttcc

SEQ ID NO: 23196 - DNA, 1014 bp, Homo sapiens; identical to SEQ ID NO: 23195

SEQ ID NO: 23197 - DNA, 1014 bp, Homo sapiens; identical to SEQ ID NO: 23195

SEQ ID NO: 23198 - DNA, 1625 bp, Homo sapiens
ctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactccatctccaaaaaaaaaaaaaaaaaaggccggcacggtgactcacgcctataattccagcactttgggaggccgaggcaggtggatcacgaggtcaagagatcgagaccatcctggccaacatggtgaaaccctgtctctactaaaaatgcaaaaaattagctgggcgtggtggcg

SEQ ID NO: 23199 - DNA, 1051 bp, Homo sapiens
tttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaataggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccac

SEQ ID NO: 23200 - DNA, 1063 bp, Homo sapiens
cactggtaatctggaacctcatctaataactgatatgtcgctacttaatatcaaacaatctgaaagccacctgaaatactgccatacttactaagcaatattcttctttaacacaaactgaaatcaaatattcacaaaagtctgttatgtttgttgtggggtggttatttatttatttatttttaaagagatggggtttcgccatgttgcccagactggtcttgaactcctgggctcaagcgacccacctgcttccgcctcccaaagtgctgggattacaggcgtgagccaccacgcccatcttaaaagttcgttatgtatgaaatcacagagaaaatcacagcacacccaggaaattcacgtgggccacattatgccaatacagcaaactagaaaccagcaacaaccaaaataaaacatgtttctgaataacttttgagtgaagggtaatcatagctgaaattagaagcaatttagaaggaagtggcaagaagaacattatataccagatgcagtcataaaaatacttaagagaaagagtgacttcaggtgactttattagaaatagtgggccaggtgcagtggctcacacctgtaatcccagcactttgagaggctgaggcgtatggctaccttgagcccaagagtttgagatcagcctaggcaacatggtgaaatgtcctctcaaccaaaaacacaaaaattagccaggcgtggtggtgcgcgcctgtagtcccagctactggggaggctgaggtgggaggatcacctgaacccagaaggtcgaggctgcggtgagctgtaatcaactcatgaagctagaaggaaaatgatgaaaaaagtaaagacactagaaggagaaggttttttttttttttaaagatagggtcttgctctgttgcccagactggagtgcagtggtgcaatcacagctcaccacagcctctcgacttcctgggctcaagtgatcctcccaccttagcctccagagtagctgggactataggcatgcaccaccaccctggctaatttttttattttgtggaaatgggatcttgttttg

SEQ ID NO: 23201 - DNA, 1092 bp, Homo sapiens
caggctgctactgcccagcctgggttgacgtcatcagggcaaactcaggcttggtgcttataggtcttctgttttagtaagtagtcgatccagatttttaagtgacaccacacgcattttaaatgttggcagcaaatacagattggcaaaaagcactgaggtgtataaagcagttttgctgcctggtgatccgtggactgtttgtttgcactgtttgcattctctggtctaaagtatcttttggcttcttcttttttttttttggatggtttatttcagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaa

SEQ ID NO: 23202 - DNA, 1028 bp, Homo sapiens
gtgggggccgcgccgacaggatccatcgggggtccctgctatatcggggtgtgtggaacgggcaggggaggccgtgggaggtggactcaggaggtctggttggcctcagggcgggcaaggttctcagagtgggagacaggaaagttggaaccttcaggtctcacgcggctctgggtccaacctattgagtgtgttcttaaaacttagcccagcccctgggggtcaggctggtgcagggagatgggggactcccacaaccctgacgggaccggcctgggcagagagagggacgtggaactggagggtctctgcctgggaccatccccgaggaggggcgctggagatggccctgaaggaagggcactgatggccggaattattgaaagtggggcgtcgtcccaggcggaggtgcaggacgccgtaggagatgaaggcacaggctcccgggaatgaggagggaggctgcattgattttatcagggttcttgagttcgagaatcgtaaatccagtgaagggaaaagaaggagctgatggaagactccagaaaattcttgcagatgtctgcagagccctgaccctgagacaggaggctgggtggagggcagggccatcagaacatccctggacagacctctgggagccttaggtggagagatgcacccctccaccaccttttcccttggggggttttggggggtggtggggtcattgatgaagagcccaaaggtccaggaagacctctgagactccagtggttgggtgcagggagggctgaggagagagctgagctgtggggaggtggagggatggtctctagctatgcctgcagggtgcagaaccaagttgggggctgactgtgagactgggaagggcctgaaccacctggaagggtatgggatgatgggtgagtgctagggtctcccaggagagcctggaggaggctactggttgagctcagcagagaggtctgggctggaggtgtcaccgtgctgaggttttgatgggctggctgattgggtggttaaaa

SEQ ID NO: 23203 - DNA, 1510 bp, Homo sapiens
acgcccaagtgcacgcccatcgccgcctccagggtgacgccctgtatgcaaataagcccgtcccgcccaatcagctcccgggggcaggaccgcccgctcccaaggcacctgcggccgcgggcccctgatcttcgtgcagccgccgcgggtccgtgcgcccagcgtcccagggcccaggccgagcaggtgcgtgtcatatcgggttgagactcctgtggtgtcctctgaacggcttctgcgggctgggtgggttttggaggtccgggtgtactgctgggcgtcccagggtggggtgtgtgtctaaaggggtgtgtgtcgtggggtggtgagtccccgaggttgtggcaggagggggttgtgtctccaaggggtgtgtgtctgaagggtgtgggtctggaagttgtgtgtccaagggctctgcgtctgagatttggtgtgagttggggagttggagagttagctgtgtgtccaaaatcatggtgctgtgaggccctattatgtgtctgtgagctctgtgatgtggcatgtgatgtccctctctcctggtgtgcactcctttagcattagcgcatcccctgtgcacaaccctatgccttcttgctgtgggtgtacactcgtttgtcacagcaggatggtaggcacaaaaccttggaacgggggagcaacagctgccggggccaactctcctccctttgcctcaatgggtacaggaacaagagtcacatccccgtgtggttgttagcacatgacaaggtggtggcagcattactttcacggtcacagtcctccctccctatctcttttggggtccagggctgcagatatgggtgacctgtgtccttggccaccctaacccctagttgcagacccaattagtcagaaatagctggccgggcactgtggctcatgcctgtaatcccagcactttggaggctgaggcaggaggatcacttgagcccagtagtttgagaccagcctgggcaacatagtgagacccccattttctttttcttttcttttctttctttgttttttttttgagacagggtctcatcctgtcgcccaggctggagtacagtggtgatctttgttcactgcaacctccagctcccaggctcaaacaattctcctccctcagccttctaagtagctgggattacaggcgcgtgccactaccgcctggctagtttttgtatttttagtagagatgggctttcaccatgttggccaggctggtcttgaactccagacctcaaatgattcacctgcctcaacctcccaaagtgctgggattacaggcgtgagcccctgcacctggctttaaaaaaaaattttttttgagacagagtctcactctgtcacccaggctggagcgcagtggctcaatcttggctcactgcaacctctgcctcccaggttcaagtgattgattttctgcctcagcctcccgagtatctgggactacaagcgtgtgccaccatgaccagctaatttttgcattttttgtaga

SEQ ID NO: 23204 - DNA, 1030 bp, Homo sapiens
tgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatggacccctaaattatgatttttgccaaaatggctttgagtccgtttctgctgctgtttgcagaagggcctgcactgaccactgtgaatgccaagcctgggtgaccaggcctccacaagttatgcatctccaaggccagctgtgtgccaatgcagttaccccagaatcccttgttccagtacaatgtattagggaggtcagataagagttgtttggggtcgaggcaggttccagtcactgctctgggagggtccctcagcttggcactgtggggtggttgatggagacggatgggaagagcaggggtgtcccgaggggagacagagggcatcctgttaggacatcgggcctgtcaaggcatctgaaggcctggaaagggggttcagccctacctctcctccttctaggtcacactggggggcctctgtgccattatcccacctctccactgtcctactcagcttaggagtggggaggagcctaaagccaccccatttagggcactgattggtgtgtggcctccagagtccttctcccttcttacctgctctgaaggcacctctcaatgtccatctgtccttcgtgcgaccatttctccagcaaacactggtatttgtgagccagccctcttgctcagaccttcaggacaaactggcagcagaatgggattattgcctgcctcccaggacctgcctaggatgtctggggcgctaggagctaggggtgagggaggcaggtgtggggggccccaccagacccttctagggctctgagtcactcatagcccctggatgcaacctcaaccagcgactaacagtcatctctctctcttttttttttgagctggagcctcactctcgcccaggc

SEQ ID NO: 23205 - DNA, 1067 bp, Homo sapiens
tcctcacatggcagcaagaaggagaagtatgagtgcccagtgaagggggaggccccttattaaaaccacaagatctcgtgagaactcacttatcaggagaacaggatgaggggaaccacctctatgattcagttgtctccacctggtccctctcacaacacatggggattatgggaactacaattcaaggtgagatttgggtggggacacagtcaaactatactattctgttacagttatgacctgcatggcaaggaggcagccgtctgactatctaagggaaggatgtgccaggcagggggaacagcctgtgcaaaggccctgaggcatggtggccaggtgttcacagaaagcccagacctgtgagggaagggagttgcaggaggaaaggtctctgcttccaccatgaggactcaggagagccccaaccaagagagctgggaggaaggccctctaggtgggggtggcctcccttgccaaatatctcctgcgccccctacaggcagacatgcagcgttgggaggagcagagccagggagccatctacactgtggagtacgcctgcaggtgagcgccacagcctccccgctgcagggccaccttttgctgctctggcctcctgggcattcaggggcatcccagccaactgcccagtaagccccaccctgccaggcctacccgagtgggtgtatggggtctgtaccacgattcacttggccagggccccaggtgggtctcttccctgtgctgagcccctccccagctgccacaggaaagagggatagggattctggaagatgcctctggggaccagcatttctctcccacagccaggacagatgggccagtggggtggatggcagccagggggaagcccaaagcacagatatggctgtttatttttaaattttttttgagacagaatcttactctgtcacccaggctggagtgcagtggcatgatctcagttcactgcaacgtccgcctctcaagtccaagcagttctcccgcttcagcctcccgagtagctgggactacaggcgcccgccaccttgcccggctaattt

SEQ ID NO: 23206 - DNA, 1032 bp, Homo sapiens
tccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcaggtgggcagaccctctccccctccctgtgttggaagggtctgacttctttcactgagcataatgtcttcaaggttcatccacagtgtagcttgtatcagaatttcattccttctgtggccatatcttccactgtgtgtacataccacatttggcttacccactcatctgtgaatgaactcttatattcacagaggttgtttacactgcttggctgttgtgaataatactgctgtgactatctgaatcgttttcagttctcttgtcggtatacctaggtgtggaattgctgggcctattgcaattctgccttttttttcttttttcttttttctttttttttttgagacagagtctcgctctgttgcccaggctggagtgcagtggtgcgatttcagctcaccataagctctgcctcctgggttcacaccattctcctgcctcagcctcctgagtagctgggactacaggtgcccgccaccatgcccgcctaattttttgtattttttaatagagatggggttttactgtgttagccaggatggtctctatctcctgacctcgtgatctcccgcttcggcctcccaaagtgctgggacgtagagatggggtttcaccatgttggccaggctggtttcgaactcctgacctcagatgatccacccgcctcagcctcccaaagtgctgtgattacaggtatgagccaccacgtctggcctgtaattctccttttaactttgaggaacctgcaggtgcac

SEQ ID NO: 23207 - DNA, 1049 bp, Homo sapiens
atctgcctgggactggaggcccccccgacaggtgtcctgaatgtcagactggccctggggatcattgagttgttgaccacacctcagggttggatcactagtccactccaagtcatcatgtctttccttcatttgcctgattaaggctatataaataagaaacctagtttgctgtcattgtaggtagacactgactgtggaaccctttcaaaggagaagcaggcaaggatatggaattctgtccaaggcccagagcccggtggctctgcttggtcagaggggtccagggcccagccgctgcagcccagcctcacccctgatgtcagaactgagagatgctattggtgcaggtggccccggccctcctgtgtgtcctttctgttctggggtgttgctgacaggcgcccagcttgtcaggtgtggctgtcggggaggccaggctggttgaggtcgcctggggtgggtaccccgggcagccagaggagacgaggctgaagggagctcatttccgcactcactgcagagccagagccggaccaggaaagaactgggtgggtcggggggacgaccaggtattcaagcccctgcagggtgtgcaggtttgctcctgtgtttaatctccatgcagggtcagctgtgaggcagccccaaagcacagaaatgctagttagacccacatggttggcagacctcccctcacccccaaatctaacagccgcctcatgtggccactcctggcccttccctgtcacgcctgtgggccaggcataccccagccactttgggaaacaatttgtaaccaactgcatggctataaagaagctggaggcctggtgcggtggctcacgcctgtaatcccagcactttgggaggccaaggcaagtggatcacctgaggtcaggagttcgagaacagcctggccaacatggcgaaaccccatctctactaaaaatatagaaattaactgggcatggtgtcatgtgcctataatcccagctacttgggaggctaaggcaggaaaatcacttgaacccaggaggcaaaggttg

SEQ ID NO: 23208 - DNA, 1047 bp, Homo sapiens
ctccaaaagggcatcctcacatcccttctaggaggagcttctaaggctcttccgctgagcccttgaggccccaaagcactgcccctcaccatgggttacctgtcccctgagtttaggccagaggtatgagctgcaggttggagggtgctctcttctatccctgggaaaggacggtcactggtcacgggtgagcttgtccagaccgcccagtgtaggagggcaaaggggggtggctgtggtgacagcattgccagcaagtccagccctgtccacattcaggacgagtccctgtgacacctgaactgtgtgaagggctagccggtgaggtcacatcaccctgacagcacagactgaagcgactgtggagttgtgccatgacagccttgagatcccttgcttctggctgtgtgtccgagcggatcagaggccagcttggcccccgggccattagaatggagctggcgtgtgtcctttccttaaaggggtgccccagcagctccaagggtaccctgttgggaactgctgcattacaaggggtattggccatctcggggcccttgaagcccattatgacccactgtctgcatggcctcagaaacgcacctgttcctgtaaacagcaaccaggtcaggattgttgctgggcccatggcaggagggcgacctagggtgaaagacagtcacggaatgctctcgggacctcacaggggccctcgttgggctacacactccccacctctcccccattcccagcagcccaagcaacaaggggaataagattagccacaggtctggcatgttgcccagttgccaggcacttgctggcagcgagaaatttctcttgtgcatctcctacaaggactgcagtctgtgtagtagctgacaaactcacagcctcagaaacaggccaagggaaaaatgcaaaagcaagttccacatggctcagtggggaggctaatccgtatataaaaatatatctttatagctctgttcactgaaaaggccccgaaataatgattaagcctgtggcattgagcatccctagctc

SEQ ID NO: 23209 - DNA, 1046 bp, Homo sapiens
cgagaagtaagtgctgccttggaggaggtgatgtccctgcagctgagaatagcaggaggatgactccacagacttcagcaggagaggctgggggttgtccagggtgtccagggaggggcactaggccaggcagagccctagctctgtgccagggcagcaggaagccacacagtgtgtgtgagccggagcaggagagggggccctgactcccatgtgtccttgcaggcaggagcagttcgtggacttgtacaaggagtttgagccaagcctggtcaacagcaccgtctacatcatggccatggccatgcagatggccaccttcgccatcaattacaaagtaaggcctgggccctgcccaaacattcactgtctgcccacccagccccaccccatgaagccatctgtccctcatccccacagggcccgcccttcatggagagcctgcccgagaacaagcccctggtgtggagtctggcagtttcactcctggccatcattggcctgctcctcggctcctcgcccgacttcaacagccagtttggcctcgtggacatccctgtggaggtcagtggccctgtggaggtgaccctggggctcagcttgatgggtccctcctatggcagtgaccctgagctgggctgcaggtctccagctcaccatccctccctgccccgacagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaagccctgcctccacctcgtctgtgccacacggtg

SEQ ID NO: 23210 - DNA, 1001 bp, Homo sapiens
cacggtctcagctcactgcaacctctacttcccgggttcaagcaattctccttcttcagcctcccaagtagctaggattacaggcgccagccaccatgcccatctaatttttgtatttttagtagagatggggtttcaccatgttggccaggctggtctccaactcctgacttcagatgatgcgcctgtgttggcctcccaaagtgctgggattacaggtgtgagccacctcacctggcctttttttcttttttctttttttttttttgcaagaactcaggtgttaaattgaattttaaagatcaatcttacgttggtttttttgcttttccaatatttatctgcttttatctactaaagcatttattgagtgttgtttgcctcctagaatcatgctccttggctatttcttttgaaatcagtttaggttgttttgttttgttttattttgagactgtctcgctctgtcgcccaggctggagtgcggtggtgtgatctcatctcactgcaacctccgcctcccgggttcaagcgattctcctgcctcagcctcccgagtagctggaattacaggcacatgccaccacccctggctaatttttgtatttttagtagagacggggtttcgccgtatcagccaggctggtctcaaactcctgacctcaggtgatccgcccacctcagccttccaaagtgctgagataacaggtgtgagccactgcgctcggccaaaatcagtttagttttgacctatctcgtgttgtgtgttttttcattgcatttgttgtgggggtttattgttggtggtttgttttcttaaagtagtttgtagaaagcaacacgggcactctctgaggtctccttagggtgtcaggtgaaatggggaagtctgggaactgtcctcacgggagccagctgggggacttcaggaccagtggctctgaagccagcaatcttcccctccgtggagcctgctcctccgggtctgacaccctcctgcc

SEQ ID NO: 23211 - DNA, 1001 bp, Homo sapiens
agggggagccactggctctcacagccctaggcaggtgggctgcacccctcagagcatcttggggacaggcaggcctacagctctgatgctccccgaggtgggtggccagaggctcactttagacccaggataggccacgtccttgggtgtccctctgggttggaatctgccctgccctggccgaagccacagtgccagggtcctccaagcccaggtcttccagctctggaccaacacctgctctagcccagagccccgatcaggccctgggggaggcaggagggaggtgggggaggccggggtgagaggtaggggcttggctgcctctttggagcaaagcccctcaggactcgtacttatttgtttccagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatggtgagctggccccagcctggggcaaggggtgggggcgcggggcagcccgtgacatccccctgcattccctgcagttctcccagtgcccgcccgactaccaccacatccacaccgagatctcccgggaaggagcccgcgtcctggcgctggggtacaaggagctgggacacctcactcaccagcaggtacgggcccaggctccccctgccttcaccatgtgcctggcccgtcagctcctccctgagtcacctcctgtgtcccacagtgccaggttgaatggttgtgattttgtcctccttgccccgcctccagcttctacctttggagactccaaatggcactcagtctgtccactgctgtggggacccacccagtcctggctcacgcagagcacacgcagggcttacctgccccagtcctggtgtgtccctagctctactcttttgccctggtct

SEQ ID NO: 23212 - DNA, 1057 bp, Homo sapiens
ctccaaataaataaataaataaagattgatataatattttttgagataggatctcactctgttgtccagactagagtgcagtggtacaatcatggcccctgcagtcttaacctcccaggctcaagtgatcatcccaccttgttccctactacaggtgggcaccaccacacccagctaatttttgtattttttgtagagataggctctccctgtgttgcccaggctcctctcaaactcctgggctaaagcgatctgcccaccttcgcctctgaaagtgctgggactacacgcataagccactgtgcccggcctattatctttaaatgaggctaagtcataggtcaatagaatgattcccctcacctcaccccttacactcacagcaacagcagcagaatacatacatacagcagaggacaaaaaactgtacaactcaggcttaatttcagaagtcctttagaatacttcagtaaattatataactgattacgtggacaaatgtctacacatacacaatataccaagactgagtcatgaaaaaacaaaaaatctgaacagagctgtagtagcaggagattggcatagtaataaaaaaaaaatagccaggcacggtggctcatgcctgtaatcccagcactttgggaggccaaggtgggtggatccccttaagtcaggagttcgagacaggctagccaacatggtgaaactccgtctctactaaaaatacaaaaaattacctgggcatggtggtggacgccggtaatcccagctacttgggaggcagaggcaggagaatcccatgaacccgggaggcggaggttgcagtgagccgagatcatgccattacactccagcctgggcaacaagagtgaaactccatctcaaaaaaataaaataaattaagaaaaataataaattggctgggcgcggtggctcatgcctgtaacctcagcactttgggaggcagaggagggtggatcacaaggtcaggaaattgagaccatcctggctaacacggtgaaaccccgtctctactaaaaacgcaaaaaagtaggct

SEQ ID NO: 23213 - DNA, 1030 bp, Homo sapiens
agtcctgggtcatatgttttggctgggacctagctgtggtttttttgtttttgttttagtttttgtttttctagacagagtctcactgtgtcgcccaggctggagtgcagtggcgggttcttggcttactgcaacctctgcctcccaggttcaagtgattctcctgcctcagcctcccaaatagcagggattacaggagcatgccaccacacccagctaatttttgtatttttagtagagatggggtttcatcatgttggccaggctggtctcgaacttatgacctgaagtgatccatccgcctcggcctcccagaattctgggattataggtgtgagccactgcacccggcctagctgtggctgtgtattttagaatgaagctgtgactaatgctgggtattggccttcatctagggtgcaggctggtggggagattttttttcttctgtgcaagttgtgggcccatcaagtagtcattcctgaaaaagtagtcatctgaaaaacagaaagaacaaaaagagtggggactgggaagctgctattagatggtgtcttgaggtccacactctccaggacccttaaatacctctgctgctgctgttgctgctcacgcctctaacgcaacaaagacccagatcctccaaggttgtcagaaataaccctcatggcatcctttagttcagcaaagatgttagttcagacctaaataaagccttgtgtccttaaaccacacaaagcatctctcaccatgcaggaggcccctaactgatagtagttatttgaagatctctggaggaaaaaaaataacacatgctgtagtagagagggccctcccctccccagagtatttccagtgagcagaaaacaaaaagtgaaggagagccgggcgcggtgcaacacgcctgtaatcccagcactttgggaggctgaggtgggtggatcgtctgaggtcaggagttcgagatcagcctggccaacataccgaaacaccgtctctactgaaaatacaaaaaaattagctgggcctg

SEQ ID NO: 23214 - DNA, 1053 bp, Homo sapiens
agtgaattactgaactataaagggtggtgtgggaactccagatttgtagttggcgtgtagaagcatgggtggcctgggcaccctaccgtgtggcttgcatctgacatgggggcagtcttgtgggactgagtccttaacctgtggagtctgactaattctgggtacttagaattgaattaaattttagggcacagtcgatgtcagagatttggagaatggcgttggaaaagacaccttgtattggtgttgggaagacaaaaaacggttcaccttcacacatgcttctgtgtccctgcccccaggtcacataggctttggtaaaatcatagtaggttgggcttttgttgaaatggaattttttgagaacaggtcttcttaagaagaacattatgttctgggaatattacaaaactgttacttttcctattcatctctcaaattttagagagaaaactttgccttatgaccctcaattctttaatggatccaagaagggtaattgatttgatgtttattttttacttgcacggctgggattgacaatttctacgttccttacttgtgagaccagaaattggaagtctctgacttcatttttttgtgatgtttgatggatgatagctttaaaatctcattattgccaggcatggggactcacacctataatcccagcactttgggaggcggaggcaggcagatcgcttgagcccaggagttcaagcccagcctggccaacatggcaaaaccctgtctctactaaaaacacaaaaattagacgggtgtggtggtgcacatctgtaatcccagctattcaggaggctgaggcacaagaatcgcttgaacctgggaggcgaaggttgcagtgagccgagatcacgctacagcactccaacctgggcaacagcgaaactcggtctcaaaacaaatgaaataaaataaataaaataaaatctcattcctccttttctactatgtaccctacatccagatgtggtaggaagaaagcctgggtcaccctcatttggtgctggtgagacattcaatccacattag

SEQ ID NO: 23215 - DNA, 1027 bp, Homo sapiens
tatttttaatgtatctataactgtatatttaaaatgtgtttcttttcaacaccgtatatttgatccattattgacagtatctgtccaccatttgttgtatttagaccattgatgtttaacatgttattgatttagttgtattaatgtctccctttttctttttatgtttttctatttgttgttgttcttcctttcccatcttctattctttttctaccttatctgctttcattaagcattttacttgatgccatttttctccccacttagcacatcaattatagttttttgttgttttttaagttttactcattgcctttgagtttgtagtacatgcttacaagtaacccaagtcctcttgtaaagaacactgtactacctcactggttgtgcaagtacctcatgaaaaagtattcccaattcctcctttcctgtcctttgtaacattgctaccatacgtatcatttatccataagctggacttaccaaatatattgttcctgttagtgttttggacaaactcatctgtcagattacaaaaaagagattgtattttacttgtatttattttttctctaatacccttctttatcgtttttcttttttgtagggaattttttaacagttctttcaaggcaggtacgctagtgacagattatcttttcttatctcataaagctttcatttctcttccattttgagggatattcttgctctatacagaattctatgtggttgggggttttgtcttataatgttttaaacatttcactccagtctcttcttgctttcactttctgtaaagagtcttgggctggtcctggtggctcacgtctgtaatcccagccctttgggaggtcgaggtgggcagatcacttggggccaggagtttgacacccacctggccaacatggcaaaaccccatctctactgaaaatacaaaaaattagctggacatggtggtgcgtacctgtaatctcagctactcggaggctgaggcaggagaattgcttgaacccaggaagtg

SEQ ID NO: 23216 - DNA, 1052 bp, Homo sapiens
ttgagcgatgcggatcctgagagcgctcccgggtaagcaaattccctggtggaacgcctcaccagagcagcgtgtggcagcccccgcggaggatcaatgcagtgactgaacaccgggaaggaactggcacttggagtctggacatctgaaacttggtaagactagtctttggaacttgcccactccatttgagtggaagtgtggcctgatcacctatggcgtgcctgtaccggcactttggtttttgtttttgacttgacttggattgcttgatactttggttttggttttgaccttgcttggatttctagataccccgattttggtattgattctggtttggtgtaaactgtaaaagtatgtgtgtgccctttttacccgttatttgttttgtggtgtgcgtgtggtgcgagcgtggtgttttgtcttgaagaagcatgggtcaggcacaaagtaagcctgccccagtaggagctatgttgaaaattttcaagaaaggatttaagggagattacagtgttactgtgataccaggaaaacttagaactttgtgtgaaatagactggccagcattagaggtgggttggccatcagaaggaagattggacaggtcccttgtttcaaaggtacggcacaaggtaacctgtaagccagggcacccagaccagttcctgtacatggacacttggttatagctggttttagacccccaccccacaatggttgagagaacagcagcataagcaagcttgcagaggcaaggaaagaccagcagagagagaaagaggaagagacagagagataaagagggagtcaaggaaagagagagagaggcagagaaagagaaagagacagaggcaaaaggaaagtcaaagagaaaaagaaaatcagagaaagaaagagagatatacaagtagttaagaaaaaagtgtaccctattcctttaaaagccagggtaaatttaaaacctataattgataattgaaggtattctccataaccctataagactccaataccactttgttgtcagtgtaaacaagggcgtattc

SEQ ID NO: 23217 - DNA, 1050 bp, Homo sapiens
ggagagaatcgcttgaaccccggaggtggaggttgcagtgagctgagatcacgccactgcattccagtctgggcaacagagcaagactctatttcaaaaaaaaacaaagaaatagaaatagaatccatgtatttctgaatcctgaaaaattattagtaaatgtttattatatagttttctttgaacatctggtctgtctgcaaacatatagaccttttttttttttttttttgagatggagtcttgctctgtccccaggctggagtgcagtggcgtgatctcagctcccgggatcgagtggttctcctacctcagcctcccgaatagctgggactacaggcatgtgccaccatgcttagctaatttttgtatttttagtagggatgggctgtcaccatgttggcaaggatggtctcgatctcttgacctcatgatccgcccgcctgggattacttatatgaaataaaattttaaataaaaaatagcatttgattacaactattggtgagactattagtgtgaagtcatatttttacttacattgacaaaataaccattctgtatattggatattgacttctattgacaaaatagccataacaatattctgatttagaataatactccttttctgctgtatatttgcaagcttttatcaaatattacgggagctcaatagaaatcaacaatatgaatctttatttaccacaaacattattgatgcctatgcttgtttttcttaaaatctattagctttttatgacacatttatactttttcagttgtttattactgagaagtggctgtcctgccagaaaactgctattctcagctgtatccacaatgactaatagtgagtggaagtgcagtggataaaagcaaatgtgtcttctctgtattttttttcatccattggctaaaaaacaggaggatgcagaagatgaaagaaaatacaatccctgaaagatcatgaagaagctctcaatcagacaaaaaaccccataggagattttttttttttttcattattgtactctctgcttctatgag

SEQ ID NO: 23218 - DNA, 1053 bp, Homo sapiens
gtgcaccaccacacccagctaatttttgtatttctagtagagacagggtttcaccatgttggccaggctggtctcaaattcctgacttcaggtgatctgcctgcctcggcctcccaaaatgatgggattacaggcgtgagccaccgaacctggccacatggattctgttttctttcctcagtgttagagaatacatcagagaatatatttgttaaaaatagcagattgaataattccagtaactctcataagtcacagcaattctctcttttcacatggagtcaagaactctgcccattgacagttggtcactatgttttgttttgtttttcaggaactgttgacattcagggatgtgaccatagaattctctctggaggagtgggagtttctgaaccctgctcagcagagtttgtataggaaagtgatgctagagaactacagaaacctggtctctctgggtgagaataacttcaatacacaatttctatttcacacaaaagattttattttcttcctctgtagaatgtttggtggggatttctgctttgtataaatgagttttagatctctgctttcaaggaaaacttggggatttgttgggatagagaagaaaattttcaagatgttttatgtttacattaactttcttctaccttgaggtgatgggcatttttcactctagtttagtggtaattctatttttttattttattttattttattttttgagacagagtctagctctgttgcccaggcttgagtgcagtggtacaatccagctcactgcaacctccacctcctgggttcaagtgattctcctgtcttagcctcctgagtagctgggactacaggtgcccaccaccacggccagctaatttttgtatttttagtaaagaggaggtttcactatgttggccaggctggtctcgaactcctgacctcacgtgatccaccctccttggcctcccgaagtgttgggattactagtgtgaactaccctacccagcctttagtggtaattcttggaattccattataaaaattccttta

SEQ ID NO: 23219 - DNA, 1054 bp, Homo sapiens
gtgcagtggcgcgatctcggctcactgcaagctccacctcctgggttcacgccattctcctgcctcagcctcccgagtagctgggactacaggcgcccaccaccacacctggctaattttttgtatttttcagtagagatgggatttcaccatgttagccaggatggtctcgatctcctgaccttgtgatccacccgcctcagcctcccaaagtgctgggattacaggcgtgagccacagcacctggccagaaacaggattttaaaaatgcacatttaaagaggatgtcactaattgcccagaataactcagaatattctggaaaagagaatagttagataagacttgctctttcaaatgctgaggaaaggctacttaaatacattattagaggttataaaacctgggagatatctgtagcttgaactttgcataaagatgtttctttatgcttagattcaggttataatttactttttgttgccaataatatcatagctctgatgattgtctgcccatgtgtgttgacactgtacatcaatttgttctattgtagttcatgttaatttctttttttttttttctttttttttgagatggagtctcgcactgttgcacaggtttgagtgcaatgtcacaatcttggctcactgcaatctccgcctcccacattcaagcaattctgctacctctgcctcccgagtagctgggattacaggcacgtgccaccatgcccagctaattttttgtatttttagtaaagatggagtttcaccatgttagccaggatggcctcgatctcctgacctcgtgatctgcccaccttggcctcccaaagtgctgggattacaggcgtgagccaccgcgcctggcccaattcatgttaatttcaatcacttggttaaggctctctgtgacagattttttttaattataaagttaattatttttatctttattattcgtaagtaccttgggagatttactgactgatgtacataaaccatcacatttaatctgcaaacttccctttctttttagattctctttgctt

SEQ ID NO: 23220 - DNA, 1030 bp, Homo sapiens
tcctcagccaccctgtgttattttcctggttttgagtttcagaactgtctggggatgacatgagatgcccacagtggctgtgtctcctgaggtgtctagtgaatatcagcccctgggccatctcctctcaggggcaaccctgccaggtatgggaatgtggcctctctgtggagtggttggtgcattgtgcctgggagaaatcaggtatacctttcctctgaaagcaaatccattaggacattaagattttcttccccaactcccagtttccatttcttagagatacagtgctggccaggcaatttggatgctagtattgaggagaaaattttctcagattggtgaagagagaaaaaaaatatccccaaggacaaggaacacccaacccagtgaggcagtgcaaaaacctgcaaagcaaaatgcatctaagggacacagtggggcacagcacagtggctcttggtagaatggttattgtccacttcagtgagcaggatggggcgggaaaatgtcccaaatgatagaatggcttgacttgacatctgagtcagatatgtctgtgttccaatcagtattgccgcttcctgagtttgtcaccttggaaagatttctttgcttattttaacttcagtttttaattaagtgtaaattatcagtagagcttgaaaggtagtctgtactggcaacctggttttttcaccaacccaggcttctgtgccacctgattatagtctcatctgcctgcatggacacaggaagaagtcagagcatagcctctcctgggacacaatctatagcatgaaccagtccttccgtaaccctgcactgtcccacccatggcttctagatagcaactttccctcgtttgccttttagttcccccacaaaccctttttttatgtgcacacagtgtgcccaacgccacccctcagttgtcagatgtccagtagttcaagaccatgggcctagacctaccttttgcagaagcaaatacaaattagaaataaggggcttcattcccccacttgaa

SEQ ID NO: 23221 - DNA, 1043 bp, Homo sapiens
aaaaacttagccaggaacagtgatgcatgcctgtaatcccagctactcggaaggctgaggcaggagaatcgcttgaacccgggaggcagcagttgcagtgagatgagatcatgccactgcactgcagcttgggcaacagagactctctcaaaaaaaaaaaagaagaaagaaagaaagaaaaacaaaatactgttaaatgtatataaatgcagcttgtctacaaacattacacataactatgctaattattctgaagtaataaatagaaagccaggcacaactacagactccactgttcagtttacgcactgaactgttcttctttttgcagtataagtacttcagcctgcaaatattggataatttccttggataatctggtttctgtcaaagaaacatagtatcttttaatgtttaccattatgtattgctaaatttgatcctatctttgtgctaagcttctgtgtgcccttaaaattagcttttatctaaataaatctgtgtctatttaaaggactaaaaattaaaaaataaactttttggaaccaaaaacaaagcaataaatctgaagttctagataatctggagtcagaaaaaagacaaaaggtatttagctgttaatataatttacatatatttttaaaaatcagagaaaaataactatatataatctaaatcccttaagaaatgagacaatggcaaaaatttttttggaagtttttttttttttgagacggagtctcgctctgtcccccaggctggagtgcagtggcactatctcagctcactgcaagccccacctcccatgttcacgccattctcctgcctcagcctcccaagtagctgggactacaggcgcccgccaccacgcctgactaatttttttttgtatttttagtagagatgggtatcactatgttagccaggatgatctctatctcctgacctcgtgatccacccacctcagcctccaaaagtgctgggattacaggcatgagccaccacacctggcctttttttggaagtttttaaggagttttgaa

SEQ ID NO: 23222 - DNA, 1057 bp, Homo sapiens
gggtggctcatgcctgtaatcccagcactttgggaggctgaggtgggtggatcacaaggtcaggagttcaagaccagcctggccaacatggtgaaacccctctctacaaaaaatacaaaaaaaattagccaggcatggttgtatgcacctgtaatctcagctacacaggaggctgaggcagagaattgcttgaacccaggaggcagagtttgcagtgaaccaagatcacaccactgcactccagcctgggcaacagagcaagactccttctcaaaaaaaaaaaaaaaaacctatgaaaatattagagaagatccaaataaattttaaaattgccgtattaaccagagtgatctatagattcaataaacctcctatcaaaattgcagtggtatttttttcatagtaatggaaaatacatttctaaaagttacgtgatactaaaataactttgatagccaaagcaatcttgaggaaaaagatcaaagcagaaggatatcatacttataatttcaaactatatttcaagactatatagtaataaaaacagaatggactgtgcagaaaaaatgaacaaaaaatgcaacaaaaactaatactgtcacacatttcagatctgaagcaaaaagacaacttaaaaaagggttttagtttctcaaaatcacgcagatatttgtgtgtccccaaggcaacggaaaagcagccagattgtgcaatcacttatatgccataaagaggaatttcgctctcactgtgaacttgaaggaagctcaccgaaagaatagtagaatccttagagaatttaaaagcatgagacagatgtccctttgtgagagaaaaattaaataaataaataaataaataaaacagctgcccaggaactatttcctttggaacacagcttcccagatcacattttaaggactggctttctttttgaccttgggacctcttatctgcattgtctgttgtgttcattttcattcgcacctacctgggggtttggcaatcatctcatgtctcttcatagtcagaggttttattccttgctccagacagg

SEQ ID NO: 23223 - DNA, 1158 bp, Homo sapiens
tcaatcttgttgcacaagctggagtgcaatgatgcaatcttggctcactgcaacctccaactcccgggttcaagggattctcctgcctcagcgtcctgagtagctgggattacaggcgtgcgccaccatgcctggctacttttttgtattttcagtacaaacagggtttcaccatgttagcctggctggtctcaaacttctgacctcaggtggtctgcccgtctcagtctcccaaagtgctgggattatagacgtgagccaccacaaccggcaccagtgaatttatttaaaacattcttacacgtcagaaaaaaactgtgatattgctaaagttataataatttttttaaaaagctgtcaaatgcaataatgccatcagcaaaattgtactaccaaataaaacaagtgcttccaaaataaccaaatcctgagaaagtatattggcactgcatacaccatacacatcaaagatgctaaaaggagtttcttccactgaaaataacataatgcaagaaaacaacagataatctatgaaaatacataactttctggaaaagatatccacatacacaaaaatggaatttcttaacatcataatggtacagaaaacatttttaatactctctaaatttaaaagataaaagtatagaaattattgttaacatctgttaataaatatacaacataaaaaatataattagcaaaatcagtaacaaagttgaaggcaaatgtaatgatgaagaatttcagtatataactgaagttaatttttttaccacattcaaatatattgttggatcttttaggttttatgtaatcccccatgttaccactaagataatagctgtatagatacacaaaagaaaataagaaactgaaagcatatcaatacaaaaaattaaaaaaacacaaaaaagacagaaaatgagtgaaaaagatagaagaatcaaataaaacaattaataaaaataacagtaagtttttctattgcagaaaacgatttaaatatatatataatcatctttccaatcaaaagacatatttttttttattttttgagacggagtttcgctctgttgtccaggctggagtacagtggtgtgaccttggctcactgcaacgtccgccttctaggttcaagcaattctcctgcttcag

SEQ ID NO: 23224 - DNA, 1053 bp, Homo sapiens
tctgtaggttgtctgcttactctgttgatagtttcctttgctgtgaagaatctctttagtttaaataggtcccatttgtcagcttttgcttttgttgcaattgcttttggtagcttcatcatgaagtgtttgcaggtttctatgtctagaatggtagcttttatgttatcttgcagggtttcttataattttatgttttacatttaagtctttaatttttcttgagttgatttttgtatgtggtgtaattaaggggttcagtttaagtgttctacatattactagttagttattccggcaccatttattaaatagagaattttccccacatttcttttgtcagctttgtcaaaaatctgatggttgcaagagggtggcattatttctgggctctctgttctgttgcattggtcttgtgcacatgaattttttataacatctttctctcttctgcttttccccccataaacattttttttttttttttttggagagggagtttcgctattgccaggctgaagtgcaatggcatgatcttggctcaccacaacctccacctcctgagttgaagcaattctcctgcctcagcctcccatgtagttgagattacaggcatatgctatcatgcccagccaattttgtatttttagtagagacagggtttctccttgctggtcaggctggtctccaactcccaacctcaggtgatctgcttgcctcaacctcccaaagtgctgggattacaggtgttagccaccacacctaggctaacattctttcaagtgcatcctgtttgcaaaacttagattaccaagagttcaaagactttttaaaaagttccaaaaaaatttttcttattctctttttccttaagggatttagattatgtgtagatatttttctctgctttcttgaaatatctgtaaaccatattaacagttaaataaactttgtctttttttttttttttttttttactttagattatcttttctagtacatctgatttattggtttatttctaattttaaaaagtttgtttctctccttttt

SEQ ID NO: 23225 - DNA, 1053 bp, Homo sapiens; identical to SEQ ID NO: 23224

SEQ ID NO: 23226 - DNA, 1096 bp, Homo sapiens
cactccatgctcatgaatttaaagaatcaatataattaaaatgtccgtgctgcctaaagcaacttacagattaagtgctacttctctcaaactataaatgcaactttttatggaattagaaaaagaaaaccattctaaaagtcatatggaagaataaaacagcccatttagccaaagcaacattaacaacaaagcaatcctggaggcctcacattacctggcttgtactacaaagctacagtaatccatattacatggcttgctacaaaaatacacatgtagaccaatagaaagaagagaaagccctgaaataagtttacatttctacacccaacttttttctgacaaagtcaacagaagtaaacaaggaaaaattgtctatccaacaaatggtactgggaaaactggttaatcatatgtagaaggagaaaattgaaactgtacctctcaccatataaaaaatgtaattcaaaatagattaaaaacttaactgtgaaacttaaagctataaaaatcgtagaacatcaaaaaagtactcttctagtcactggcctctggaaaggatttatgactaacaccataaaagtgaatgcaacaaaaataaaagtgaaaaattaacacctaattaaactaaaaaacttctgcacaccaaaagaaaccattgacaaatatgcagacaacctagagtatggaataaactattttcaaacttcatacaagaaaaagttaatatttattcatatatattatgtatttatataatatataaattaagttaatggttagaatactataaaaatttaataaggaaatacacaaatgatctgagtagacacttctcaaaaaaagacatgagagttgccaataaacatgcaaaaaattgctcaccatccctaatcatcagagacatgtaaatcaaaatgacaatgtgatgccatttcatagcagttagaatggctgttattaaaaagtaaaaatattgcagatgttgaagttgtggagaaaagggaatgtatatatactgttggttgaaatgcagtttaatgcagcccttgtgaaatgcagtttggagatttcttaactgaaaatagaattg

SEQ ID NO: 23227 - DNA, 1033 bp, Homo sapiens
tctcaaagtactgggattacagatgtgagccacagcacccagccaaaactaaaatgatatattttaatctcgtaacaacttcaatttaatacaaaagctatacctttatatttttcagtagttattgatattgaagattattttatactatgcatctactaacagatttatattttatatttcatattctatagaagtagtttaaggattttgtgtaccatcattatgatagtaaataattctatatgtgtctgtatatttacatttaatagagagctttattttatatatggttttatgatgctggccagcatcattttaattttcaaaaaaatggactcattttaatatttctctttgtttatatgcagagtctcactatgttgctcaggctgatcttgaactcctattctcaagtgatctggctgccttggcctgctaaaactgtaggattcataggcccgaaccacagtgcctggacaccatgtagtacttttcataggactgtgcttgtagtgatgaacacccacaccttttattatggagtctttatttttatcttgtttttaaagtaaaataattttggatcaagtattattggttagaaatatttttttatcacatcaacatttggaaagttcttaggtttttcttttcttttttgagacaaagtctcactctgttgcccaggttggagtgcagtgatgtgatctcggctaactgcaatctccacctcccgagttcaagtgattctcctgcctcagcttcctgagtagctgggattacaggcacgtgccaccatgcccagctaatttttttttgtttgtttgtttgttttatttttgagatggagtctagctgtgtcgcccaggctagaatgcagtggcttgatcttggctcactgcaacctccacctcccgagttcaagcaactctcctgtctcagcctccggagtagctgggattacaggggactgccaccatgcctggctaattttttttgtatttttagtagagatggggtttcaccatct

SEQ ID NO: 23228 - DNA, 1020 bp, Homo sapiens
gggttcaagcgattctcccacttcagcctcctgagtagctgggattacaggcacatgccaccacacctggctaattttttttttttttttgtatttttagtagagatgaggtttcaccatgttgtccaggttgaccttgaactcctgatctcaagtgatccacctgcctcctaggattacaggcatgagccactgcactcagcctgtagcatacccttgagagcacatagcgcctgcttaatacaccttgcattagtacatgttgttttccaaatgcagacttattcagacattgctgccttctgtttcctttgtaaactttgaagagccagcaaataatatgaaactttaggatgaagatgggttgtctttatttgtaccagaaatacttgtgttgtgacaagagtgctgagtgtaagggactctgtgctgtgcctgctttctctaactactgctaataatgagcccgggggagcaacattaacattgacaggggtcttgtttaaaacatttatccatggatcctttccaaacctgcagaatcccattacgtagagtgggtccaaaattaccaagtgaattttaagctcactaaagcttgagaggcaatgcttggctaagtggttatcagcccaggcttctcattaggattacacagccagtttgcagaaatctctgtacttcacccctcctcacaggctctgtttattgctccaggtggacacatccatgttgtatttgtttgttttgagatggagtctcactctgtctcccaggctggagtgtagtggcttgatcttggttcactgcaacctctgcctgccaggttcaagtgattctccttgagtcagcctcccaagtagctgggattacacgtgcatgctaccgtgcctgactaatttttgtattttttttttttgagatggagtgtcgctctgtcaccaggctggagtgcagtggcgcgatctcagctcactgcaacctctgcctcccacattcaagcgattgtcctgcctcacc

SEQ ID NO: 23229 - DNA, 1062 bp, Homo sapiens
ggaggaggaagttgcggtgagctgagattgcgccactgcactccagcaggggcaacaagagcgaaaccctgtctcaaaaaaaaaaaaaaaaagaaaaaagaaaagaaaagaaaagaaaaggatttgcatttcctatataaaaggtttttttttttttgagacaggtttcactcttgttgtccaggctggagtgcaatggcacgaactcggctcactgcaatctccgcctcccaggttcaggtgattctcctgtcttggcctctcagtagctgggattacaggcctgcaccaccatgcctggctaataatccttttctttataagtctcagagagacattaaaatgagaccacaattatgtctttcttttttctttgagctatgtagttaccacttgaaactgcttgctattgccacaagtagctataaattgaactaaaaatgccacactggacactataacccacaccctatagcctaacaatgtatatccaatcaataatcaatttatttttgtaaataaaaaaatgttgacagacaactttgtatcaacccactctatgcgcctctctttttgtctttccaatccaattgtaactgctgctaatcaaagtatatattccaggcaacttgaatatttgctcccaggttacaatcctcaagtttggcccaaataaattgtatacttacattcatgtttcctcagctatttccttttaggtaaacatcatttggaacgtgccagagcggcctctgaggggatctctcctttgattgtactttgctttctgtaacacctaaggatgcagagtcaggttgatcccacttagaatctgcacataagatctggcttctgcctgggattacaagacagggccagactttgaattgggaatgtactgaaaaccaatagaaggcattttctgcactgtgagatgtcaacatagacatcctacagctccctttgagactgtggctctttgagcttttcagattttgtccagtaagatcttgtagcaggtctgccacagttacgtgagaggctccagatgtaaacagaatc

SEQ ID NO: 23230 - DNA, 1039 bp, Homo sapiens
cctcgtgatgagcctcccaaagtgctgggggattacaggcgtgagccaccgtgcccagcccattctaaatacattggcctctgatggtcaccattttacatcaatgaggttatgttttttggaatccatgtgtaagtgaaatcatgaactattaaccttatctcaattaatgttctccagcttaatccatgtgattaaaaataatgaatttttttttaaaggccaggtgtggtggctcacacctgtaatcccagcattctggaaggccaaggtgcattgcatgagcccaggagtttgaaaccagcctgggcaacatgaagaaaccccatctttactaaaaatacaacaaaaaattaactgggcatggtggtgcacacctgtaatctcagctactctggatgctgaggcatgagaatcccttgaaccagggatgtggaggttgcagtgagccgagattgtatagacagagacttggtctcaaaaaaattcttttttaaatagtattccactgtatatatctaccacattgtctttctttactcattagatgctgaactgttgattttttttttttttttttttatgaagtctcactcttgtcaccctggctggagtgcagtggagcaatcctggctcactgcaacctccacctcctgggtttaagtgattctcccaactcagcctccagagtggctgggattacaggtgcccgtcaccatgcctggctaatttttatatttttagtagagacagggtttcgccatgttggccagtctggtctcgaacttatgaccccaagtgatccgcctgccttgtcctcccaaagtgctggaattacaggtgtgagccaccacacccagcctgaactgttgattctatattttggctattgtgaagagtgctgcaaacaacatagaagtgtaagtgtttcttcattctgatttcatttgttttggaaatatacccaatagtgcaacagctgtattacatggtagtttgattttaagttttttgagaaatctctattttgttttcctaa

SEQ ID NO: 23231 - DNA, 1051 bp, Homo sapiens
ttttcaatagaagcaactgctttcagtacattttgtatgtagggtttatggagttccaatatacttttcagaattttgttacttttgaaagttattttctttttatttggcaggacagatttgctgatagtattatgcttacttgattgctgtattttacaggagtttgactttattacacacttcccttctggcctgcaaaatttttattgacaattcactggctgtctcataagactatgctggcaaatgacgcatcacttttatcttgcagctcccaaggttctcttgtctgtgacttttgaaattgtgcttatatatgtgtttgttataaatatctttgtgtgtttcctagtttgtttgttgagcttcttcatctttacatcgtttctttcaatatttttcagctattcttttttatatttattacctccacaatttgtttttttgatattctaaatatttatgttcttatcttcatttttctgattttctatagttctctgtcttcctgtttcactcactgagtattattcaatttattttcaatttttaaaatcggtgtgtatacatcttttttatagtttcttttttaaaattttatatttttatggaaccatattgccttattttgtatacattgtaatccttgattgaaatttggacattaaaaaaggctacctgtcacaatctttataatgtagctttgtcctggcatagtctgaacaatcgtcttggttagagattctgggagtctctcaaacatgttcttagaatgtgtcttgtctgagattttgtctttctcttttagttaaaggagtttattcatgtttcttcttaataataatcacgtgctacacctgttttctgtctgtggtacagcagtctctctgttgctgaaacatttacctttggtctcagcaaagttaagactgtcactccaaagtataccaccgtttctttcagcattatatttcaagagagacacaaaccagtgtctggaaaggctcctagaagcaagtaataaagataaatgtgccagtattttact

SEQ ID NO: 23232 - DNA, 1018 bp, Homo sapiens
acccacctgaatagactgttaaaatagtcttatagtttctttttttatctaagtaaacaaaagatatcatttgcaaataataattaactaccttcccattttattacaaatattaacatactttttctggcttatttttttcaagtatcattttatacatttacacacatatacaacaatgaaaattattcaattattcaatgtgttaatttttattaaaaatgattgttaggctgggtgcagtggctcacgcctgtaatgccagcactttgggcactttgggaggccaaggcgggtggatcacctgaggtcaggagttcgggaccagcctggccaaaacggcgaaacctcgtctctactaaaaaatactaaaattagccagggaaggtggcaggcacctgtagtcccagctacttgggatgatgaggcaggagaatcgcttgaacccaggaggcggaggttgcagtgagttgagattgcggtcggcgtcccccaacttcttagagggacaagtggcgtttagttggtggagcgatttgtctggttaattccgataataaatgtcaaatataacaaaaaatgcacaggtattaacatactgaatagggaaatgctgtaagattttactctaagagctaaaacaagtcaaggatgtgcactttcttcagtcttactaaacatagtactaaatgtccaagacatagaaaataaagaataaaatcaaaggcatccagattggaaaaaaaggagttaaattatcattgtatgataatcttttatctcaggctgggtgctgtggctcacacctgtaattccagcactttgggaggccgaggcaggtgcatcacctaaggtcaggagttcgagaccaacctggacaacatggtgaaacccatctctactgaaaatgcaaaaattagctgggtgtggtggcgcatgcgtgtaatcccagctacacaggaggctgaggcaggagaattgcttgaatgcggcacgcagaggttgcagtgagccgaga

SEQ ID NO: 23233 - DNA, 1027 bp, Homo sapiens
tccagcctaactctggcttgaagtaaaaatacatactaaatttccagttctgacaatctcgagaactgaaaatttagtactttacttcaaggaactgtcaactttctttccctaattcacattatgaactatttgtcctttagtgtatatttttcatactgtattttaattatttactgacaacacattgaaaacattttaaaaatttgttttctgtttttaaatattttccatgagaagaaagcaaagagtaatcccctgacactgtattttaaaaaatatctgtgcctctttttcttttatcttccctaagcacagagatcataatgctttgggggtcagtgttttttgtaaactttatggggtgatgtgtcctcagctaccctttagttttttcctggtcctgtactatctgaataaaccaagatacccaccatgtctatctgctagagttaatatcagctcttgggtcattttctcttatagaacaagctgaggtatggagtgtagcctctcaagaagaaggtgaatgccctggggcttagagggatctcctggtgtattcttcctttgaaaagctaaccctttgagacattaagattgtttttatccaagccattttccatttcttggagacatattgctggtcagcgatcagacgctggtattgaggggaaaacagaaataatttctgccagctggattctccaagatttgtgaaaaaaaattgtatccccaaagacagataaaaacctcatctcagtgagctagtacaagaacttgccaagtaaaatgcacttggggcactcattggggcgtaatgcagtgtctcctgagaaggtggtcattggacacttaagtgagcaggatggggtgggaaaatctctccagggattggatggcctgacttgacgaatgagtcagacacatctgttttctaatcagcactgccactcctttgttttgtcaccttgaaaagatttgttcacttatattgactcttttaaactgtaaattgtattttatt

SEQ ID NO: 23234 - DNA, 1790 bp, Homo sapiens
ctcacagtatttaataggagagatgctctctcttgctctcgctctcttttttctttttttttttttttgagacagttttgttcttgttacccaggctgcagtgcaatggcgtgatctctgcccaccacaacctctgcctcccaggttcaagcgattctcctgcctcagcctcccacgtagctgagattacaggcatgtgccaccacgcccagctaattttgtatttttagtagagatggggtttctctatgttggttaggctggtctcgaactcccaacctcaggtgatctgcccacctcggccttccaaagtgctggggttacaggcatgaaccactgtgcccagcccaagatgctgtctcttaacagctaggcctagagtcatgaatatgattctgggtctccttgtacaaaggtcatgaagaattgccactttcttgcatactgtataaatctcttgtggtacagagagtgtcattacagggttcagcatacagatgagattgtttctcatatacactccccaccaactgttagaattgtcaccctcacacatggacagagcccactggtgaggccctgaatctcacacacacacacagtctacagttaaaattgtgactgtcatatgtgaacatctggctagagttgaaataatgacttatttctaaatccagttcataggtgagaattctacctgtctaagcctaggtaggatagtcaacatgtccctaattggctgggggacatgttgactctcctacctgggcttagggccaaacagttcatggaagggatgaaggctctcagctctcatgcacagatccagttggtgagattgtcactagcatacttagacccaacatactctgatacctagaactgggacatgtgcaggatttttaattactggaccttcctgcaggtgtgattgtgacatatgtctttgttacacacctgagtggtttgatgttcctgccttggttcaacccaaagtgaagattgtgatgtgtcactggacccagcatctcagtgatgtgactcttctttttggacaccacaaattttgggtattgtcaaatattgctggatcctgtacccatgttatgtgactctccaacctatgtcctgcatgttgtgccatattgcagcacaatgtgtcacattagacatcattacatattgctgggctcaacacccaagtgatgtaacattttcctgggccttgactacagggggctttgtgacataactgaatgcccataaccatggtaatgttactcttctcctgcctggtctctgctcacagggaaattgtgacataccattggcctagcatcttggtgatgtgactctcctctttttctcaggccccacatatttgggtattgtgacatacccaaatgtgacactgggctcaacacctaagggacgggagttctctacctggccccttcctgaagggggcattgtgacatacttctgcacaggtatgtcacagttattacctaggagatgtgactctcctcttttgccagcaccctgcttacagggaaaattgtggcacatttctgtggccagcaaccaggtgatgtgtttctcctgcttgggtctttattacagaaaagatggttgacatatcactaggcccagcatctaggcgatgtgactgtcttcttctgcctggtccctgcttacaggaacattgtagcatattgctatgcccagcacttttctcttcttttaggttttgcctgcaggagactttgtgacattgctgggccctgcac

SEQ ID NO: 23235 - DNA, 1033 bp, Homo sapiens
tctacctgtgccctgctttcaggagggattgtaacatccctggtcaagcccccagtgatgtgattctcctgtttgatgcctgccctcagggaggattgtgacatagccctggcccaacacacagttcatgtaactcttgaatttgctctttacatacaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctcataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaac

SEQ ID NO: 23236 - DNA, 1035 bp, Homo sapiens
gacaacaattggagatattaaactgaccacagaccccacctttttctgctaataagtagtctagtgctagcctgttttgataaattgctgcacgcatttggttttcttgttgcgtgagcatttccaaggctgaggcggtttggttagtgattatctctagaaccccctgtagtctaattattatatttagagtatatatgggagtgcaataaccccatgaactatcctcagtccaagtggcaggactgttaatattcgatgatccgttgcggaggccattcatcctgttgccatctttggcttcctcctgcctttatggatcatggttgtttttgtttgtttgtttgttttaaattattattacatacaggtactccgagagtgttgcccacgttaatgttttggaggaaggagtagccttgggggtgagcttgaccctagtgcgatgaatccagttgaggagtccttggactctcactgcagttggcatgctgcgtatcacagtgtaggggcctgtccacttcagttgtaggtttttgtgaggctcgggttggcagataaacacatctgtgcctgcaagacagttatgttgagaggacaaggaggtgttgacaggaaggggcatggcctcatttgccgcttcacgaatgaaagaccatgtctggattaaggaggggaggtaattcctgaatggctcagaatctgggaagggtagaggccccaagacaaaagtttggctatcgggggaaccagcccccaatatttcaatgtaggttattttctgttttccctaagtgtcggctggtctgagaaataaagggaaagagtataaagagagaaattttacagctgggcctccagggatgccatcacatattggtaggaccatgatggcgaccccaagccacaaaaccaacaagtttttattagggatttcaaaaggggaggggcgtacgaattgggagtgagtcacagaggtcacatgcttcaaagggcaataaaagatcacaaggcaaaagggtagagcaggatcac

SEQ ID NO: 23237 - DNA, 1049 bp, Homo sapiens
tgtttaagttcgaaactatttttagcagaaaaaagcaatattggaacaaaatcattttaaggaggtgtctaatttactacaaaacaaaaattctcaaaaatgctgaaagcaaatttatactctgctttgtattgaatttcttgctgtacaatcttttggcttatggttcagagtctccccatgcaaattctgttttaacttgactggtactcatgctagacccataattttttgttgttgttgtttaataggttttttgtttgcttaattgtttgttgttgttgttgtttgtttgtttttgagacagagtcttaatctttctcccgggctggagtgcaatggtgcaatctgggctcactgcaacctccgcctttcaggttcaagcagttctcctgcctcagcctcctgagtagctgagattacaggcatgcatcaccacgcccggctcatttttgtatttttagtagagacggggtttcaccgttttggtcaggctggtctcaaattcctgacctcgtgatccacccgtctctgcctcccaaagtgctggattacaggcgtgagccgcctcgcctggactaatttttgtatttttagtagagacagggtttcaccatgttggtcaaactggtctccaactcttgacctcaggtgatccactcacctcggcctcccaaagtgctgggattacaggcatgaggtaccaggcccggctggcctgtgtaatagtttatgaagaattcattatgtgagcctgtctgtaattataaaaatacttttttaaaattttattgttccataagttacttatgtacaggtggtatttggttagttgagtaagttctttagtggtgatttgtgagatcctggtgcatccatcacccaagcagtatacactgcaccatatatgctgtattttatcccttcccctttcactcttccccgcaagtacccaaagtccattgtattattcttatgtctttgcatcctcatagcatacctcccacatatcagtgagaacatacgatatttggtttaccattcttaga

SEQ ID NO: 23238 - DNA, 1051 bp, Homo sapiens
ggaagggcagaacctccccaagtctgtagctgggaagagtttgggatggttacagagtacagttcaaaattctcagtggaaccaagttaagtggaatattttcttgtctgtagccaaaaacagtagtcctgtagtttgctgcctgaatgaggcttgccttctaaaaaggattaccttcgatcttgggcttcagcagagtttcataactcccatcctggatctcagagctctcttaaaggcacttatttttgagatggggtcttgcaacataacccaggcaggtcttaatattttgaccggaagcagttctccaactttaatgtgccatgtagctgtcattacaggtgtgaaccatgatgcctggttctctcacaaacgcatttttgtcaggaatggctgccaaattttcttgctgtcaggagataagcaaatagggcatctttttttttttatcttattaatgtcactctccatataaatttttatttttattttctacttcaaatttgtctgtagttttggattcagacatttaggacaatatactagaatgtacatgttgtgtgtgagttaggtaattagtatacaggcaggcaaataggaattacagaattttcagccacttttgtcagcctgtaactaaataataacataatgtattcctcaaatatttgttttatacatgaagctctaaccatattttgctaaatatatacataatttagcaatttaaggctatagttggttctaaacttgaattacagtaattttattttgtgtaaaaatagcacatatttaaaacataaaaattgacactagtttcttttaaatgcttatctattaagtttctcattagcatctcctatttatgattgtactacattttctctgggattttattgccatacaatagataccagtaatttaaagtgcctgccttccatgactgcacagttagtcaaacattgccgttttctagacaaattatttgttaacgtacattaatgttgccaactagattttatgagtaaacatttctttcattattttc

SEQ ID NO: 23239 - DNA, 1038 bp, Homo sapiens
ttgagtatgaggggaacttgtagggtccccggtgtttgcttctgagttttagcctcagaagcacttggcaaggggtcgcttggcaaggatggtcgctactcaccctgagaaccaggtggccctgtaaaaggttatctataatatctacttctgccttagaactttcctttggggggtaggttctgggagtttcacagattgttaggttttgatatagggtcatgaagggctgtacataggagatttctgaccatttgccctgcctcttgcaaaataggcctgattgcaggatagcgtcataattaatgctaccattgactgcccagtgttctgaactgagcagctcataatagggccagacagtattgcagaaaaatattatacattttcttgttagattgtcagggtcaaattgattctaatggtggaagatatagccaagcagggaatcagaattggaaatagagttccccacagtggaatcaggtgaaatagattaagagttgctcatagtggtctagaaaaaagaagaggactttgcaaagtagagggctcattaggtgacccaaatttttcctggggcatctccctggaaaacttcttggcccagactggggtctctgggaacatcccctctttaggccccagacttagtctgtcagatggctctgaccttagataggtgccagcacaactttagaatggttccctccaccactgatgacctactatgaggtgttgttttttttttttaatttttttttgagacagagtcttgctctgttgtccaggctggagtgcagtggcatgatcttggctcactgcaacctctgcctcctggattcaagcgattctcctgcctcagcctcctgagtagctggcattacaggtgcgtgccacaatgcaagactaatttttctgtagttttagttggtcaggcaggtctcgaactcctgaccttatgatctgtccgcctcagcatctcaaagtgctgggattacaggcatgagccaccacgcccggactactatgagcttt

SEQ ID NO: 23240 - DNA, 1040 bp, Homo sapiens
cgcgcccggccgtcttgtgccagttttcaagaaaaaaaatgtttgcaacttgtatctattcagtatgttggctgtgaatttgtcgtagataactcttttgaagtatgtaccttcaatgcctagtttgttgagggttataacatgaaggatgttaaattttactgaaagctttttctgcatctattgagttaattttgtggtttttgtctgtagttctgtttaagtgataaatgacatttattgatttgtatatattgaaccaaccttgtgttccagggataaatcctacttgataatggtggattaactttttgatgtgctgctggatttggtttttcagtattttgttgatgattttttgttaatatttattaaaaatattggcctgaagttttttgtttgtgtgtttgttttgtctttgccaggttttggtatcagaatgatgctgttcttatataataacttggggagaagtcctttctcaattatttggaatagttttagtaaaaataataccaacttttgtttgtacatctggtagaattcagctgtaagtccgtctggtcctgggctttttttggttggtaggctacttattattaatttgattttggagctttttattggtttattcaggggttcaatttcttttttgttcagtctagggaggaggtatttgtccaggaatttattcatttcttctagattatttagttactgtgcatagaagtgctcattgtagactttcatccttgtttgtatttttgccaaatcagtgataatgtccatttgtcattactaattgtgttttttttttttttggatcttctctttttttcattaatctagctagtggtttatttatcttactgagttttttcaaaacatttacttctaattttttagtcttttttgtagttttttacatcatctaaatattcttcagttcagatatgattttagttatttgttgttttcttctaccttaggggttgatttgctctcacttctctcattcttttatttaggatgtcaggtta

SEQ ID NO: 23241 - DNA, 1039 bp, Homo sapiens
atttttaataagattatttaaatatttacatttaatttttgttctctttttttttttttttttgagacggagtctcgctctgtcgcccaggctggagtgcagtggcacgatcttggctcactgcaagctccgcctcccgagttcatgccattctcctgcctcagcctcccaagtagctgggactacaggtgcctgccaccacgcccggctaattttttgtattttttagtagagatggggtttcaccgtgttagccaggatggtctcgatctcctgacttcgtgatccacccgcctcggccttccaaagtgctgggattacaggcatgagccaccacgcctggccagaaatttaaatgtttacattaaaaatttaaataacatttaaaattaaataggaaattattcctgtatttctctttgtcagctttgttgaagatcagatggttttaagtgcgtggcattattttttggctctctattctgttgcatttgtctgagtctgtttttgttccagtaccatgctgctttggttactgtagctttgtaagataaagttgggtaatgtaatgcctccagctttgttatttttgcttagaaaagtgccttggctattagagctcttttttggttccatatgtatttaattttttttttttttaagttaagaatatttttgaggccaggtgtggtggctcatacctgtaatcccagcactttgggaggccgaggtgggtggagcactcgaggtcaggggttcgagaccagcctggccaacatggtgaaaccctgtctctaataaaaatacaaaaaattagcctggtgtggtggcatatgcctgtaatccggctacttgggtggctgaggcagccttgaacccaggatgtggaggttgcagtgatccaagacctcaccacagtactccagcctaggcgacaagaaccaaactccgtcaaaaaaaaaaaaaaagaatatttttgatagtttcatagaaataacatatctgtaaatttcttttggtggtatggccatattaatac

SEQ ID NO: 23242 - DNA, 1037 bp, Homo sapiens
acagagatagtatcagaatatttttgggtcaaggtttccctttggaaactttatgggtgatgtggcctcagccaccttcagttttttctggtcctgggcttcagtagtttctgtgaataaaccaatatatctaccatggctatgtctgctcgagtgtctagtgaatataatctactgggttattttctttcataaaacaacctgaggtatggagtgtagcctctcaatggaaacagatgaatgcccttggactgataggactctcccctgcgctcttcctttgaaaaactaacccttgcgtgcacggtggtgcacacctgtaatcccagcactttgggagtctgaggcggtggatcacctgaggtcaggagttcgcgaccagcctgactaacatggtgaaaccccatctctactaaatacaaaaaaattagctgggcgtggtggtggctgcctgtaatccgagctattttggaggctgagagccgagatcgcaccattggattccagcctgggcaccaagagtgaaactccatctcaaaaaaagaaaaactaagcctttgagacatgaagattgcctttactcaacccagcttccatttcttggagacatattgctggtcagccaatcagatgctggtattgagggaaaaacacagagataatttctgtcccctgaattgtctaagatttgtgaaagaaaaaatagcatttcaaaagacaaaaaaaagtgacctcagtgaaatgatgcaaaaacttgcaaagtaaaatgcacttggggcagtcactgaggcatagtgcagtgagagggtggtcattgagcacttaagtgagcaggatggggtgggagaatctctcaagtgattggtgacctgacttgacacatgaattagacacacctgttttcttttttttttgagatggggtttcactcttgttgcccaggctggagttcaatggtgccatctcggctcatggcaacctccgcctcccaggttcaagcgattctcctgcctcagcctcctgagtagcagggatta

SEQ ID NO: 23243 - DNA, 1003 bp, Homo sapiens
aaaccccatgccacgcagttatttggtaaagcgaatgattaggggtcttggagtcaaaatgatctcaaccaattctcaaactttaaatgggttagaagcccagctcgatggcatggggccaggtatgaaatgcgagtgcctagcgggcaacttttggtaagcagaactgctgctgtgggatgaaccaaatgccatgttagggtgcctgatgctgatgcccattagaccccagaaaatgtgttggttgatatagacagcaggacggtgggcatggaagtcagaatccactaaggagtgtttaacaacaaagaatcaactcgccctgaaaaatggatggtactgaaacattgggcccatacccggccattgccagcagttgagagtggatgggagtggtgagggtggtcgctcccgctggagccccgaggatgctatgctgctatgagtgggaggaccgctgcaatgagccttgaagccttgggcatgagcctgggtggagctgtcccaggtgcagatcttggtggtagtagcaaatattcaaatgagaactttgaaggccgaagtggagaagggttccagttgaagatgggtcactcggtccccagagataggagagtgccattccgaagggatggatgatgacttccattgccctcagccaatggaaacggagtcaagttcagatttctgaatccggagtggcagagatgggcaccatgaggcattcagggaggtaatggaagtgatcctggagaagctggtgggagcccaggggagagttctttttgtgaagagcagggcaccctgtagtggattcacccttagagagaggtctgtgccttggaaagaatcatagatcaggaggcacctggtgagctctcacaggcccttgaaaatctgggggagagggtgtaaatctcacaccaggctgtaaccatatccacagcaggtctccaaggtaaacagcctctggcatgttagaacaatgtaggtaagggaaatc

SEQ ID NO: 23244 - DNA, 1027 bp, Homo sapiens
atttttgagaccattgatgccagtactgaaaaacagaatattttgcaatgaaaactagaaacaaattattggtgaaaatactttctgatgtgtagattcatgtcactgaatggaacctgtgttttgattcatcaggctggaaacacttttattgtacactctataaagggacatttctgagcgcaatgaggcctacaggaaaatccaaatatcctgtgatgaaaagtgggaacaagctatctgcaaaaatactttttgatgtgtgcatttacctcaccaagtcacactgttatttttattcaccagattggaaaccctttttttgtagaattcacgaagggatatttctgagtcctttgaggcctacagtgaaaaactgaatattcctcattaaaaattagaaacaagctaactgtaaaaatgttttgccatgtgcagatccatctcacagtgttgaacctttgttttaattcaacagttagtaaacactttttctgtagaatctgtgaaaaaatatttctgagtctattgaggcctacaatataaaaccgaatatgccatgataaaaactagaaacaagatatctgtgaaaatgttttgtgatgtgtaaatgcatctcaccaaatggaacctgagtttggatttaccaaattagaagtcctcttcttgtagaatctacaaagggacatttctgagttcgttgaggcctattgtgaaaaaccaaatatccccggataaaaactagaaacaagctacgtgtgaaaaccctttctgatttgtagattcatctcacagagttaaaccttcgctttgattcaaggggttaaaaacactctttctctggaaacaacaaagtgacattccttaacccactgaggcctgtagtgagaaactgaatatcacaaaatagaaactaggaagaagctatctgtgaaaatgctttgtgatgtgtaaattcatctcacagcgttaaacctttgttttaattcaacctgttaaaaatactcttattgtcgaaactaggcgg

SEQ ID NO: 23245 - DNA, 1031 bp, Homo sapiens
gagtgcattgagtcatatgttgaaaaatcgaatatctcgtgataaaaactaggcaggaggtatctgtgaaaatgctttgagatgtgtgggtattggcctcacagagttaaacttttgttttgattcaacagtttggaaacatactttgtagaatctacaatgacatatttctgagcccattgaggcctgtagtgaaaaaccgaatatcccatgataaaaactcaaaacaagcgatatgtgaaaatgctttgtgacgtgtggttcatctcatagagttaaacctggttttgatccactacattggaaacactcttattgtagaatctacaaaaaaaaatttctgagaccattgaggtctctagtgaaaaactgaatatcccatgataaaaactagatacaagctatctgtgaaaatgctttgcaatgtgtggatttgtctcacaaagttaaacctgtgtttgattcaacgggttggaaacactttttttgtagaatctatgaagaaacatttctgagaccattgaagcctatagtaaaaaattgaatatcctgtgatataaatgagaaacaagttatctacgaaaatgtatattaatctcactgaatgcaacctgtgttttacttcaccaggttaaagatgctctgttggtaaaatctgtgaagggacatttctgagcacattgaggcctatagtgaaaaaacgaatatcctgctataaaaactagaaacaagctatgtgtgaaaatgctttgcaatgtgtggattcacctcacagatttaaacctttgttttgtttcaacaggttggaaacactctttttgtagttgaacgaagggacatttttgagtcccttgaggcctatagtaatgaacagaatatcctgcaataaaaattagaaagaagttatctgggaaaatgctttgtgttgtgtggacttatctcacagtgtcaaactattgtttccatgcaacactataaatgcacactttttgtagaatctatgaggggacatttctgagcccattgaggcc

SEQ ID NO: 23246 - DNA, 1026 bp, Homo sapiens
tatgaagggaaatttctgagcccatttaggcctatagtgagaaacagaatatcccactgtaataagtagaaacaagctatctgtgaaaatcatttatggtggctggattcatctcaccaaatgaaacctgtgctttgattcaccagtttggaaacactatttttatagaatctatgcaggaatatttctgatcccattgaggcatatgctgaaaattcgaatatcccatgataaaaactacaaacaagctatctatgaaaatgttttgtcatgtgtggattcatctcacagagttaaacctttgttttgattcatctgtttgaaaacacgcttttttgtagaatctaagaatcaacatttctgagtgcattgaagcctatagtgaaaaacaaaatatctgatgataaaaactagaaacaagctatctgtgaaaatgctttgtgatatgtggattcatctcaaagaattaaactttattttgattcaacaggctggaaacactgttttcgtagaacctacaaaaagacattggggagcccactgagtcttacagtgataaaccaaggatcctgtgataaaactagaaacaagctatctgtgaaaatgctttgcagttggtgaatttctttcatagttaaacctttttttattcaatacgttggaaacaccattttttagtgtctctaaagggactttttcagccctttgaaacctatagtgaaaaaccaaatatcttgcaataaaaacaaataaacaaaaaagaactacttatgaaaatgccttgtgatgtgtggattcatctcacagagttaaaccattgttgtgattcaacaggttggaaacatgctttttgtagaatctacgagttgacatttctgagccctctctgggttatggtgaaaacgaaatatcccatgataaaaactagaaacaacctatctgtgaaaatgctttgcaatgtgtggattcatttcacagaattaaaccattgttttgatttaacaggttggaaacactctttttgta

SEQ ID NO: 23247 - DNA, 1599 bp, Homo sapiens
tgtatctgagcccattgaggcctatagtaaaaaatggaatatcttgcaataaaaaactagaaacgagctatctttgaatatgctttctgatgtgtggattcatctcacagagttaaaccttatttttgactcaccaagatggaaatacttttttttgtagaatctatgataagacatttctgagtctattgatgtgtatagtgccaaacagaatatcccacaataaaaactagaaacaagctatctgggaaaatgccttgtgatgttttcattcatcttagagagttaaaccattgttgtaattaaacaggttggaaacactctctttgtagaaactacgaattgacatttctgagccctttgaggcctacagtgaaaaacagaatatccagtgattaaaactaaaaactttctgtctgtgaaaatgctttgtgatgtgtggaagcatctcatagagttaaacctttgttttggttcaacaggttggaaacacttttttagtagaatctatgagaaaatctttgtgaacccaatgaggactctgtgtgtgtgtttgtgtgtggggggggtgggggggcaggaaacaacgaggatttcatgatggaaactggaaagaaccatctgtgaaaatggtttgtgatgtgtggattcacctcacagaattaaacctttggtttgatagaacagattgaaaacactgtttttgtacaatctaaaaagagacatttctgagcccattgaagcctgacgtgaaaaaccaagggtctcacaataaaaacgaattacaagctatctgtgaaaatgcttagcaatgtccggattcatctcactgaatagaccctgtgttttgattcaccaggttggaaactctttctgcagaatctgcaaagaaatatttctgagcccattgaggcctacagtggaaaactgaatattctgtgataaaactagaaacaccctatctgtgaaaatgctttgtgatgtgtggatttttctcatcgaatggaacctctgttttgactcacaagggtgaaacactattttagtagaatctaggaagaaacatatctgagcccatttatgcctacagtgagaaactgaataccctgcaataaaaagtagacagaagctatttgtaaaaatgctttgtgatgtgtggattcagtgttaaacttttattttgattccacagttttgacaccctatttgtagaatatatgaatgaacatttctcagcccattgaggcctatcatgtgaaaccaaatattttataataaaaactggaaacaagtgatctgttaaaatgttttttagtgtgtgaatttgtttcacaaagataaatctttgcatggattcaacaggttggaaacattattgtagaacctatgaagggatgtttttagcctattaaggactatatatataaaaaaaactagaaacaagctgtctgtgaaaatgctttgtgatgtgtggattcatctcacagagttccacctttgtttttattcaacaggttaaaaacgctctttttgtagaacctacaaaaagacatttctgagcccattgaggcctacagtgaaaaaccaagaatcccataa

SEQ ID NO: 23248 - DNA, 1162 bp, Homo sapiens
gggtgatcccaggcattctaatgggagagacccctggccgaccccagtcagtctaattaaatagacacctgggtgaccccaggcattaaaataagagagactcctacccaatctcagacattctaatgggggagacttctggcagtttattgatagagacacctgggcgacctcaggcattctaataagagagattcctggccgaccccagacggtctatgcatagggacacctgggcgattccaggcattataatgggagagtcttacggttgaccccaggcagtctatggatagagacaactgggcgattgcaggcattctaatgcaagagactctctgccaacccgaggcattctaatgatagagaaacctgggagaccccaggcattgtaattatttaggcaccagtgagaccccaggcattctaatgggagagaattttggttgacatcagacattctaatgagagactcctgtctgatgccaggcagtctaacaatagagacacgtgggcaacccaggtattctaatgggagagacttccagtcatccctagacagtctaatgatagagaaactgggagacccagacattttaatgggagagactcctggccaacccaagcagtctatggatagagacttgggtgacaacaggcattctaatgagagagatttctggcccaccccaggcattctaatgatagagacaagtgggcaaccccaagcatttcaatgatagagacacctgggcaaccacaggtattctaatgttacagactcagggctaacctcagacattctaatggagagattcctggctaagcacaggcagtctaatgatagacatacctggactaccacaggcattttaataggagagactcctggccgactaaacgcagtctaattaaagtgacaaatgggcaactcctggcattctaatgggagagactcctggccaactgcatgcagttttattaaaaagacacctgggcgaccccaggcattcaaataagagagaatcctagctgacccaaggcattctaatgggagacactcctggctgacccaagcagtctgttgatagagacacctgggtgactggaggcattctaatgggagagattcctggctgacctcacacagtctaattataga

SEQ ID NO: 23249 - DNA, 1050 bp, Homo sapiens
atatgagtaaacaagctatttagataaactactctacattcctatgttagttacccttgctatagttcaaagaggattaggccatcttcagcaaagctatctgaagctatgcaaacccccctggccttccaagaaggtttatgttttataattttcccacctatcctgactgaaaccctgcatctcccccttttctgttttctgcattaggtctttttgattggagaatgcagatgtatgcagcaacaggtttgtaaggcatggcagccattgcttttattccggctttgcatcctagaattagcaaatcacataatgtaatcatgattataattagcaacattattttccagtcaaagagtgacccatagtgttacttggcatctcagttcactctatgccatcaatgaggaaccccaccgggagaatgttaatttcttttagccaagcagtctcactgttagaagctctgaagggggtgtttgttaagtaacagggcataaaaaagggtggatttcagagatgagcttaatagagtgtagcaagtactggttgcaggcagagtgagagaattaaaaaggaataaattatttggcttagccttatgcctcttcagcataatgtctggggcctgcatcatccatggaagctgcatcgtctggggctgcaggtcctgtagggtcttttttagactggctcgggttttttcttctttccatcatttgatgaggacgtagtctccaggctcgtgctagtgtactggaaattctaggggtggtgcctgtgctaagagaccttttataatctttgttaaagagcaggttagtgctttaagaaaaacctgttgtgctttattttgaagtctggtttacaaaaaaactggacgataccttttttaactttagccaatatgtttctgtctgatctcagaagctaagccaggcaattttctccatttctggtactgggttgtgtcctagccacaccatggtatggtttaatgcattgtgctggaatccaaagaggacctgagggtgtggaaaaacaagc

SEQ ID NO: 23250 - DNA, 1051 bp, Homo sapiens
attagatcctatttgtcaattttggcttttgttgccattgcttttggtgttttagacatgaagtccttgcccatgcctatgtcctgaatggtaatgcctaggttttcttctagggtttttatagttttaggtctagcagagccctcagaaataacaccacatatctacaattatctgatctttgataaacctgagaaaaacaagcaatggggaaaggattccctatttaataaatggtgctgggaaaactggctagccatacgtagaaagctgaaactcgatcccttccttacaccttatacaaaaattaattcaagatggtgagatcatctttctaatatgctgctgaattttatttgctggaattttgttgagttttgcatctgtgttcataagggataattaatctgtagttttctgtagtgtctttttctggctttgatatacggtaatgctgagattgtggaatgagtttggaactgatctctccttttcaattttttggaagagtttgaaaaagattttcagtctttcaaaatgtttggtagaattaactactgaagccatcaggtcaagggcttttctttgtcagcaggtttttgatttttgatttgatttccttataagttatggatcaattcaatttttctattcttggtaatcaagtcttgctaggttttttatacctagaaatttgtccatttcatctagattgttcattttgttgtcacacagttgttcacagtacactctttaaaacattttatttcttagaatcaggcaggcagatcatgagatcaggaaattgagaccattctggccaatatggtgaaaccctgtctctactaaaaatacaaaaatcagctgggcatggtggtgcatgcttctaatcccagctacttgagaggctgaggcaggagaatcgcttgaacctgggaggcggaggttgcagtgagctgagatcgggccactgcactccggcctggtgacagagcgagactctgtcaaaaaaaaaaaaaaaaaaagaagaattagtagtaatgtccccatc

SEQ ID NO: 23251 - DNA, 1190 bp, Homo sapiens
ccacctcctgggttcaagcgattcttatgcctcagcctcccaagtatctgggactacaggcatgcgccaccacgcccagctgatttttgtatttttagtagagacggggtttcaccatgttgaccaggatggtctcaatctcttgacctcgttatccggctgcctcctcctcccaaagtgctgggattacaggcgtgagccaccatgcctggccacatctacttttttaaatgtgtcattatatttgtgatattgtcatgatgttttctacttatattttattcaaaaattttatactttaagttcttacctttaggtctttgatgcatttttatttgtttatggtgtagggtaaatgttcaacttcatccttttgcttgtggatatccattttttcccagcaccaattgttataaagacagtcctttgcccattgaacggtctttgtatccccatcaaaaattatttgaccatatgctgctttatactgttccagtgtccatatgtgtgtctctttgccagtaccacactattttggaactttgtattaagctttggaatgaataagtgtacattttgtaacactggacttctttttcaagataattttgactcattggggtcccttgagattccatatgaaatttaggtaggatttttctatttctgcaaaatagaattttttgctttttttgttactcccgacgtattttattcttttcagtgctattgtaaatgtgcttgtttgcttagttttgttttctaattattcatcattactgtatagaaacacaagtgatatttgcatgttaattttgtatgctgctactatgctgaatttattagttgtaatactttttgtgtggatctgtgaaatctctagagctttccacataaaattatattatctgtaggctagagtaattttacctctacatttccaatttggatagtttgtttctttttaattcttaatttgactagaacttccaacactatgtggaatagaaatagcaaaagcagacacctttgccttgttcctgagcttagagcagaagctttttgtctttcaccctggagtacattgtttgatgtggttttttaatgtgtggatttcacaatggtagtattttagttttaaaattcctacttttttgagtgttttcaccctgaaaagattttgaatttca

SEQ ID NO: 23252 - DNA, 1073 bp, Homo sapiens
gtggatggatttctgcaaaaggggaccaagtacttggtggtttattgtagaaggaacctcctctgaaaaaacctcacagggaaattctcaacttaaatggtagctaacagaggcgccaggtgcttaaggtgtgcattggtgaggtaggcactattctgatgaatggttgatggtgagaaaactgagactcgggagttcatgtaaaatccccatagctacatgtctcgggggcggaactgagatttaacttatggcagcctgactctagaaactgagatttacccaacatgtgtgttgcctccctttctagaaaaggagttccacccaaagggaataagtcacatctacttttctaacagaaatcccagtgtcaaaatagctatgctggtgttcccaatccgcttttcaaaagaggaacagccaccattaacctttctggtcagtgaatgaaagataaggaagtgagtgaaagcaaagtgttagcaaggcccgactgtgagccggacactgttacacactaaatgcatcatctcattcaaaggagagaacatcttcattaacaaatgtgacaccgtcttcattaacaaatgtgacacccttgcctgctgagcaccccctcccgccctgacccccagctcctcagtcagattctgtctgccacactccagtgaaactgctcatgtcaaagtcaccaggggcttccacgttgctgcttccagtgaaccatttaggacttcatcttgtttgatctctcatcagcatggcacagttgtccatgttttccttctgaaaagtgctgctcttttgacctttttttttcctctctttttttgagatggagtctcactctgtcgcccaggctggagtgcaatggtgcaaacttggctcgctgcaacctccgcctcccaggttcaagtgattctcccacctcagcctcacgagtagctgggattataggcacctgccaccacacctggctaatttttgtatttttagtagagatggggtttcatcatgttggcgaggctggtctcaaactcctgacttcaggtgatctgcccgccttgcctccc

SEQ ID NO: 23253 - DNA, 1066 bp, Homo sapiens
tttctctgtacatcatagtttatcatttgactattaatgtgcagtagtacagacttttttggtaggagtctcctcacctacaaaggttcattggaacaggagctagatcttacgtatctttcactctcccacacacccagtagaatgccttctacagagcactgtccagatatgccactggggaatgctcagacattctcataagaattttaagagacttagacattaaggaacgcttctgaagtagactctaagcatataggcaaagctgtattactcccattttttacatgagaaaatattcacagatgagttttcacatgttcaagatcatatgactagtaggtgggagaggtcaggaaaaaaaaattcacccaactctaaatattcagagttctgggctttctgcaaatatggccaccaggcaataatgtaacaactgtgaggaaactagatcaaggattaccaagcaacatttcttaacttgaccacagatttttaggaaggggattgggaggacagagagaattttagaggactttaggaaacacttcactctgccatttaagcagaggtcttcccttggagagttgtctggccacagtatggtatgtgtagtgaagcagtaagagagagagcggagagttagtttgagattgggctacagagagtgttgaatacgatgcaaaatacattgaacacaaggcaatgacgttgaaagtattctaaagagactttattgggtgcacagtgacttggcagggcgagaagaagaggtaaagtcttaattaggaggcgtcactgtggtctacgggtgagtcagaaaggacccaagctcgagaacacagccgcagtgaggccacaggccagcaattgtgctggagagtctaaggcatcaagtcaatcatcattttctaagaaatgtttcacttttaatctcaaaagtcactcaggccttgtcatatctatgttactacactggtgtttttgtttttgtgtgtgtgtgtttttttcttcgggtgtggctttttaaaaattaccatttaatttcttaagaagtagtccc

SEQ ID NO: 23254 - DNA, 1048 bp, Homo sapiens
ggagatgggatttgtacgagtgacggtggaaccccgctcttgacagtttgggaggactcgacacactttgcccatctcctcaccccactcccaggatcatcttctgggctttccaatttgggggttggtgtgaggatttacaagccaaggtaggccgcaggttctctcgcttgtttgacaccttgggcgtttagccaggaaaggactgctcatatacgtgggggtccatgaattaattttacctctagagaaacatcagaattgggcagtagggctccaggcacgaatgcaaacctcacgtggcacaataacaaccccatgaaccaggcagcatggcggatatggtttgttacggtctccccctacttggaaattcagggccattttgtcctgaggttaccaaacctttgcctggctaaagattgggccactgtccggaagaacctttcaccccagcccagaatggccctggtttccctgagataagacaggaagttgtaaagtcgcactccgcgtctgtcgtagtgctcatgttctgcggttgctgttgcgagagagtgaatggaggaaggcattggtcgcccaagtcaggcctttaaatgggtgcagggaggaggggggatgttgccaagggagggaggttttaatcacaggtgcgcgggtgaccctgacctcaccccgcccaagccccggcttgctgcagtcctactgtatatcttccgaccatcacatgtacgcagtatcttaaaataacatttgtgataaatgtgcaatttaactaatttatggtgctatgatgtgctcagggctacatgcaagatgaaaatcttaaatggagcttgaacagctcacttcacaacaagaaatcaatatgccacatcttagcaattcgctgcagtcaacatttagcaaaaatatcagtgatgtatctttaagttttaggcagcaagaattctataattaaccaaaatccttacatgtaagttagagagggttggttatgatgaggacccaatctccctggcatctctattctattttcattctg

SEQ ID NO: 23255 - DNA, 1160 bp, Homo sapiens
ttctgagagtcctcaactgtgaaaggcaaattgtaagagtgagcacttcggactgggcgccgtgactcaagcctgtaatcccaacactttgggaggccgaggcaggcagatcacgaggtcagaagttcgagaccagcttgaccaacatggtgaaaccccgtctctactaaaaatacaaaaattagctgggcgtggtggtgcgcgcctgtaatcccagctactcaggaggctgaggcaaaacaatcacttgaacccgggaggcggaggttgcagtgagccaagatggcactattgcactccaggctggatgacagagcaagactccatctcaaaaaaaaaaaatgaaaataaaaaaaagagtgaggacttcatgaagtccttgtggagggtgtgtgggttagtgctgggaaggccctggaatagcacttggccctagtcaggatccatgtcaccaaatggtagctagcatttattttgaataaaataaaatctttgcaaaaaaatccgtctttctgagacccatgtgcttctgctggcaccagccgatggctcatcccatgacagtgcagccagcgggtgccatctttttgccagtgccctttgtcacttgtgggctttggggttttagaaatctggcctgtgaggccttgacaccttgctgggaagaaatgccaacagaggagagaggaagatggggcggggtcggggcatgagagcctgtaccagcacccaccagactcctgagtgattctgtgcctcatgcttgagtgattccgtccactcagccaccccaccgagatggtcaggtgccagatgggccctgtgcaggccccgtgcaggtcaagtggtccatgccatcatgagctgagccctccaccttggtgactgtgggtgcctatgtggaccaagtgcgtctccggtgagccaggtctatgccatctcagaggctgccgtctctgtcctgtgttgcagcacgaccaatgtcgcagtgcagacccgggcgtattccttagcgtagtggagaaaggtccctttacaacactcaggcctgcgggtcagcagctccaccatcttcagtctcttcccagagagatggggggcgatttgccggagtgaaggcttggctgttaggaatctgatgttgtcaaccccacccatta

SEQ ID NO: 23256 - DNA, 1048 bp, Homo sapiens
atgttttctttctttggcttacctctaatgcattatgtatcctggaatgatacgaagttctgtaattaattctgttagatgtaattgctataatcactttgatgttacacataataaaggtaatatggtaagtacataaaaaatgtaaacaccttattgtaatactcctgctaaaatgccttctcatcaagtctggtttatagacaagtgttcctatttttggtcataggtgacagtttattcgagctgtgttcattgatattctaaaggagaggcatttattggaaaagatgggccttggtttggagggatctccaagctggttgcctaggaatcttaatgcccgttttcttaaagatgtggctaattatgaaaaggtgaccattgtcttctgagtagaccagagaggtaaacacttcagaagtagccgtggaaccagggaagaatgtggcctaggagtgagtgaggagccaggagaatgctagcagaggattcggatcaaaggagctgttctgtaggttttcttatggtgtgggactgtgggaagtgctgtgtgtgtgtgtgtgtgtgtgtgtgtgtgtgtgtgtgtgtcagagagagagagagagagagtgagtgcatgctagcaggtgaacagagaaggccacctttctataacagtgcaataagggaaataacatgcaggatatctactttattattttcctacacctttcatgggggtgggggctacagatggtgcctcactgttgcatgacatgtccgggagtggctgatgttgcctgttggactgaaacctgtgtggtatttgagacacactcccaccccatcaggcctctgtgcacctaccctggatccagaccaccacaggacatcagggaagtttgcctgagaccccaagtgcgcaatacttgtgggatgcttctgaaacacatgtacattatgtacattactctttgccaatgcatcttgcaagaggctagaatgtggtggggtaggaaacttgccatttaattttaccttcctggagatcctagagtcaaactag

SEQ ID NO: 23257 - DNA, 1096 bp, Homo sapiens
atctataattccagcactgtgagaggctgaggtgggaggattttttgagcccaggagtttgagtcctgcctgggcaacagagtgagaccctgtctctacaggaaaaaaaaaaaattaaaaaaaaaaaccatccaggcatggtggtgcatgcttgtagtcccagctgctcgggaggctgaggtgggaggatcgcttaagcccaggagttcaaggctgcagtgagctattattgcatcactgcactgcaacctgaataacagagagagatcctgtctcaaaaaagaaaaagaaaaaaaaaatgaatgagaatgaggtgtcctgatcagatactgtgacacttctgagttctgtctgttactgcacatttgcttggtgaggaggtcgaggagagcacggaccttgtcgaggcttggtacatccatgagcgatgccatttccccatctctttgcagtgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaaggtagctcttcccatctctgaggggcaagatgacttcgaaagaagatcgatgtccgtagcttaggtcttggcctactagacaaattgtgcattattgcctgagggcagaacttggcttgcaccctttctgccgcatgtgggacgtcatcattaatgggttttactgatatattatttttggtttgagtgggcgtttttctcagggttgttccaggaactcctgcaggcagagtttgttctggctgccgagtgctattgatttattggcaaatggagtgggtagaaacgaggctccgcaggggcagggactggggagggagcaggatgtgttggaactcttttttcccggtgcttcaccttcaatgcctagagtctttattgagactcggccagttctggacatcgagtgtggtttctttcatacataatttgttaatgagctcacct

SEQ ID NO: 23258 - DNA, 1033 bp, Homo sapiens
tagccgggtgtggtggcggacgcctgtagtcccagctacttgggagactgaggcaggagaatcgtgtgaatccgggaggcggaacttgcagtgagccgagatcacgccactgcactccagcctgggcaacagagcgagatctgtctcaaaaaaaaagaagttcctgcttcccagaggccacatgaaggccctccagccacggcccttccttgaatgggatggtgtgagtccttcatgctgcagctggagggggggccatctctgacttcaagcattaaatacccgaggactggctctttagatcccattgcctgtggcccactttggcctctaggatcttctttctttgtctgccaactgcagtggtgaggccacttgggagccttgaggtcatttcttctagcctaacatctaagggcctccctttattttaattttttattaaaatttcagattattatgtttaatttcaaacaaagaataatacaatggaccaggcacagtggctcatgactgtcatcccagcactttgggaggccaaggtggaaggatcgcttgaggccagggattcaagaccagcttggacaaaatagtgagatctcatctctacttaaaaaaaaaatgctggtcatggttgtgtgcacctgttgtcccagttacttacgaggctgaggcaggaggatggcttgagcccagaggttgagggtgcagtgagctatgattgcgccactgcactccagcctcggtgagagagcaagacactgtctccaaaaaaaaaaaataaataaaagcgtaaagaaaagaatagaaggaaaccatcatccatgtgaagtgttcttttttttttttttttttttaaagacagagtcttgctctgcagcccaggctggagtagtgcaatcatgtgatctcaactcactgcaacctctgcctcctgggctgaagcacaacctcccgagtagctgggattacaggcacatgccaccatacctggctaatttttgtgtttttagtagagacagagtttcaccat

SEQ ID NO: 23259 - DNA, 1034 bp, Homo sapiens
cattgcttccttttagattccagagtgtttctgtaaccattcagcacctgaatcacagtatttcatcttgtaaatcaattgcaggcgtcagcttcagactcaagcaaaactggttttagaggaaaacaagttgttgctggagcagttggagattcagcaaaggaaagccaaggacagccaccaggagcgcctccaagaaggtgaggtccttccagtgaggactggtcatgcattgatgtcactattgtcattttacccttctatctctctcctgccgggggccccagttgaaaatgagagaagtcatgttttgcatttttgactggaatgtggctgtttataacctttccacgtcactaccctcaatgcatagattgctttttcagactccacagtgtctctcatcatcccatgggtttgtaaatcactcgtaggtaatagtgctagactcagcagaactggttttggggtaaaatagtaccttagaaatgggaatgatcacgtgaggtaaacatctgaaataacacagggtctcttcccagatgtttgttggatgcgtaagcagaaccattcactttctaaacagttcccctgtgtccttccttccttcagagctgcgggcctgggaggcgacatcactgcaggttagatttccatcaaacaccttccgagagtgtccctcttcccatctcttcccatgcattcccccaacccctaggagcctcatagtctgtgacagtgcacaactgtaagggggccaggttaagagtcatcgcttctgctttaaaaccgtaattcatgagtacaaaagatagtggcattttttccctttgctttactgatttttctttcttagtgaagaatggcataggctgggaagctgaaacacaagccatcttgcatgaggctgtggcaccctgagaagcagatggaggttttccctctccagctgcttttggaatggcagccccttccacagcatggcaggtccatgaacagcccctgctgttgctgcagttgcagggctagcactt

SEQ ID NO: 23260 - DNA, 1042 bp, Homo sapiens
gtggctctcacctgtaatccagcactttgggaggctgaggcaggcggatcatttgaggtcaggagttcaagattagcctggccaacatggtgaaaacccatctctactaaaaatacaaaaattagcgggcgtggtggtgggcacctgtaatcccagctacacgggaggttgaggtgggataatcgcttaaacccgagaggcagaggttgcagtgagccaagattgtgccactgcactccagcctgggcgacaaagctagactctgcctcaaaaaaacataattttttttttttggtagagatggggtctgggtatgctgcccaggctggtcttaaaccttggctcaagcaatcctctcaccttggcctccagagtgttgggattacaggtgtgagccactgcatctggcttgagtttttatttaaagccccaaacattaatgagtccctgctgtgtgctgatacccacaactgacagcttatggccacacggtctgtaggatagacaagcccataaataattctgtacacaatggtaaaacaagaactgctgttgatgtgtgtaccagaagggcagtgacgtcagcctggagagttggcctgggcctggcagggagtaaggaaagaattctgggtgcagaagacagcaaataccaaggcctaaaaaagaatgaattatttgctgtttgggaaatggaagcccacgctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagccgcg

SEQ ID NO: 23261 - DNA, 1053 bp, Homo sapiens
gttctgatttttttagttactaacatttcacaaagcagaacttaaaaagctgtcaagttatcttagtattttctaagacagatggtatctttgtgcttattttttgtttttgtctttttttcaagacagggtctcgctttgtcacccaggcaggaggacagtggcgcaattgtggctcatggcagcctcaaccttccgggctcaagcaatcctcccacctcaccctcctgagtagctgggactacaggcatgagccaccatgcctggctaatttttttgatttttttgtagagatggggtcttgccatgttgcccaggctgatctcgaaatcctggactcaagcaatcctcccacctcagcctcccaaagtgctgggactacaggtgtgagccactgtgcctggcctgtgtctattttttgaatgggcaatttgtaccttttgatccccagcccctgcttccctcactagatgcagctgctgccatcattttcttgtatccttccattgttgggcctttcatatacaaacacagcctgttctgcctcatgcatgttgagttttcaactttaaattttttttttttttttttgagatggagtctcactctgtcatccaggctggagtgcagtggtgcaatctcggcccattgcaacctccacctcctgggttcaagcgattctcgtgcctcagtctcctgagtagttgggattacaggtgtgtgccaccacacccagctaatttttgtatttttagtagagacagggcttcaccatgtcggccaggatggtctggatctcctgaccttgtgattcaccccccttggcctcccaaagtgctgggattacaggtgtgagccactatgcccggccgttgagttttcaactttaagtgggaacttcagacttcatactttctgtgtgcagaagacatatgcagtgattataaacaaactgtacatctgccaaaaaaaaaggccggggggagggaggaacaaaggaaaggaggaaggaactgttgcgcagttatttatttacattggaaacagccctcg

SEQ ID NO: 23262 - DNA, 1050 bp, Homo sapiens
ttaagacagggtcttactctgtcacccaggcccgagtgcagtggcatgccctcagctcactacaacctccgcttcgcaggctccagtgattctcctgccttggccccccgaatagctgggactacaggcatgcgccaccataccccactaatattttgtatttttagtagagatggggtttgggcacgttgcccaggctggtctcaaactcctgagctcaggcaatgtgcccatctcagcctcccaaattgctggcattacaggcatgagccaccgtgcccagccaagattttcaattagagaaatggaaagagatatcttccttaaacatgtgcctacaagatggctattatcatttctgaccatagaaaagatgtcaaaatgggccgggcacagtggctcatgcctgtaatcctagcacattgggaggccaacgcggtcgaatcacttaaggccaggagtttgagaccagcctgggcaacatgggaaaaccccgcctccgctaaaaatacaaaaaattagccaggcatgatcgcgggcaccttgtaatcccagctactcgggaggctaaggcgggaggatcgcctaagcccgggaggttcaggctgcagtgagctgagatcatgccactgcactccagcctgggcgatacagcaagaccctgtctctttaaaacataaataaatgggctgggcgcagtggctcacgcctgtaatcccagcactttgggaggccaaggtgggtggatcacctgaggtcgagagttcaagaccagcctgaccaacatggagaaaccccgtctgtactaaaaatacaaaattagccaggcgtggtggtgcatgcctgtaatcccagctactcgggaggctgaggcaggaaaatcacttgaacccgggaggcggaggttgcggtgagccaagattgtgcaattgcactccagcctgggcaacaagagagaaactccatctcaaaaataaaataaaataaaataaataaataatgcacattttagatagatatagcctataccgtgaatttatagtgcaaagg

SEQ ID NO: 23263 - DNA, 1050 bp, Homo sapiens
ctcgccgtctctcgggtgtcaaactgaccgtgtccttggggtaaactcctgcaaatggaattgctggaaaaatgttgatgcccaaagcccagtgccatctagaaaagttgttctcccttcacggctggggctgggttagtgtctggtgagcagataccatgtccttcccggggatgttctcatttaatcccgtgagggggagcggagaggagtgtggcatcctctctgcattatagagaccccacagtagacagatgggtcttagaggagccaggtggcctctctccagaagccatgttctcagccagcgtgcaggacacccctcctcccaaaccatgagtgccggtgtgcccacccaggcctcaagattaattgtgttatttccattattcacctttatcattctgattagggaaaagtaataccccgtctttatttttgctgatttgattactgacgagcttaaacttctcttgtaagtatttcttgggcatttatctttgtgggttttcagtcctttgcccatttgcaatcgggacatttgtgggtgacttattgctctgtaattgggctctttgtactattgttctgtgtgttggaaatatttttcccaatttgatgtacagaaattgtaaatatcagttgtcatgttggtcctttcctgtatagtttatgcctttgcgaaattgctttttctactacctcaatataatccagttatcagcatgttttttctatctttatagtctgatgactttcttttaaataacagtttttgcataattatgaaatatttcaaacactgctgtgtatagtttaatagatatctgtgtatccacatggtttcgtcttttatatttaatacgttaattgagctaaactgcatttaagaataatatataaacaaggattctggcttttctgcccccgcgtaattactaagtgacctgttgtctttggagtaatgtctttgccccccattgtaaaattccatttttgctgtattctaaattcccaggtgtattagtcagtatagggtagcctttgggg

SEQ ID NO: 23264 - DNA, 1050 bp, Homo sapiens
atgctaagactgatcactgggttacattttcccccttgacctggagagtaatctacctggtgttactttggtaccatgtgaataaatgcagccttcatacatatatctgttttgttttgttgttcctagagttttaatttgcctttcgtctttcttattgagagaagaaacatatcttcttcaccatatcactaagagctttaagcttcctattgattttatctgcagaaaggaatccatgccattctttttgtggatgtttttctcagagccacatacttggagttctaatttctactgattgctttctaggcttgctgtccagtgtctaattatacttttggattgactccagtttttaaaaatatcccattatatcacctccttctctttattggcttgtgctttctccctctccccacccttctacccttctctctctgctggagtacatccttaagtacttccccaatttctgagtttttgaatgtctaaaaaggactagtttccttctgtatttggttagtagtttgtctgggtgtagggttctataatttttgcatggagtgcaacaaaaagggggtgagtgtaacagagtgggtcatgcgctctttgacattgtctcagttaagtctcagtgtcgctatctgtaaaatgggaaggtagtacctgttctaggttgggttccatgggaagctgagtctgtgagccaagtaggcaggaagcgtattgaggagtgctctcaggatcagcgtgtgtgtcagagtaagggagcaggcttgggctgcgatgctgtcacaagggcatctcagctgctcccatggggagttttggtgctggagtggcccccagagatgtccccagctgaagcgagggagctgagtcttggctccctccatcgaatcaaggagaccagtagaggggtgtggcctcaggggatgagttgggcagtgcacccagcatccactgcaacttacaggacccaccatgcggcgggtccccagtaaatggcaatttaaagtgaagggaagctgcgtttgcctgctgaga

SEQ ID NO: 23265 - DNA, 1050 bp, Homo sapiens
gtccctggctaggtttcaggcacactcagctcgcagctgagctaaaccatcattttcttcatggctttggtttcttggagaggacttattgattgattccccagaggatatgtaattccaaccagctcttttctttctgtccttccccttgtgggattttatcctttgcatcactgggtcatggagtgtgggagggatagttgttgcgggttcagtggtgttgaattcccgcccacctggctccaatagaatcattccctgcacatccatctccaggagagatggaattcctggccctttaaatgagttttgttcaacacggtgccactttgatgcttagaggctgattttggaaatccttcatccttgtctcactactattttaatcagtggagtgtttagatctcagttaattgatatcttaattcagggtttaatgctcagaggcagtgctgtgacttgtgaatgtttaaggaaaaaaataaggttgcacaagtacatctttgcctcatctactttttgtgatttttggtctgtagcaggagagtaggcctacatggggtaggagactttgcctcccagcctccctgtctgtttgagcagcctccaggcatgttgatgcccacagcgtggccatgagctggggactctctgtgaggctgtgcagtgcccacatttcctggcacgttttttcctggccaaagagcctgagctgacttctgccccaagttctctttttagagacagggtcttatgctcttgcccaggctggaatgcagtgttgtaatcatggctcactacaacctcggactcccaggctcaggtcatcctcccgcctcagcctcccgagtagctgagactacaggtgcacactcccatgcctagctgatttttttttttttttttgagatggagttttgttcttgttgcccaggctggagtgcaatggctcaatcttggctcactgcaacttccgcctcccaggttcaagcgactcttctgcctcagcctcccgagtagctgggattacaggcatgtgccaccatgccc

SEQ ID NO: 23266 - DNA, 1031 bp, Homo sapiens
tgagccatggatattttttgatttctcatttaattctactgtgattaatgaatgttctctgcatctcagccctttaaaatatgttgaaacttccagcacgtgaccattatgataaatgttcacatacacttaaagaaagcatgtattctgcagttatgggccatagtgttctgtatatgtcaattacgtcaagttggttaatttcttgtttatatcttctatatctttcctgatttccctgcttgcttattctgtcactactactttgttttatggctgaaaaatatttttttctatggatacgtaccacatttcgtttgtccattcatcagttggtggacacctgggttgcttccaacttttggctgttctgagtaatgctgctatgagcatagatgtcagacttcttgtgtgaacatatgctttcagttcccttgggtatatacctagaagtggaattgcagggtcgtctggatgcctttcatgtcttttcttgcctgtttgccttggctagaacctccagtacagagttgaatagaattggagacagcagacatgcttgcattgttcctcatcttaggggaaagcttttagtcttttaccattcagtatgctatgatgttagttgagggagttttttgtagatgctctttatcaagttgaagaagttcccttccctccctagttcattgagtatttattatgaaaaggtgtttgattttatcagtttatttttctccatctatttatacaagcatatggttttattatgtgttctattaatatgattgatgtgttacattgatttctttttgtatgttgaaggaatcttgtattcctgggaaaaaatcccacttggtcatgatgtatatatatcctttttatatgttgctggattctgtttgctagtgttttgttgaaaaatttttgtctctattcgcaaggaatttgggtgtgtaattttgttttcttaaggtgtctttgtctagcttagcatcaaggtaatactgaccttgtagagtggttgaaaa

SEQ ID NO: 23267 - DNA, 1050 bp, Homo sapiens
tgaacctggaaggtggaggttgcggtgagccaagatcacaccattgcactccagcctggcagcctgggcaacaagagcaaaactccgtctcaaaaaataaatgaataaataaaattttaagatcgtaggtagaatttgtcaatgagaaaattattgaaagaagccagactcaaaaagttacatcttacatgatttcattgataagcagttctggaaaaggcaaagccaccggaatgaagaacaagctggtggccactcaggattaagggcaaggagaccatctgactacaaaagcacagcacaaggagtatctgaagttaggaagcaacatctctactgtagtggaagtgcctatgactccagccatccatacaaaacctacataagacagagttctcaaaactcatggaaatccacatcaaaaagattgagtttgctgcatgtaaattttttaacatttaagactcaaaaagctatgaagtattgatacacacaagaccaatgaagccaaaagattataagatctgtgaaggaactcagaccaaaaatagtgcatgttgtatgattccatgtacatgaagtgctagaaaatgcaaactaatctatactgacagaaagcacatcagtggttgcctagaaagaaggaaggggacaaagaggcaggagacaggcacttaaagaggtacaaggaaactttcataagagatgaatctgttcatattttgattgtggtggtaattttctggtttttcacaactgtcaaaagttacaagttgtacattttagatatacatgcttcttatatgtcatttatacttcattaaagctgttataataaaaataaaaatatacaagatataaaaatacaattaggaacaacttaatagaataaggcatgtaataatggaggaatatgcactttttaactgcatggggatcatttaaaaaattgaccatgtattagagtataaagtagatctcaacaaatttcaaaggattttaaaatagaggatataatttgatctcaatgcaattttcataaaaatcaat

SEQ ID NO: 23268 - DNA, 1775 bp, Homo sapiens
gtgtttgctcttgcttctccagttcttttaattgtgatgttagggtgtcaattttgatctttcctgctttctcttgtgggcatttagtgctataaatttccctctacacactgcattgaatgtgtcccagagattctggtatgttgtgtctttgttctcgttggtttcaaagaacatctttatttctgccttcattttgttatgtacccagtagtcattcaggaggaagttgttcagtttccatgtagttgagcggttttaagtgaggatcttgatcctgagttctagtttgattgcactgtggtctgagagacagtttgttataatttctgttcttttacatttgcagaggagtgctttacttccaattatgtggtcaattttggaagaagtgcgatgtggtgctgagaagaatgtatattctgttgatttggggtggagagttctgtagatgtctattaggtccacttggtgcagagcggagttgaattcctggatatccttgttaactttctgtctcgttgatctgtctaatgttgacagtgggatgtttgttaaagtctcccattattattgtatgggagtccaagtctctttgtaggtgtctaaggacttgctttatgaatctgggtgctcctgtattaggtgcatatatatttaggatagttagctcttcttgttgaattgatccctttaccattatgtaatggccttctttgtctcttttgatctttgttggtttaaagtctgttttatccgagactaggattgcaacccctgcttttttgttttgttttgttttccatttgcttggcggatcttcctccatccctttattttgagactatgtgtgtctctgcacatgagatgggtctcctgaatacagcacaatgatgggtcttgactctttatccaatttgccagtctgtgtcttttaactggagcatttagcccatttacatttaaggttaatattgttatgtgtgaatttgaccctgtcattatgatgttagctggttattttgatcattagttgatgcagtttcttcctatcattgatggtctttacaatttggcgtgtttttgcagtggctggtaccagttgttcctttccatgtttagtgcttccttcaggagctcttgtagggcaggcctggtggtgacaaaatctctcagcatttgcttgtctgtaaaggattttatttctccttcacgtatgaaggttagtttggctggatgtaaaattctgggttgaaaattcttttctttaggaatgttgaatattggcccccactctcttttggcatgtagagtttctgcggagagattagctgttagtctgatgggcttccccttgtgggtaacccgacctttctctctggctacccttaacattttttccttcatttcaactttggtgaatctgacaattatgtgtcttggagttgctcttctcgaggagtatctttgtggtattctctgtgtttcctgagtttgaatgttggcctgccttgctagattggggaagttctcctggataatatcctgcagattgttttccaacttggttccattctccccatcactttcaggtacaccaatcagacatagatttggtcttttcacatggtcccatatttcttggaggctttgttcgtttctttttattcttttttctctaaacttctcttctcatttcatttcatttatttgatcttctgtcactgataccctttcttccagttgatcgaatcggctactgaggcttgtgcttt

SEQ ID NO: 23269 - DNA, 1045 bp, Homo sapiens
tatctcatgttacttaattaaagttttgtacttttaggtttataatccattttgaggtagttcttgaatattgtataccatgtgaggtttggggtcacagctttacagtgttgttttttggtttttgttttaatacagatgtccagttcattcaacaacatttctttaaaacacgatcttcagtgagttgcctttgcacctttctttaaaattatttgatcttatatttgttggtctatttctgcacttccttaatctgtatttttgctaatattttaaagtcttatttaacataattttacactatgtctttaaatcaggcaatgtattcctttaactttgtacttcttttcaaattttttctgtttttattttgttttgtttttggcttttctaagttcttcgcatttccatatgaattttagaatttagttgtcattttctaataaaagtattgtggattttgattgggattgcattgaatatatgtatatcaatttgaagagaattttaacgttaacaatattgagtgttgtaacccataaacgtggcatatctctccctttatttagatctttaatttttctccgcaatcttttatagtttcagtgtatatatcctgcaaatcttatatgtctcaagtatatgttgtatgctcttgtaaaaagtactcttaaatttcaattttaaattagtcattgttagtacatagaaatacaatttttatagaaatattcattatctaccctgtaaaccagaggtgtccaatcttttggcttccctggcccacagtggaagaagaatagtcttgggccacagataaaatatactaagactaacgatagaatgatgagctaaaaaaaaaaaattgtaaaaaaaaaaaactcataatgttctaagaaagtttacaaatttctctttttttattacactttaagttttagggtacatgtgcacaacgtgcaggtttgttacatatgtatacatgtgccatgttggtgtgctgcacccgttaactcgtcatttaacattaggtatatctact

SEQ ID NO: 23270 - DNA, 1043 bp, Homo sapiens
ttttttttgaagggtttttttgtatctctatctccttcagttctgctctgatcttagttatttcttgcattctgctagtctttgaatttgtttgctcttgaatctctcgttcttttaattgtgatgttagggtgtcgattttagatctctcctcctttctcttgtgggcatttagtgctataaatttccctctacacactgctttaaatgtgtcccagagattctggtatgttgtctctttgttctcattggtttcaaagaagatctttatttttgccttaattttgttatttacccagtagtcattcagtagcaggttgttcagtttccatgtatttgtgcagttttgagtgagtttcttaatcctgagttctaatttgattgcactttggtctgagagacagtttgttgtgatttctgttcttttacctttgctgaggagtgttttgcttccaattatgtggtcaattttagaataagtgcgatgtggtgctgagaagaatgtatattctgttgatttggagtgtagatttctgtagatgtctattaggtccgcttggtgcagagctgagttcaagtcctggatatccttgttaatcttctctccattgatctaatactgacagtggggtgttaaagtctcccattattatggtgtgggagtctaagtctctttgtaggtctctaaggacttgctttatgagtctgggtgctcctgcattgggtgcatatatatttaggatagttagctcttcttgttgaattgatccctttaccattatgtagtggccttctttgtctcttttgatctttgttggtttaaagtgtgttttatcagagactaggattgcaacccctgcttttttttgctttccatttgcttggtagatcttcctccatccctttattttgagcctatgtgcatcttttcacatgagatgggtctcctgaatacagcacactgatgggtcttgactctttatccaatttgccagtctatgttttaattggagcatttagcccatttacatttaaggttaatg

SEQ ID NO: 23271 - DNA, 1039 bp, Homo sapiens
caggcacataccactgtgcctggctaatttttgtattttcagtagagacggatttcaccatgttgcccaggctggtcttgaactcctgtgccttggcctcccaatgtgctaaaggagttctttatattttcttgataagagcccttgtttggttatttgtgggaaatgtgttccccaacactgtggatcagctttgtattttccttatggtttttaatgagcagaagtttaaagtttaatataattaaatttatcaatgttatactttatgcttcatgttgtgtgtgtgtgtgtgtgtgtgtgttgtttaaaaaacatttttatctctttattgttatttttaatatggttttattcctttggaaaaaagattctcatgtcatggtcataaagatattcttctacataaagatttgtaaagtctttattgttttggattgcccattgaggtctctaaagtacatggaatggacttttacgtgaagtgtgggtaagaactccctttctttttaattatatagattccctgctgtcccagtttaggacagggttgtgtaatcttttggcttccacgggccacactgaaagaagaagaattgttttgggtcacacataaaatacactaacatggcccggcgcggtggctcacacctgtaatcccagcactttgggaggccaaggcaggtggattacgagatcaagagattaagaccattctggccaacatggtgaaagctcctctccactaaaaatacaaaaaaattagcttggagtggtggcacacacatgtagtcctagctacttgggaggctgaggcaggagaattgcttgaacctgggaggcagaggttacgatgagccgagatcaggccactgcactccagcctggtgacagagcaagactccatctcaaaaaaattaaattaaattaaaaaaaaatacactaacactaacaatagctaatgagctaaaaaaaaaaatcacagaaaaactcataatgtttttaaaaagtttacaaatttgtgttgggccacattcaa

SEQ ID NO: 23272 - DNA, 1201 bp, Homo sapiens
ccaacatggcaaaaccccgtctctactaaaaatacaaaaattagtcaggcgtggtggcaggcgcctatatcccagctactcgggaggctgaggcaggagaatagcttaaacccggggggcggaggttgcagtgagcagagatcacgccactttactccagcctgggcgacagagtgaaactgtctccaaaaaaaaaaaaaaatttgcttaagtttaaggccaggtgtggtagttcatgcctgtaatcccatcactttgggagcctgaggcaggatcacttgaggtcaagagttcaagaccagcctgggcaacatagcaagaccctgtctctacagaaaatttttaaaaattggccagcatggtggcacatgcctgtaatcccagcactttggggaggctgacttgggaggatcacctgaggccaggagtttgagatcaggctgggcaacatactgagaccccgtctctacaaaaaacaaaaatcaaaaaattagctgggcatggtggtgtgtgcctacagtcccagctgctccagaggctgaggcgggaggactgcttgaacccgggagtttgaggctgcagagagctatgatcgcactgcactgcctggatgacagaatgagaccctttctctaaaacaaaaaaaattttttttgcttaaatcatgtagtgttgtaaaccttgtttggtttcttaactttttcacttaacatttttttttcttttttttttgagacagagtctcactctgtcgcccaggctggagtgcagtggcgtgatctcagctcactgcaacctccacttcttgggtttaagcgattctcatgcctcagtctcctgagtagctgggattacaggcgatcaccaccatgcccagctaatttttgtatttttagtagagaactgggttttaccatgttggccaggctgatctggaactcctgacctcaagtgatccactcgtcttggcctcccaaagtgctgggattacaggcgtaatcactgcgcctagccaagatttggtttttttagagggctttacttccatgtgactagtatcttgtactgttggacatttttaccatgtgtatggattatacttacaaaagaaaagaacaacataaataaaaataaactaaaagttggaggaagtaaacgacaatctaaacagcagaccctcctcagcctactttctccccac

SEQ ID NO: 23273 - DNA, 1638 bp, Homo sapiens
gcgcgagccccggggcggacgcgcgctggggggaggcggcccggggcgcgcgcgctggtctgtctccgggggcgggcgggcgcgcgcgagcccggggctccgcggggcgcgaggtcgccgcgcgccgccctggtgaaacgcgggtctggatggaacgtcggggtacccggtgcaggggctggggtcgtcgggggccaggtgggctgcccgagtttggagacagtaaagtaggtcggtggggggctgggggggatgggctggaaggggagaggagcgcgcgcgcgtcccggacggccagcctgcggtgcgcgaaggcggagggccggggcgcatgcgcacgcctgggcggggccggggcgcgcacgcaggcgggcggcggctgcgcggggcacgttctccggccggcggcgcgggcgcgggccgggccaggctgggtctcttcctcccggccccggactccggtgcccccgggacgcggcgctttacagacgcatacgggagcagccccggtcccccgccccgcgcggccgaacaaatggttctctccagagcttgtgattatacgttttattagactcgggaggggtatggcagggcttcatcagtgttccttcaaattaaaaaaaaaaatacaaaagctacgtagaaaacgtcagatcagacgactaaactttcccgactcagggccaagttctgcaagggagaaagaaagaagggtatgagccgcggggaccggctgggggcccagggacggtctggacgccagggagggcggccctcaccttcttgagcctgcgctctcgggacgcctgcgagtcggtctccgagtacgggggcggcgcgggcgggtagtaggcctcttcctcctcctccttgtggggtctcctcctctcctccgaccccttcttcctcacagcctcctccagtagccgcccatcataggggaggtccccggacctggagccgttgtcccgagggtcccgggtacggtggtggtgggacctggggtcggcaggagggcgctcccgagacctgaagtcgtcgtagtgggggtcccgggagcgtgggaagtccctcgagtcgtcttggtcatagaggtcgtcccggctgcggctccgcgggggcatgtaggcccggcttctcccaccattactcgtgggagacctgctccctgactcggcggtgctcggcggggtgaggtcgtccagggcgtccacggagcgggcccggggccgcctggcccgccagcccccgcctgcctgctccctggcgggctcctggtcccatcccctgggactccggggggagtggccaccccactcctcatcccggatcggggtgagggcagggccccgggaaggccgagatcgccagtcgtcctcgtggagggaggtgacttcactcatggctgcagggaaggggggtgtcactgactgctggaggagcccggggtccagggtttgcaccaagagtccctgcggcaggtatcagggagacatgtttcacccccccaccttaaaagccctcagaccccaaggctcctgcttaccccgctccacacggccactgggggggccaggtcgagaagggtcgaagttggccagctccttctccatgtagtacaggacccgcatggag

SEQ ID NO: 23274 - DNA, 1095 bp, Homo sapiens
aaccgcgggaaggaaaaggagagcagctggtttcactcgcaggatcggggagccaaggctccgcggagatggggctggatggccgcggaggtggagcggaagcggctcgccccagggttaaaatgctgccattttggggctgggactggtctgggaggggactgagggaaagtctcccctttctctccccggcagtgtgaaaagccagggaatgaagcccgcgggagcggggaatctgggattcaggtgagagccaaagtctcttaagtctcctggggactgcagttcctgcccaggactgtgcccactcctcctaactcaactctgctcaaccccctcctgccttgtctgcagggaactgactatttcggcagaagaaaccaaatgcactcctaaaaatgctaacgatttccaaagtactaattaattgcaaatcttgctgtgatatacctcaccttataccacagatggggctgggagaaattccatgtaaaccggtccttttagaagcacaattgtcttaaatgtcctctatccagccggggaacagactgtggtgaactctgggggattcagagtgctttggaaaaacattccccccagttatgctggaaatgtgggctttatgtcagcacctgtggtgctgagagttagtgtcacggagatcttgtgaaagtgcaggttgctctaacagggctgggtggggctgagcctgttagccgcgttgctaacaagctcctgggtgaggcgttggtgggaaaggacccacgtggccaggggcaaggccagaccggaggtgctggggctgagtagagacatctctttttagataatctatgagggatactaaccttttatgggaacaaactggtttttttaaaaaaaaatttcttcccatttgtaaccctctttctagtttgtgtttttttcctttttgagatggagtcccgctctgttacccaggctggagggcagtggtgcgatctgagctcactggaaactccacctcctgggttcaagcgattctcttacctcagcctcccgagtagctgggattacagacgccagccaccacctctggctaatttttttttg

SEQ ID NO: 23275 - DNA, 1045 bp, Homo sapiens
gatcagaacccgccctgaccggcgcagagatacgggacgcagccgtgagcactgttttttatttcaccatggacccatcggcgtggggcgcccgccccgggtgtccttcctcccccgggcagccagatgctggaacgggaggcacatgttccggccccggcccctgggaaggaaagaaaggaccttcccgtttcacttgtctcggctgaacatgtagcggaggaggtcgaccacccggtgactgtagccatattcgttgtcgtacctgtggaggaggggtcgggaggttcaagggggttccttccgaccaccccttagttcccctccctctaagtctccagctccttcccccttaccatgaaatgagcttcacgaaattgtcattgagcgcaatgccggccttagcatcgaagatggacgagtgggtatcaccgaggaagtccgtagagacgacctggaagtcagaatttcaaagataagtgtgtccggcagagcaaggacctccaggagctgaggccccgactcttaactctatcgcccatccatgcattcatctataatatttgatgtagccctactgtgtccagtctctggactggagggtatgaccaagtgcagggtatgaccaaggcactgtgtcagggtctggccaaagggcacaggtcacaaacaccctcatgctgtaccagtacatccctttcctaggaataatgcaagcgtttggaatgggccagcatggagggcctctctgaggggtggccatgagcctgggtctagatgactagaaagatctgaccggctggggccctcagcacagtgtctgaggtagaaggagctgcaggaagggaggacctgagggttttagccctagtgtcatgaaaggccacaggagtgttttcaatcctgaaaacgggtgatgcaatgtgattccattaaaacaaaagatcccagtgactgtgggaaagtggacctgcaggagttaatgcagggagacagcaccaaggtggatgtacaggggtccaccatgaccatggcatccactcct

SEQ ID NO: 23276 - DNA, 1129 bp, Homo sapiens
gcgggtgcctgtagtcccggctactcgggaggctgagacaggagaatggcgtgaacccgggaggcggagctggcagtgagccgagaccacaccactgcactccagcttgggtgacagagtgagactccatctcaaaaaaaaaaaaaaaaaaaaaaaccctcccaaagtgctgggattacaggcgtgagccaccatgcccagcagtcattcctttcaatggcaaaaaccgcaattatttttgcatcaactacacacacagacacacacacacacacatatctcatgtcacctgcagatacagttttatttcttcctttccaatctaaatgcctttttttcttttttgagacagagtctcactctattcctcaggctggagtgcagtgttggtgtgatcatagctcactgcagtctcaaagtcctgggctcaagtgatctccctgcctcagccccctgagcaggtaggactacaggcatgtgccaccatgcttggctaattttttaatattttttgtagagatggggtcatgctgtgttgcctaggctggtcttgacatcctagtctcaagtgatcctcctgcctcccaaagtgttaggattacagacgtcagccactgcgccgggccctgtttgcgtttttttcttgcagtgactagaacttccagcactatgtcaaataggagtgtcaagagcagacatcctttccttgttgttgatcttatagggaaagtattccatccttcatcattaaatatgatatatatttggtgtgtttaaatctattattgttattactattattattattattattatttgagacggagttttgctcttgttgcccaggctggagtgcaatggcgccatctcggctcactacaacctccgactcccgagctctaagcgattctcctgcatcagcctcccgagtagctgggattacaggtgactgtcaccacggctggctaatttttatatttttagtagagacgaggtttcaccatgttggccgggctggtctcgaactcctgacctcaattgatttacctgcctcagcctcccaaagtcctgggattacaggagtgagccaccgcgcctggccgttattaatatttttgatgtttaagtt

SEQ ID NO: 23277 - DNA, 1058 bp, Homo sapiens
acccaagccatcctgcactgagcacagatggcagaagcagacagcactttgacttggaagagtagggacactgctggtgctgttttgtttttattttgagacagagtcttgttctgtcacccaagctggagtgcagtggcgccatctcggctcactgcaacctctgcctctgggttcaagcgactcttgtgcctcagccttccaagtatctggggttacgggcatgcaccatcacacccggctaatttttttgtatttttagtagagatggggtttcaccatgttagccaggctggtctcgaactcctaacctcaggtgatccactgctgggattacaggtgtgagccaccatgcctggtctgttgctgttcttaaaagtactccccctccctagactcaaaaaccttgcccccccttcctcttcctgggctgactcggtaggaatcatctgcagttgtctctctggaaagagcaaagaaacaacaggttatgcagacacaagcctgtgtcctgccagagggtagagcaggtagagagattaggtagggcatgattggaaggggagtatgtgataaaaggcaatatgatatcagcctctcagtcctttttaatacttatattactttctttttttttttgagacagagtttcactcttgttgcccaggctggagtacaatggcgctatcttggctcactgcaacctccgcctcccggttcaagcaattctcctgcctcagcctcccaagtagctgggattacaggcaactgctaccatgcctgactaattttttgtatttttattagagatggtgtttcaccatgttggccaggctggtctcaaattcttgatgtcaggtgatccacccacctcggcttcacaaagtgctgggattacaggcgtgagcctacatgcccggcctaatactcgtattactgaataaaatttgaaatctgatttttttttttttgagacagagtcttgctctattgcccaggctggagtgcagtggcgcaatctcggctcactgtaacctccgcctcctgggttcaagtga

SEQ ID NO: 23278 - DNA, 1519 bp, Homo sapiens
caagtgatcctccttcttcagcttcccaaagtgctaggattacaggcgtgaaccaccgcactccgccaagggtcagggtctttaaagactcctggattctgtgggagggcacctaggtgtgaggctggccctgacctctgccattcccttcccctcaggagatcaagagcaacaagacagttctgcacttggccgtgcaggctgccaaccccactctggttcagctgctgctggagctgccccggggagacctgcggacctttgtcaacatgaaggtgggagctggggctgggaagtgcagattgtgtggggtacggtagggggggcagtgggatgttaggggtcctgggggctgtggacgtggaggggacgatgtgtgggatctgcaggggaaagtataggaagcagacacagattgccccagaacatgtagtccgtggacacagggatgcatgcagcgtggctgtggccgggggaggtctgggatgtgaaaggacaagtgtaggacgtagacaaggcagaaattgaagtgcagtttagaggcctgggccagctgagcccagatccccaccagccctccccttacttttccaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgagggggtaagtaagcactgagcctgcctgtagagtggcctctgagctcgcgggcgcgggatgacctccctgccccacccaatgctcgctttcagagaatgacttctaatctcggaaggtgacttcagccctcaggcaaccctgactctataatgtgacctctgacctcagtgtttcatcctttaccccagaatggtgacttctctgatctctaccccaaccctgacctcacagtgtgacctgtacttccaaccctgaatcttgcttgacctcaaggtgtgacctttgatccccccaagtgtgacctcctaccccctgcccctaaccttgggtcctgacctcagatgtgacctttgacctcttacctgttcccttcaattccctctcattcctcacccccaggtgggaacccccagccagcagcccctttcccttcactgaagttctgcttcctgaccctttctcagtgtacgaacccaggccttgaccttcttcccacatctttatttttatttgtttgtttgtttatttatttattttgaggcagcgtcttgctctgttgcctaggctggagtgcagtggcatgatcatagctcactgcagcctcgagctcctgggctcaagggatcctcccacctcagcctctccagtagctggtactacaggcagtcaccaccacacccagctaattttgtttttttttttttttaagagatggggtcacactatgttgtccaggttgatctcaaactcctggcctcaattg

SEQ ID NO: 23279 - DNA, 1050 bp, Homo sapiens
ctatacatgcagccccaaccagaatataagctccataaaattgtggatttttgtcttattcccgctgaatataacagcccatgcctagaacagtgccttgctttcatgaatatattacattccggctggcgctttccttcctccaatgcatgcacagctgaaaaagcccttatctcccatcgcactcctgttgccttgtcccatgttctgacataaagcggatcatccacatgtggggatgaatcttgtgccccgctggaagagatccctgtggctgccggccctggtgcctggggtgagacctaacagtagagagctcactactaggaaaggagaggcattcccaacacagagaagtaggggcggacaggtcccgaggctggagggcgtgtgcagatgggtcgggggagcaaggggctgtcagcttcattaaggctgagagcaggcaggagcgaaacagctggctttgctagccagttacacactcaccgctgtccacggatccctgacactggacgactgttgtgccggtggcccccccaggctgctgcagtctgaggagaaaagccagatggtgacactgcgtctctcctgccccttacctccaggcacagtgaggggcccacctgggatataggcatctccccggagctggtcaggcagatggccccagttggggggctgtggacgccgactcctgaccaggaaggcgcggggcatgccctccggaaggctctccacacacaggggctgcttccacctgctgtcagacctcagccccaggatgactatccctggtgggaaaggaggggaagcctctgaggaacctcattctcttcatgcaaatttcctggctggccctgggagtggactaagctggctcaggttacccctgcctggggacctgcccatcttctcccaggttttggagggaaccatccagcctccaggggtggacaagcactaggaccaccaagcagagccaggcaaggggagatgggcctggggagcttttgaggataggaagaagaaacaaggccccagggggac

SEQ ID NO: 23280 - DNA, 1031 bp, Homo sapiens
ccccatccccttgccggcttccttctccgtccctgcgtcgagctgtggctacatttctcgatgagggcagagggcgacaggcgtgacaaccaccttcttgaagctctgcgggcaccctcctgcgggtggacgatgagcgcctgggaggccgttgtccttggttggggagcgctcgtctggatccagcctagcaaagaggctgctccggatggggaggggatgaaaacccctgcgggtccgacgccgatgcccacgttgcccaggccttcacagacccccaaactggaaccgccgggacgacgactgccaaccggccacacgacccaggcagagacgcggggagaggctgaccagaagaaaggccgacgtgcaagaaacccaccctccggcgcacagggcacatgtgtcccgaggcgcacgcacacacagacggacagagacagaaagagagggccacggaaagagcgagaagggagagagagagagagagagagacctgagagagagacagaagtccgcacacagacaggcactgcgcgcgcacacacacagacgcaccccccccaacacacaaacacacacacccatgacgaacacacacgtacagcagggaacaccctcccgcaggcagcccctgaagctgccgggttctgctctccgcgactgagagccagcggtgagagagccgcccacgggcacgcaggcggacctgtgctcgtcatcacaagggctccacttttggggagactcacccgcacaccgtccgcgcacgcctgaggctgggatcccgcgctgcctcgccggcgatctgtctgaggtttcttcctcctggggtttcttcctgctgctggaccctccgcgaatcccggcctccggagaccgtcctggtaactgccctggccaggactggtctcagcccagactcagacgcacgatcacacagggctcctacttccccaagtgtcagggacccatccccgggcaacggtggctttcactgtgacccaagcggcggctcgggcctcgcgcat

SEQ ID NO: 23281 - DNA, 1957 bp, Homo sapiens
tcgaatggaaaatgatgaggggacacgatgttagagttgcagtgggaaggggtggaaaagagggattccagagtgccaggcacacaggttttctggaaggtttacatgaggactgctgtggtttgaatgtgttccccaaagttcatgtgttggaaactcaacccctaatgcaacagtgttgaccagtggaacctttaagaggtgattaggtcatgaaggctctgccctcatgaatggatgaagctagagtgggttagttatcttgggagggggttcctgataaaaggatgaggttggcttccttccctttctctttccccctcccccctctcacatgtggtcactctcttgcccttccaccttccaccataggacggcacagtgagaccttcaccagatgcaggcccctcactttcccagtgttcagaaccgtaaaccaagtgaactcttgcttataaatcacccagtctgtggtattctgttatagcaacacaaacggactaagagagggacactcagtgggctcttctacttgatggagcactccctgcgtggtgccttgtatttgtagacatgatgctgtaaatgctctttgaatgtcttgaaggcttttatgtttgaggagtttacagagaagcacctacaggcttcaggtcccttcttctgttgcttctttgctccttagttcctcccctaacctggtgctaaattagatcatagtgtggtccttggaccaacagtatcaatagcacctgaaaatcatgctggaaatacagattcacaggctgctccctagaatactgaagaagaaactctaggagtgagacccaacaatctgtatttaacaagtccccaggtgagtctgatgcacacagaaatgtgagctgctgtattagatggtgttgagttcatgccaccgaatcactgacacacacgtctgctcactgcttgctctttgcacaggcccctggatcctcctggaatccccgatccctcttgctccctggcagagttttctagtccctcttacttgaagcatgtctttcagagcccggcaccacccatcttgagtatctggtgagttctgtggtctgcatgtccatgtttgggacattctgggaagggtggcccaggctgtgatttgccatctactgcaggctatggatggtattcagaagggaggggagatgctgtgtgcgtgttctgaagggtttcccactaaacagatcaaccctctccataactatttgatttttactttatctcctcgttgacttcacagtgtcagtgcagtttgtgtaaacatctctatggggtgatgcatgcagataaatgtttatgtgaacatataaagtctgcatgtgtgggtgaacactccacatcaggtcattgtccatcattacatatctgtggtgtctggctcattcgtctcgttttctgtcattttacctacttttacctgaagtacaatgactatttaataactattaaatgtttcatttcagctacacctctatggtatttttttcacctcatatcataccttcctccctcactggacttcagtgtgggacctgcaggtctcaggccttctgggaagtcccagcttttcttgaatgttttctctctctggccagctcaggctggagcagtgggtgttggtgccatcctgtggctataggtgataagccggctgttcttcactgacctggtcttaccttgaaccctggagttctcacatgcatggatttaaatgctgtgtctttctaagggcacattatggccattttccttatctccctcccaaggggctgtttgctgtgtttattgactccctgtttaaaaaacatatatatatatatatatatagacgaattaggttgtaccccataaattgcatgtttgaaaaatatttcaaagaatagtttatttttttttgctgatttttatgtatctt

SEQ ID NO: 23282 - DNA, 1084 bp, Homo sapiens
ccgtggtaaccagaaagctgattcagcagctcaagatgcagtgtgactttcagtcacgcctctaaacttgctgcccacagtctcctttccacagccagatctgcctgacaatcccgcatactcaacagaagaagaaaactggcctcagaactcagagccaataaaaatcaggaaggttggtggattcttcctgactctagaatcttcataccccgaactcttgggaaaactttaatcagtcacctacagtctaccacccatttaggaggagcaaagctacctcagctcctccggagccgttttaagatcccccatcttcaaagcctaacagatcaagcagctctccggtgcacaacctgcgcccaggtaaatgccaaaaaaggtcctaaacccagcccaggccaccgtctccaagaaaactcaccaggagaaaagtgggaaattgactttacagaagtaaaaccacaccgggctgggtacaaataccttctagtactggtagacaccttctctggatggactgaagcatttgctaccaaaaacgaaactgtcaatatggtagttaagtttttactcaatgaaatcatccctcgacatgggctgcctgttgccatagggtctgataatggaccggccttcgccttgtctatagtttagtcagtcagtaaggcgttaaacattcaatggaagctccattgtgcctatcgaccccagagctctgggcaagtagaacgcatgaactgcaccctaaaaaacactcttacaaaattaatcttagaaaccggtgtaaattgtgtaagtctccttcctttagccctacttagagtaaggtgcaccccttactgggctgggttcttaccttttgaaatcatgtatgggagggcgctgcctatcttgcctaagctaagagatgcccaattggcaaaaatatcacaaactaatttattacagtacctacagtctccccaacaggtacaagatatcatcctgccacttgttcgaggaacccatcccaatccaattcctgaacagacagggccctgccattcattcccgccaggtgacctgttgtttgttaaaaagt

SEQ ID NO: 23283 - DNA, 1025 bp, Homo sapiens
tgcaggaaacagcaccaagggtgattgtaaattttgatttggcgcggcaggtagccattccagcgcaaaaatgcgcaggaaagcttttgctgtgcttgtaggcaggtaggccccaagcacttcttattggctaatgtggagggaacctgcacatccattggctgaaatctccgtctatttgaggctgactgagcgcgttcctttcttctgtgttgcctggaaacggactgtctgcctagtaacatctgatcacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtaaaaacggggctttttcagcccactcgggtaaaacgccttttgatttctaggcaggtgttttgttgcacgcctgggagggagtgacccgcaggttgaggtttattaaaatacattcctggtttatgttatgtttataataaagcaccccaacctttacaaaatctcactttttgccagttgtattatttagtggactgtctctgataaggacagccagttaaaatggaattttgttgttgctaattaaaccaatttttagttttggtgtttgtcctaatagcaacaacttctcaggctttataaaaccatatttcttgggggaaatttctgtgtaaggcacagcgagttagtttggaattgttttaaaggaagtaagttcctggttttgatatcttagtagtgtaatgcccaacctggtttttactaac

SEQ ID NO: 23284 - DNA, 1063 bp, Homo sapiens
tatacatagtatatattatatatatattatatatatatatattttttttttgttttgagacagagtcttgctctgcgacccaggctggagtgcagtggtgccatcttggctcactgtggcctctgcctcctgaggttcaagtgatactcctgcctcagcctcctaagtagctgggattataggtgcacaccaccacgcctggctaattttttgtatgtttagtagagatggggttttgccatgttgcccaggctgggctcaaactcctgagctcaggtgatctacccacctcagcctcccagagtgctgggattacaggcgtgagccactgtgcccagcctgtaaattcacattttcaaagggcgttaagggaattattaattaaactggtatattattctgataaaatacaaatattttttagttctagaggagaaattatgttcttcctgtttttttttttttgtttttttttttttgtttttttttttgagacagagttcccctcttatagcccaggctggaatgcaatggcataatctcggctcactgaaacctccgcctctcctgggttcaagtgattctcctgcctcagcttcccaagtagctggaattacaggcatgtggcactacacccggctaattttttgtatttttagtagagatggggtttcaccacgttggccaggctggtctcgaactcctgacctcaggcgatctgcccacctcggcctcccaaagtgctgggattacaggtgtgagccactgtgcccagccctcctcttcttgttgaatagaattttccactgagatacagagtcagagcattgataaaaaaaatacaagccagcttaagttccacctctggtttctgggatctcttggggaggaacccattggtgttatttcctctgagagctgcttcttccaaagcaggtatagcacttcctacaggaggtcccagaaggttgcagcacaggcggggtcaaatcctgactctggagttcaagaccagcctggctaaacatgatgaaaccgtctctaccaaaaatacaaaaattag

SEQ ID NO: 23285 - DNA, 1041 bp, Homo sapiens
cccagcccacatggctaatttttaagcattttttgtagagacagtgtctcactgtgttgccaggttgctctaaaactcctggcctcaagggattctcccaccttggcctcccgaagtgctggtattacaggtgtgagccactgtgcccagtcatttttgtctattaattgatgtattttatgcatctacatttcattaattttcttacatatttgggtttaaatctgctgtcttcccagtgtttttctgtttgcttaatatgttcttacttttttcattctcctgccttttttggattaatcaagcatttttattctagtttttccttttataacatgatcattatacatacatttatttttcttcttgtggttgccttagacaataacaagtacattatttacttattgcattgaatctgaaattagcttctttatatcttgttcaaaattgtagggatcttaatagaatttttttttttttgagacagagtctggctccgttgcccagaatggagtgcagtggcacgatctcggctcgctgcaagctctgcctcccgagttcacgccgttctcctgcctcagcctcccgagtagctgggactacaggcgctcaccaccacgccccgctaatttttttgtatttttagtagagacggggtttcaccatgttagccaggatggtctcgatatcctgaccttgtgatccacccgcctcggcctcccaaagtgctgggattacaggcgtgagccaccacacccggccggatcttaatagaatctttaaaaaatgtattcatttatttttagagacaaggtctcactgcatcacccaggctggagtgcagtggtgtgatcatagctcactgcaacctcaaactcctgggctcaagcaattctcctacttcagcctcttgggtaggtaggactacgggtacacaccaccatgcccggctaatttgttttattttagagatgggggtctcactgtgttggccaggctggtctcaaactcttggtctcagatgatcctcctgtctca

SEQ ID NO: 23286 - DNA, 1053 bp, Homo sapiens
tgactggtgccatactgttatgtgcctgattgcagaggccactgaggcttgcctgttgctaagggctgttggagcccagggcctctgatgtcagcctgatggtggtggcagcctggagatggagttcatcatgcaagcctgaagcctgggctgcatgatctttcctgatgccagagcaggtctagagggtcagtctgtggctactggcctggagtctggggttgggagtctccctgttgctgggttttactatggcgggcctggtgttagggaacaggcaaagttctgtgctcacttccctgacttttccccaagtgggcaatacctctgtctacactgtgctgccttgagctggggaggggtgacatgggtaatgtcgagccgtccttcctgcactcttcaatgcttcttttcttattattgtgctacaacccagtactgcgatctctcacctggttgccttagctattgtgaaggcatttttgttgatggataattgctcaaactgatgtttctgcaggtggaccatagatggaaagaactattttgctatcttctgagatttagcattttttgaaagattattagctgggcatggtggtgcccaactatagtcccaactgcttgggaatctgaggtgggaggattgcttgagcccgggaggtcgaggctgctgtgagccaagatcatgccactgtagtccagcctgggtaacagagtgagaccgtgtttttgaaaaaacaaaacaaaacaaaacctactgttagttattcctcttttttttagtgaattgctgatgatcagatttctcctggtgaagtagaaatccttgcttcagagacaaatacctgagttgaaagagaaactggcttttaggctgggtgtggtggctcacgcctgtaatcccaacattttaggaggctgaggcgggtggatcaattgaggtcaggagttcgagaccagcctgggcaacatggtgaaaccctgtctctactataaatataaaaattagccgggcgtagtggcaggcgcctgtaatcccagctacttgga

SEQ ID NO: 23287 - DNA, 1004 bp, Homo sapiens
ttagtgtctcttctgtataatgtcattttgatccattttgtattaggctaatttgtctttttcctaagatttgtaggaattccttgtataaattctagatactcatttttgatcaatcgcatgttttatagatatgttttccagtttgtgtcttttttattcactttcgttatgatatcttttgaagaacagtaattctttgtgttaatattgtcaaattgtatgtttagtggttaaattatatattgcttataaacatttttatctttttcctgtatgctttatactttttggatcttcagaaaccccttcctagcccaattttctactttgattcccaaaattttttttttaagacagaaaaagtcacccaggctagagtgcactggaacaatcacggctcactgcagcttctacctcctaggctcaggtgatcctcccacctcagcctcccaggactgcaggcgcatgccatcactcccggctaacttttcatattttttgtagagacagggttttgccatgttgcccatgctgatctcgaactcccaagaatttttatgtttccgctttcttattaaagacctattaatgcaactttaattgatttttatgaatagtatgagatggagatcagttatttttcctatatagaaaacgaattggctgggtgtggtagctcatgcctataatcccagcactttgggaagttaaggcaggagggttgcttgagcccaggaattcaaaaccagcctgggcaacagagggaaacaccgtctcttaaaaaaaaaattatgtttccctctcaaatgaaaactccgtctattcttcattgatcaacaatgctcctctgtcatatattcagatttcatatatgcattgggtctttcttgttacattgagcctttttatccctgccttaattactcttgtttatataacaagtcttgatttctgataggacacatctctccaccttttctttaggcatattttggttatac

SEQ ID NO: 23288 - DNA, 1035 bp, Homo sapiens
gttacagtaatgaatagaacatgcgtgattgggtgcagtggctcacccctgtaatcccagcactttgggaggctgaagcaggaggattgcctgagatcaggagttcaagaccagcctggccaacatgatgaaaccccatctctactaaaaaatacaaaaatcagctgggtgtggtagcatgcgcctgtaatcccagctactcaggaggctgaggcaggagaatcacttgtacccaggaggtggaggttgcagtgagccaagattacgccactgcactccagcctgagtgacagagagagactctctcaaaaaaagaaaaaaaagaacatgcataatctctgttcccagaacctaccccacagtgtagggagagacatgaaaatagatgaatatataacataccaggtaatagtaaatactaaaagaaataagaagtagaggaaggggataaaggatgatattttatgtgaaggggcaagagaaatttaccatatcttactaaatgatatggtaacgtttgggcagagacctgaagaagcaccatagtaagttactgtactgggcggaggaccactccagatggaggaatgcagaccttcaagggcctgaggcagctgtgcgttggctgtgtttgaggagcagccccagaggccagtgactggaggagtgagagcagaggggtacgtgggtgggagatgagatcaaagaggcaggagtgggaaagagtgggtcagtttatgtactgtctgccatacaggccatgggaaatcttttcattctaagacaagaagtcatcagaaggctgtgcacctagaaatggcttgatgcaactcattatttttttttttttttttttgagacagagtctcgctctgtcgcccaagctggagtgcagtggcatgatctcggctcactgcaacctccgcttcccaggttcaagcgattctcctgcctcagcctcccgagtagttgggattacaggtgcgtgccaccatgcccggctaatttttttgtatttttttttcagtagagaca

SEQ ID NO: 23289 - DNA, 1077 bp, Homo sapiens
gacggagttgcaccatgttggccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacctcaggtgatccgcccaccttggcctcccgaagtgctgggattacaggcgtgagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaatctaaactgtcttcttctgttcctcattttgctttacttaaataatctttcatattttttaagtgttttgcccatgtgcttgggtagccttgaagtcaccagaataactaggactcaaattcagaccaaaccaggactagctttttgtgccatgagttagccatggtcctggacccagcaaaaagaatgattatgatggtcagagtaagatgagcaattgcaacataatattctctaatattgtatactgtaaatttattcagctgccctcgtttactcacagtttgcttatttgccaccataagaaatggtacaataaaaattcatgtaatcaccccttagatttcagttgtttttatttctgtgggtcagattacagggaagggattggtagatcaaaggattgatgttattttaaaatttttaatagatgttgtcagagtcaggtccaaaagaacaacatatcctctggctctacaatagatcctatgatgctacttaattgtatgcttctttgatgagtataaacctcacttgctcccagatttgcctctttgagagttttcatattgttagctcatttttctataggattatttgtctttttgcctccctttttct

SEQ ID NO: 23290 - DNA, 1040 bp, Homo sapiens
ttcatactgatgataaaccctatgaatgtaaggagtgtgggaattcctttagtgttgttgggcatcttacttgccaaccgaaaatttacactggtgagaaatcatttgactgaaataaatgtataaagtggttttttatttctgattttcacaggaaaatactgtggatggatttaataggtaatcaaggcaattcagtatctccctctcttaaagtctgtttttagacttcatggtcattctgtatgtagacgtagaattgcttagtcatagctgatatatacttatagctttgttagatgttgccaaatatttctcctttttatgttaaaaagtttttttcatgagtttctcatcctggcatgttttgtttacaatagcttttgatgtttgtattattgctcttttgactattcagttttttaattgtaatattacttcaatatcttttctgcattgtaattctttgcttgtgatatctatacttacttattttcctccacagagttagcactcctagtcagatacaatgtatttttacagtcttacagctcatcattttgtgtaatgttgttttgttttgttttaaatgatagaagtgtgatctcctttccattttcatccaattgttgacttctctttaaatttctactttattttgatacaacatattccccccaaaaaaacacatacataggaactggttatattccaccataacacacacacacacacacacacactatatacatatagtgtatatacacatatagtgtatatagtgtatgtgtgatgtatactatacatatcacatatactatatgtgtgtatatagtgtgtgatgtatatgtgtgtgatgtatactatatatgcccacacatgcactacataacacactatatatatatatatatatacacacacacacacacaatatatgtatatatagtatatacactatatactgggcactatatatatatagtgtgtatgtgtgttatattggaatataaccagttcctttaagcagtctttttacc

SEQ ID NO: 23291 - DNA, 1049 bp, Homo sapiens
gacggactctcgctctgctgcccaggctagagtgcagtggtgcaatctcagctccctgcagcctccacctcctgggttcaagcaattcttgtgcctcagcctcccaagtagctgggactacaggcgcatgccatcacgcccagctgtttgtattttagtagaggcagggtttcactggtcacaaagttctgagctcaggtaacccacccaccttgccctcccagagtgctaggattacaggcatgagccaacacgcccaggcaaaatgaggtcttaacaaactgcaccttgttattatcctcggtaaaatttatttttggggaggaaaaccacaaaagtgttagtatatatggattatcaaattttgatctgcgttagcattacctctacaagatgctaatgactagttctacatctacagattttgattctgtttaaccaatgagcttaccaggtgatgaccaacacacaaatttcagatccactgacttaatctgttacctttatcacaatcctcataatctttatgttctgctgttactctgtgagctctctttatctttcatgacagtattttaaccaattcatgtatatggtgaattattcttaaattgtctcttctttctataactgttttatttttgtagtacatgaaaattattttttcctttctttcagatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacttacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaat

SEQ ID NO: 23292 - DNA, 1050 bp, Homo sapiens
cgcttgagcttcagggctctttcgttgttggactacgtttcccacaggcctcagggccgcggatgaacttcgacctttgcttccttttccggtgttgtggttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtggttagtgctattgtttacgacgtcattgtggtgtgtgtgtgtgagagacggagaccctagtgtgtgccgtgggtgctgtttgatcggactcaggacggtgagtaggggcggggtctatcgtgtgaccctggtctacggtgacgtgatcgtgtgacagcactgttgtgaccaactataagtgtgaacggggtagaagtgtttttttgtttttttttgtttgtttgtttgttcgtttttttccgtgagcctgtaggagtttgttttgggtaaagcgtcatttttccgactctgtgatgtctgtgatggaatctcttcgtgaggtcttatacacacacacacacgcatatagatagattacatagatgatatatagaagatagataaatgatagataatagatagatagatagatagatagataagatagataaatgaagtttcctgggaagacgtgaaggggagggcataggtgtagtattcattcctgggataactccccttgcatgagtttggaggccatttatacattaaagaactacagtatttcctgagctgtgttccctagaaactgctaggcattggtcgtacctttttctcggatgtggggaggagtcgacagtattctagtttccctcttcgatctgggtgtgtttgttgtgtgtgatgggcttttctggtggtgaacactgtgttcttatttaaccagtccaggatgtcatgagtcctttctccctcttggttatgtagttctgcaagtgaaggccccctgaagtggaagacagcattggtactaatggccaa

SEQ ID NO: 23293 - DNA, 1045 bp, Homo sapiens
atatttgtgcattgctattggttgaatctgcatatatgaagagctgattacatatactactgaatttcttgcctacaagtgctatcaattactgagatataattgtggatttccaattatgcttgtggatctatttcttttgttctgttagtttttgcttcataaaatttaacactctcattataggttcatactagcatacatattcctgatgaacacagtcatgtgtcatgtaataacattttactcaatgatggacacatatacaatggtggtcccataagattacaatggagctgaaaaattcctatcacttgtggacgttgtcatgcaacatatcactcaggtgtttgtggtgacgctgctgtaaataaacctactgtgcttccagttgtataaaagtatagcacatgcaattatgtatagtacgtaataggtgataataataagtgattacattactagtttatgtaatttattgtactatttgtattattattttagactgtactccttctacttattaaaaaaaaaaagtaactgtaaaacagcctcaggcaagtccttcaggaggtatccagaagaaggcattgttttcataggcgatgacagctccatgcatatttttaatcctgaagacgacattccagttggacaagatatggcggtaaaagacagacatattgatactctagaccctgtgtaggcccaggctaaagtgtgtttgtttttaacaagaaagtttaaaaagtaacaaacatttttaaaacaaaaaaatttttaaatagaaaaaagcctatagaataaggacagaaatatttttgtgttgctatataatgtgtttgcgttttaagtgaagagtcactacaattcagaaagataaaaaatagtaagtttataatgtaaaaatattacaggaagctaaggttaatttattattgaagaaaacttaaaaaaataaatttagtgaagcctaagtgtactgcttgtaaagtctacagcagtatacagtaatgtcctagtccttagcattctctcacaactc

SEQ ID NO: 23294 - DNA, 1053 bp, Homo sapiens
gttatctctcattgctaccatagatattttatttctcttatagtacaaaaccaggagttaaaatatatttcttatctttcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgat

SEQ ID NO: 23295 - DNA, 1092 bp, Homo sapiens
tttctgcctacagacatctctcactctgcatcatcggattcatcctggagagaaactgtataaatccacagaatgtatggcttttaagtatggctcagaacttacacaacagcaagaaacccatactggtgaaaaactctataaatgtaaggagtgtgggaaggcctttcatcacttttcctatcttgttaaacatcagagaattcatactggggaaaagccctgtgcatgtaaagaatatggaaaagcttttatttctggctcacatcttattcaacaccagaaaatgtatacagatgagagacctcatgagtgtcaggaatccgtgaaggcctttagaccgtctgcacatcttattcaacattggagaattcatactggtgacaaaccttatgaatgtaaagaatgtgggaaatcttttacttctggctcaacactaaatcaacatcagcaaattcacactggtgagaaaccctatcattgtaagcaatgtggaaaatcttttactgttggctcaacactaattcgacaccagcaaattcacactggtgagaaaccgtatgattgtaaggaatgtggaaaatcttttgcttcaggctcagcactaattcgacatcagcgaattcacactggtgagaaaccctatgactgtaaggaatgtggaaaatcttttacttttcactcagctctaattcgacatcagcgaattcacactggtgagaaaccctatgattgtaaggaatgtgggaaatcttttacttttcgctcagggttaattggacaccaggcaattcacactggtgagaaaccctatgattgtaaagaatgtggaaaatcttttactgctggctcaacactaattcaacatcagcgaattcacactggtgagaaaccctatgattgtaaggagtgtgggaaatcttttgcttcgggctcagcactacttcaacatcagcggattcacactggtgagaaaccctattgttgtaaggaatgtggaaaatcttttacttttcgctcaacacgcaatcgacaccagcgaatccacactggtgagaaaccctataattgtaaagaatgtggaaaatcttt

SEQ ID NO: 23296 - DNA, 1029 bp, Homo sapiens
cataccactaactaaagttcaatatctagttacagctttttaggtaaaatgtacatacagtaaaattgtgtaatcttaaatttaccatttgaagaattttgacagattcaaatacttgtgcaaaccaaaatcctgtcaaagtgaagaaaaataccatcaccctagaaagttccttcatgctccttcctagtcatttcccactctatatccagaaacaactgccattctgatattttcccattgtagattaatttttgtctcttctagaacttcgtataattgggattgaaatatgtgttttttgtatgtaaggcttctttcactcagtataatgttttaaaaatgtatccatgttgtatgtgtgggtgtttgtggtatactcaatagttcttattgctgagttgtattccactctatgattgtatcacagtttattcatattcttgttgaacttttgtgctatttccaagtttttggctattatgaataatagtgtcataaacattcttggacatgtctgtttatgaacatctgttttcatttctctggggtaacacctaggaatggaattgttcagacacagtgtataggtgtatgttcagttttataagaaactgtcaaaccatacccaaagggattgcaccattttacactcccattaacaaagtatgagagtttcagtctccctacctctttgccaacatttggtgctgtctttctggctatatatctcattactgtcccacagtatttttaatttacatttttctaatgactaatgatgttgatcactttttatgtacttattggcaaaacatctttctttgtgaagtatctggtcaaaatttttgcccatctttaattggtttgttcatctttttattgttgagttatagaagttctttttttttttgagacagactcttgctctgtcacccaggctggagtgcaatctcggctcactgcaacctctgcctcccgggttaaagcaattatcctgtctcagcctcctgagtagctgggactaca

SEQ ID NO: 23297 - DNA, 1077 bp, Homo sapiens
atataataccaagttaggtatatctcatacatgaagtgcctactcactactgccattttgtgtcttaaaagacatctacagattcaacatgttcaaagttgaactctcaatcttcccctaaaaccctggaactgaagttttctccatcctggttgatgaaaacattgtattcccagatgctcaagactaaaatctttgacttaaagtcaccctagacttgtctcttttacatctagcccttaaacaaatcttgcttgctgtcacatttactatatacctagaatacaaccaataaccactatacccattgttacctcttcttccgaagccatgacatcctctttcatctgagttactacaacctcctcatcgatttttttcaacagttgtgtttccctcaaaataaagtatctttccaatggcttgcacgcttggcaagacatagctctctgttatctctcagttctgctctagcaaccatccctttgcacagtgttcttcaataacttctccacttttcctaaaacacttcagtgtagtcccattgtaggacctctctcctctgcctggaatcaccacactccttcaagtcttggctcaagtctatccttcttgatggtctaccttgatcactgtatttcacaaagcaatctaaatgatcatatccctcccattgtcttttcaatgactttttccccataacacttatattctaacatactctgtgtgtatgattatctcctcctgttagaattgttcactgacaaatatccaaaacacctaagatagtggctggaatatattaagtacctaataactgactacttttagaacaataggctcctgtgaggaaaacataaccatatttactagcagactgcctttgtatgcattggcagtggtctgatttcttgttcaggttgtcacattaaatcactgtaagtggattaagggtggaggattgagggcttgccatcatagataacatcttaccaaagcaatattgctttcaattgctgctagtgggctgcctagctctactctaaatttatctcgttcacaagacattactgaaag

SEQ ID NO: 23298 - DNA, 1078 bp, Homo sapiens
atacttagttcccagccatgacaggatggaaggttagacaggcctcattatacccctctcttttgtggtttaaatataacaactgaccaacatgaatgttaaaacagagatcataagattgacagaacagatgctttgtggcaataagacataagctggacgcaaagccatgccaggcaagggataggtcacatccccctacacttaaggaataaattcttttctggccaggcacagtggctcacgcctgtaatcccagtactttgggaggccaaggcgggaggatcacctgaggtcaggagttcgagaccagcctgaccaatatggtgaaaccccatctctattaaaaatacaaaattagctgggtgtggtggcgcatgcctgtaatcccagctactcaggaggctgaggcaggagaattgcttgaacccagaaggcagaggttatggtgaggtgaaagtccatctcaaaaataaataaataaataaataaaaagaataaagtatgttctaactgcctctaactgccacaaggtttttttttttttcctctctggcagctaaacaagcactggcctcaacataaacaatattaaaacaatttgcagctccaccagatgatgactgacctccacccactattccaccagctataactatagctttgactggacaagagactaacttcagtaactttctcctgatgaaaagaccactgagcacagactggtcctggctagtatacacacactgcgcacttgtgtggcttcctgacctgaaaagaccttttgatataataggacctaattgtaataaatttaaatgttgtgtctctaccccaaagtgaacatggttcatatgtcacacgcatgtttgttcagtgtgtatgtgtcaggaccacctgtaggaggtaaaataaattaaaatgggctgggtgcggtggctcatgcctataatcccagccctctgggaggccgaggcgggcagatcacgagatcaggagattgaagccatcctggctaacacggtgaaaccccgtctctactaaaaatacacacacacacacacacacacacaca

SEQ ID NO: 23299 - DNA, 1031 bp, Homo sapiens
cctgaattcagagacctgctcatacatgactttttttttcttagaataaagtaagctagagaaaaaaatgttattaagaaaatcaaaaggaagatatttgtattcaatattcattaagtgaaagtggatcatcgtaaaggtttttatctttgtcatcttcacatctgagctgactgaggagtaggaggaaaaggagagtttggttttgctggctcgggtggcagaggcggaagaggaggagaaggtggaaggggaggcaggagaggcatgcacactatatgtaacttttattgaaaaaaattcatgtatctgtggacttgcgtagttcaaacctgtgttgttcaggctcaactacaatttatattctctctcatcaattgtgcaatgagtctctgatcttccagtcttgtccattcccaaatgttatgtatgttttgaaaataatctttcttaagtaatatgtatatttcagttttttattttgaaattattacagattcataaggagttagaaaatatagtacaaagagttcccccataaattccagtttattgtggtacgtgattctttttagtgattcttgaattcagtttgctgacattttgttgggaatgtttgcatttaaattcatgagagatattggcctgtagtttttttttttgttactgtgtttgtctgattttgacattggagtaatactgggcttaaaaatattagtttggaagtgtttctcctcttttattttctggaagagattatgtaaaaatgacacattcttctttgtaagttcgatagaattctttggtaaaagctgggtatggtgatatgtgtctgtagtggcagctactcaggaggctgaggcaggaggatcgcttgagcccaggagttcgaggctgcagtgaccgatgatcacgccactgctcttcagcctggacgacagagcaagatcgtgtctcacaaaaaaaattaaaaagaagaagaaaaaaagaattctctggtagaactatctagcctagaggtttctttttcg

SEQ ID NO: 23300 - DNA, 1050 bp, Homo sapiens
gcagtaagccaagatcgcgccactgcactccagcctggggaacagagcaagactgtctcaaaaaaaaaatgaagtaaattaaaaacaacaaaacccatgttccgtaatcccatatatagtcactccaccgtgcaaagctgactatgcacattgaacaggaatgtgcccttacagggatcagtgtccttcagggatgtggctatcgatttcagcagagaggaatggcggcacctggacctttctcagagaaacctgtaccgggatgtgatgctggagacctacagccacctgctctcagtaggtaagcacagtcaccttggtatctgaaaggaggcctcactgagagtgttttcattctcagttgacgaatgctgttggcatcttagataggtgatggttttgtccttttttcctccagggttctctgtttgtttagggtactcagaatattactcagagatatctggttactttcctaaagaacaaaccatcattgaacaataagactgtatttgttgggctctgaaacgtaattagctggacccagacctttatcatttcccatgaacagggtatcaagttcctaaaccagaggtggtcatgttggagcaaggaaaggaaccatgggcactgcagggtgagaggccacgtcacagctgcccaggtgagtgaagtgaggtgaatgtgactcaggttagatgggagacaggaggaaatctcagctgtcttgaaaaacactggaacctgtgaagtgctattaagaccactcttcagtaaggctctgaattttttatattgcttgatgcctctcagatcactaaatgccttctacctggatgaccttccttgttgattataagtcatgtgccagtcagcctcattaaagataaatctttattatattccttttctgtaacagtctttttttccctgccttccatattgtcctagagtctctcgtttacatccaggtattcctggatctgctttctttcaaaatttactctgtgtcacacactcccactcgtgctacaccccttttatttctgt

SEQ ID NO: 23301 - DNA, 1050 bp, Homo sapiens
agaaaatgcttttaagaaaatcaaaaggaagagaaaatatatttattatttattaagtggaagtgaatcatcatgaaggtctttgcccttatggtcttcaggttaaggaggctgaggaagaggagagtttggccttgctgttttgggtggcaaagggggaagaggtgaaggtaaaagggagggcaggagagggaggcacactcggtgtaattttactgaaaaaagaaatctgtgttacaaatggacccacatagttcaaacccatgtggttcaaaggtgaactgtaattcacattctctcatgtgacttgtacagtgagtcttgtcaatgattttccagtcataactattccaaaatattccaaatgttttggaataatctttctttaggagtatattttttaaaactttttattttgaaataattatagatccacagagaattacaaaatgatacagagggttcccccatgaatttcagttattgtagtacacgattctttttattcattgctggattgtttgctgatattttgttgaggatgtttgtacctaaaattatgaaagatactggtctatagttttctttttttgtgctttctttggttttgatgtcagagtaatactggctgtacaaagttaatttggaagaggtcttcctctttgattttctggaagagtttgtgtaaaaatcacattaattcttcttcttcttcttttttttgagggggacagagttttgctcttgttgcccaggctggagtgcagtggcacaatcttggctcaccgcaacctctgcctcctgggttcaagcgattctcctgcctcagcctcccgagtagctgagattacaggcatgcaccaccacgcccaggtaattttgtatttttagtagagacggggtttctccatattggtaaggctggtcttgaactcctgacctcaggtgatctgcccgcctcagcttcccaaagtgctgggattacaggcatgagccaccacacccggccaagactaattcttctttgtaagtttggtagaattctctggc

SEQ ID NO: 23302 - DNA, 1051 bp, Homo sapiens
ggagtagaagcctttaaggaaaggcatatctattaagtgtagacttctaaaaatgagtaaagacataaagagtatagttttaaataggcctcctagttttctagaatatttttcatcattcagggtacgaataatggatccagagcatagaaaaagtatatgtttcaggaatacatgtgtacagatgtgaagaaatgctaaatgtggttgattaatgccactagtgacaattaggagacctaggtttgaggtggaaaaggcaatgattttttaaaatgttattttgtgttagggcacagattgctgtgaataaagtagtaatagcagctaagcagttttgttattttcttttttctttttctttctttttttttttttgaaacaggatctcgttctgttgcgcagactggagtgcagtggcacagtcacggctcactgcagcctcacactcgggctgaagtgatcctcccaccttagcatcctgagtagctgggactacagttgtgcaccaccatgcatggcggatttttttttttttttttgtagacacaaggtctgtgtctactgtgttgcccaggctggtcttgcacttctgggtccaagcgatcctcctgactcagcctcccaaagtcctagcattacagttgtgaaccactgcaccccactgtgttttattttcaattagtagataaaagtgtattaataagaaaattcttgttacagctattgtgctgaaatgaagtaaggctaaaactagtgttgagccctctgtcactgatggcagttatgggtgaaaaccaaattgggcagattcaccagttgctgctgccaggagaagcctaattagacagtgtcagggttggggttgagtgtggaaattttttggaattctcaaatgcttgagtataacaatcatgccgttaataataggaatccagtatctccaatacttttatatagaattgcctggaggctgctatgtttgtgtttgttaggctgtgttatcatccattaagtaaaaatgatataatttctgttgtttttcatccaa

SEQ ID NO: 23303 - DNA, 1026 bp, Homo sapiens
gtagcagagatgtaataattgtctaatccagagttcatagaaaaatttcaccaattgttacaattttgtccttatagctttttttttcttcttcttttttttgaaacggagcctcactctgtcccccaggctggagtgcggtggcgagatcttggctcactgcaagctccgcctcctgggttcacgccgttctcctgcctcagcctcccaagtagctgggactacaggtgcccaccaccacgcccagctaatttttttttatttttatttttttttactagagacagggtttcactgtgttagccaggatggtcttgatctcctgacctcgtgatccacccgccttggcctcctgaagtgctgggattacaggcatgagccaccgcatgcccagctccttatagcctttttttgccccttatctggcgtccaatccaaaatcatatctaggatcaaacatttaatttaattaaatcatctctttagtctcttttaatggaaaacaattcctggacttttctttgatcctttgtgatcctgacttttttgaaaactacaggcctgttattttgtagattgttcctcagtttgtatgtgtttgatgtttcctcatgattcaattcaagtgtgctttttttttttttttttttttttgagatggagtcttgctctgttgcccaggctggagtgcagtggcgcgatcttggctcactgtaacctccaactcccgggttcaagcaattctttgcctcagcctcccaagtagctgggattacagatgcccgccaccacgcctggctaatttttgcatttttttgtaggaatactgcttcagttcattggccagcaccttcagttagttgctttttgtattatgtccagatctgataggtgtatcttcaaggaacttagtccagtaggatcttaatgatattggattcagaagtcttctcaatttcgtttcaatttgaatttctctttatttaaatgatgagcattttacatgttgaatgaccgttgactttt

SEQ ID NO: 23304 - DNA, 1068 bp, Homo sapiens
acaccaggttgatttttgtatttttagtagagatggggtttcaccatgttggccaagctggtctcaactcctgacctcaggtgatccacctgccttggcctcccaaggtgctgggattacaggcgtgagccaccatgcccgactctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttggtttttttgtgtgtgtttctttaaaagataccaatatagtcaagacctttgcagttttgatcacagaaatatgaaagattacacagctacagctatatgaatgataaaagtgacagctatggatttttaaagttataagttgctatactacatatatgtaatgtgtgtgtgtatagtgtgtaggtatatatatttatatttatacacacactatacatgtattttaaaatattgaaaatccagaattattttatggtaaaaattactaaaattgacttcacatgctgaatgaagagagcctgagtagaccaacaaacaaatgaaaaattaagacggttagaagatacgctttctaaaagaatacatttagaatctaactttaaaaaaaaaaaatcctactctcctgagccagagtggtctcagagagactccgagaacctaattttttacaagtaaaatctttgaagaattggtaattgctaaatttttccaacatactattctacaagactaacctaaaact

SEQ ID NO: 23305 - DNA, 1035 bp, Homo sapiens
cacacgcctgtagtcccagctactagggaggctgaggcaggagaatcgcttgaacttgggaggcggaggctgcagtgagctgagatcgtgcctctgcactccagcctgggcaacagcatgagactccgtctcaaaaacacaaacagcaaataaaaaaacctgaagtccaattcccttccctttgcatgtgagctgaacctagatgaacagaatcttcaggatcacctttccctggtgctcatgctcacttgttcattcactctcgtgcaaatccggcctcctctacctagggcttctgcagaggctgctgacagagccatttatagaagtttcattgaatggtgattctcataattgtcacattagatattgctggagtcttaaccaagggtttttaacagtcatactctatctgttctttggagaacagataacctgcctgtgaagtgcccactctgctccctctctgaaataatcattgtgttaatgttgaggccatgcttcctatgggctgcccccagctccttttctgagcataacataagtattcatgctagtcaattcttacgaaacccagacccttcagctggggaactgtgaatcagccaggctgaaactgttttcatactgccccgcgttttcatagtttttctaccaatcttgcttcatccctctccttcagagtcatccatcttgtaccatggcctgaaggctttcactgcctttcctggacctctttttcattcatagccccctccttccttctgatctgatcttgctttttgcttttcagaggatcaaaatgaacacataccctaaggttacctacatactatgtttccctaacagcactctggattttatctttgtccagagactatttctgaagtttagcatcatttgctttctggagaggctgggagtttccaaaagcaagtcctggttcacttctgtttaacagtctttttctagcttatctcacttctagcacttaagcaacaagaagcaagacaccttcaacattctgcttgggag

SEQ ID NO: 23306 - DNA, 1015 bp, Homo sapiens
agctttttagtttaattaagtcccatctatttatctttacttgtgttgcatttgcttttgggttcttggtcatgaactctttgcctaagccaatgtgtagaagagtttttccaatgttatcttctagaatttttatggtttcaggtcttagatttaagtctttgatccatcttgagttgatttttctctaaggtgagagatgaagctccagtttcattcttctacacgtggcttgccaattatcccagtaccattttttgaatagtgtgtcttttccccactttatgtttttgtttactttgtcgaagatcagttggctgtaagtatttggctttattctgggttctctattctcttccattggtctacatgcctgtttttataccagtcccatgctgttttggtaacgattgtcttgtagtatagtttgaagtcagggaatgttatgtctccagatttgttctttttgcttagtcttgctttgaccatgcgggctctttttttgttccatatgcattttaggattgttttttctaattctgtgaagaatggtgatggtattttgatggaaattgcattgaatttatagatcgcttttggcagtatggtcattttcgccatactgattctacctatccatgagcgggggatgtgcttccatctgtttgtgtcatctatgatttccttcagcagtgttttgtagttttccttgtagagatctttcacctccttgattaggtatattcctaagtttgtttgtttttgttttgttttgttttgtttttgttttcttttgtggttttttttttttttttgcagctgttgtaaaagaggttgagttcttgatttgattctcagcttagccgatgttggtatatagcaatgctactgatttgtgtacattaattttgtatcttgaaactttactgaatttatttgtcagatctaggggctttttgggtaagtctttagggttttctaggtatatgattatatcatcggcgaacagcaagtt

SEQ ID NO: 23307 - DNA, 1049 bp, Homo sapiens
gtgtgtgaggtttgtctgtttctcctttgtgagtattgggatttgtctctctttgtgtgtgaatcccgtgtgactgtgtgtgatttgtgttgtgtgtctgcatgtgttcaggtagggatacgtcccggtgtgtttttgtttgtttctgtatcgtgtttctactcatgagctgggggcctgtttgagtcccagtttgggggcccctgggccctgtccccttcccccagcctgggtcccggagtgggaggaggggagaggtgaggctggaggggtcggcccacccctcccgagcctgggcggcccggcagccggggaaggggtgctgggcgaccctgtgcgcctgcccttgctgacagccgcccgcccgttcgccgcccctctagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtaccgccgggagggctggcgcagggcggggcggggccaggccgccccaccgccgccgccctctcacccccctctctctccaggtttggccccgggacagatttacacgtaccccgcccgctgttggaggaagaaacggagactcaacatcctggaggaccccagactcaggccctgcgagtacaagatcggtgggtgcagccgctggggcccccatcggtgtcccagcgcctgctgtgtgtcctagcactcgtccatcacctttatcgccttctagcaagtgtctgcctggctggctgtgtgtctgtctgcccatgtgcgtcccgggtgtttcccagagattccacagtttctctgagtcactgagtggcgactgcatctcctcctacatgggcccaggtgcccagttgttgttatttatttatttatttatttatttatttatttttgagacagagtttcacccaggctggcgtgcaatggcgtgatcccccaacctccacct

SEQ ID NO: 23308 - DNA, 1018 bp, Homo sapiens
ggtttcggtgagccaagatcacaccactgcactccagcctgggcgacacagtgagactccgtctcaacaaagaaaaaaatatatagatataaaagataagtgtcaggccgggcatggtggctcacgcccagcactttgggaggccgaggcaggtggatcacctgaggtcaggagttggagaccagcctggccaacatggtgaaaccctgtctctactaaaaatacaaaatttagccagccatggtggcaggtgcctgcaatcccagctacttgggaggctgacccaggataatcacttgaacccgggaggcagaggttgcagtgagccgagattgcgccattgcactccagcctgggtgatggagcgaggctccatctcaaaaaaaaaaaaaaaaaaaaaaaaaaaaaaagtgtcttaatcagtgtgggctgctgtaacaaatatagagagggtggcttcaacaggaaacagttctcacggtcctggaggctggaagtctgagataggggtgttggtagatccagtgtcaggagtgccgcttcctggctcgttgacagccaccttctcccttcctcccggcatggcccagagcaagatcatctcatgttgtgtccctttctataagggcacaaatcccattaataagggctccacccacatcacctgatgacctcccagaggtcctacctccaaataccatcactcagcttcagcacaggagtttggggaagacacaaacattcaacccctactgttccaacccctgcttcacagatgagaaaactgagggagtaggtaagaagacgaggggcaaacatatagcatgggccaggtgaagtggttcatgcctgtaatcctagcactttgggagggaagcaaggcaggaggatcacttgggcccaagagtttgaaatcagcctgggcaacatactgagaccatctctacataaaattaaaacttagccaggcatggtggcactcgcctgtagttccagctacttgagaggctgaggcggg

SEQ ID NO: 23309 - DNA, 1031 bp, Homo sapiens
gggtcacgaagggcccgagtcccctaaattcaggggtgcgtgtgctcccttttgaaggactccctaattcgataggcctgtgtcttgcagtctggggtcatcaaaggctgttcctttctccccaggactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggaggtctgacctgcagatcctggaggcctgcctgcggggggaggcggggctgcgggactgggtgaaagtggaacgttgtgggaagatggacatgagggcagggtattcccgccccatttgtaacccttcactcgttgcttcacagagagatggtagagtgcttcaacaagatttcgagagacgctgactgtcgggcggtggtgatctctggtgcaggaaaaatgttcactgcaggtaccagacgctcttcacacaccctgccagccttcctagctcctggcaatagacagtggagcagtgcttctgaattagggttttaagcagcttctgacttacacactttttttttttttttttgagacggggtcttgctctgttgccacgctggagtgcagtagcgcaatctcagctcactgcaacctccacctcccgggttcaagcaattcttctgtctgggactacaggcgtgggccaccacacccagctaatttttgtatttttagtagagacggggtttcaccatattggccaggatggtctccatctcctgacgttatgatctgcctgcctcagcctcccaaagtgctgggattataggcctgaaccattgctcctggcccctaactcacacttttatctgtgtgtttttttttttttttttggagacaatatctttctctgtcacccaggctggagtacag

SEQ ID NO: 23310 - DNA, 1087 bp, Homo sapiens
cactctgttacctaggaaagaggcaacactatccagcaggtaaaacttgcccacccagttgctgggagaggcccattgccttgggctggcgaaggagataggaatgggattctctatgggaatgaaggaagagaaggagaaacgccgtgcataattggtaattggctcatcttgaagcctcacgttgggcagtcactccttagacccctgccgttgacctgcagaaaatgggagatgggtacaaacttgaggggacctgggtttggggagcctccaaagacgggaaccaaccaaacttgtctctcctttgcagatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcacttgctgggattccaggatgtctgcttttctccctctctgtcctgaagacacaggcaggcctgagcacagtcacaggccctctggaggcatacagagacccaagaggagcagggtgggctgcagactgagaatggtgctagcaattgagtctttgaggaaaatccatcaggcttagtggcattcttactgggccctgcccgagcaagctctatcaggcccagtgggtcatcacacctataattccagcaatctggggaggccaaggtggggcacatactttgagctcaggagttgaagaccagcctgggcagcatggtgaaacgtcactacaaaaaggtgggtttggtggaacacctgtagtcccagctactcgggaggct

SEQ ID NO: 23311 - DNA, 1027 bp, Homo sapiens
gccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagaaaatacagatttgttttttgtgacaaatggacattgtactctgtacttctgctgtaagtagtccttttccattttgtaatgactggtaacaaaacccaggccgggtggcaggaaagggcagtggtttcgagccctgggttttggagtcagccagacctgggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcag

SEQ ID NO: 23312 - DNA, 1035 bp, Homo sapiens
ctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatcttaggggagagagcagtgtgttgggagatacaaaggaatttatttttctttttgttttctttctgttatttacttatttatttattgagatggagtttagcccttgttgcctgggctggagtgcagtggtgcgatctcagctcactgcaacctctgcctcctgggttcaagcaattctcctgcctcagccttcctagtaggattataggcgcctgctaattttttttatttttagtagagatctggtttcgaactcctgacctcaggcaatccacttgcctcagcctcccagattacaggtgtgagccaccgcgcctggctaggaatttatttttaaagatgtttattctaagttcaaatatgagtgacaaagatttggggaacatagtctcaagaggtcctgagaaaatgtgcccctgggaaaaggaatttatttaaaaggggatatggggccgggcacagtggctcatgcctgcaatcccagcactttcggaggccgaggtggacagatacctgaggtcaggagttcgagaccagcctagccaacgtggtgaaaccctgtcgctaataatacaaaaaatagccaggcatggtggtgaacgcctgtaatcccagctactctggaggctgaggcaggagaatcgcttgagcctgggaggcggagattgcagtgagccgagactgtgccactgtattccatcctgggcaacacagcgagactccatatccaaaaaaaaaaaaaaaaggtggggcatgtgtgaaggttgctgagga

SEQ ID NO: 23313 - DNA, 1032 bp, Homo sapiens
cactgtgtacagcctgaaagagtgccagcccacccacacccctgagattgcctttcagacgtggggtggtgcagaagcgggcatcagaatacctcacaaatgcacagtggagctttgctaaggatataagagcctcctgttaggctgtggcaactcactcgcctggctcccaaagcacgaccactgtcagagaaaaaggttgaatgttaaaaaggatcctcagtcccaaagagagagaggcgaggatgtaaaatgcagcattgtccgtcacagggcaaaactggaaacagtccaaatggctgtcagtggatgggttaaatgaactatggttcatccatacaatccaatactatgtagctgctctgaaaaacgaggtgaggccgggcacggtggctcacacctgtaatcccagcactttgggaggcagggggatcacttgagcccaggagttttgagaccagcctgggcaacatagcaagatgccgtctcttttttaaaaaattattttttaaattaggtgggtctgtagcatattgttctgccgaaaactcaagatgttgtattgtactatgacctatttctgtaaaaaatattagttttatgcagagaaaactggagtaatttccattaagcttagctaacagtggttatctttataagggtgggcttgggcaattacaaggtgagtgccgcaagttatatgttgttgaagtatacatgagtataatcaaggtttttgcagaggttgtccaatctctctttctctctgtctctctctctctctcattctcactctctctttctctctctctttttttttgagacggagtctcgctctgtcacccaggctggagtgcagtggggtgatctcgctgactgcaacctccacctcccaggttcaagcgattctcctgcctcagcctcctgaatagctgggactacagacacgtgccaccatgcctggctaattttttgtatttttattagacacggggtttcatcatgttggccaggatggtctcgatctcctga

SEQ ID NO: 23314 - DNA, 1029 bp, Homo sapiens
tagtgccacctttccgtgactcctgctgtctccctgcagcccgtcggggatgagagccaggctcgagtgctccacatggtcggagacaagccaggtgggccacaccccaggcctgggagctgacaagccctgcggtgtgggggttctggggtctcggggtgggggcccctggggtctgggaacatgtctggagcctggagaactcctggcggtacaggaggtggctccagcttcctgccttggccgagctcgagctgtctctgagaggcggtccttgggttttcattctctcccccttcaccattgggcagtctcaccctgtgttgtgtgattgtatcgtatgtgtgtgagtgtgtgtcgtgtatgtatgtgttgtgtgactgtgtgtcatgtgtgtctgtatctgtgtgtctgtatctgtatgtgtgtgtctgtatctgtgtatctgtgtgtgtctgtatctgtgtatctgtgtgtgtctgtatctgtgtgtgtgtgtctgtgtttgtgtgtgtctgtatctgtgtctgtgtctgtgtgtgtgtgtctatgtgtgtgtctatctctgtgtgtgtatatctgtgtttgtgtgtgtgtgtgtctgtgtgtgtctatgtatctgtgtgtatgtatctgtgtgtctttctctgtgtctgtgtgtatgtgtctgtctctgtgtgtctgtgtgtgtatctgcatatctccgtgtatctctgtgtgtatgtctgtatctgtgtctgtgtatctgtgtctttgtgtgtatctgtgtgtgcgtgtctgtctttgtgtgtctgtatccgtgtatctgtgtgtctgtctctgcgtgtctgtgtatgtgtctgtctctgtgtgtctgtatatgtgtgtgtgtcttcgtacctctgtgtgtatctctgtgtgtgtatgtatgtgtgtgagtgtgtgtgtgtctctgtctctctctctgacccccctgctttggtccctgtctccggggctttttctccccaactctgtgcctcctctctgattctcctcctcccttcctcg

SEQ ID NO: 23315 - DNA, 1033 bp, Homo sapiens
aacaccggtgcctggggctccttcgcagacctgcttcgtgacctctttcgagtgagtggcccaagtgagaggccccgatccctggggcaaaggccccaaagaaagggaccctaccccccacactgtcctcatcgtcaccttcaccctctccttcccccatttatttattcattgattcattccatcaatcaacaaatacttgttgagggtactgtttcatatgccagggatacaaggaaagatcaggaaggttagcaaccacaggcagcaatgctctgtgcatcatcgcctgcagtttgtgagacaacagcaagacagctttgatctaaagacagggttttgggccgggcacggtggctctcgcctgtaatcccagcactttgagagcccgaggtgggcagatcactttaggtcaggagtgcgagaccagcctggccaacagggggaaaccccgtctctactaaaaagacaaaaattagctggacgtggaggctgaggcaggagaatcgcttgaacccaggaggcaaatgttgcagtgagccgagattgcaccactgcactccagcctgggcgacagaatgagactctgtctcaaaaaaaaaaaaaaagggaacatggcagattagcacccaagatggagtcgcttttgcctccacaaggagttactctatactagacactttacatataattctggcaacaaccctgtgacatagatactattattgcccccactttataacaggaaactgaaggccgggcacggtggctcatagctgtaatcccagcactttgggaggccgaagtgggaggatctcttgagcccaggagtttgaggttgcagtgagcctaggatcatgccactgcactccagcctggcaacagaataagaccttgactcaaaagaaaagaaaaaatgagaatctgttctccatggaatgatggtgccacctctacagtttatgaagtttctgtgtatacctacgtctgtccctggcactctgttttttttgtttttgtttttgttttttga

SEQ ID NO: 23316 - DNA, 1903 bp, Homo sapiens
gcatgggagggtgagggggagtaaaatatgaaagggacaacggatgggagatcacagtgggttggaaggatcatgcgagtggggcactggagggaatgaggtggaaagaaaaagtgatgggtggagagtgagtgtgagattgaggttctgaagaggctgctgttattcaaacaaggtctgggtttgaccacgagagggagatgttggggaaggaaaaagtcactagagagaggtcagggaacagagaggttggggctgcggaagaactatctggttatagaaatcactgagaatgatgctaagagcagcgggagcggccgtgagcccagagctaaaattagggagaagagaggagtcatgatctgggtcagcagatgacgcatgaagcaaggtagtgatgagattcatcgctgggggttttggggagggtggagggagaatggtcaggaagtagctcccaggagcacggagacctccccacttggaaggcccacaggagagctgggttccagttagagcaagaaggtggtaggaatgttcagagaagtaactgaggcaagaagagattttgttgaagatgggtcatgggttccaaaggtcacagtagctggcacacattggggtatggggtagaaatggtttcttccgcagtgggtttccttgtgggtctgtaacccgactgaggtttggccgctcaacactcaaaagccaaactcaggccaggcgtggtggctcacgcctgaaatcccagcattttgggaagctgagacaggtggatcacttgaggtcaggagtttgagaccagccggctaacatggtgaaaccccatctctactacagaaattactggctcggtgtggtggcacacatctgtaattccagctacttgggaggctgaggcaggagaatcgcttgaacccgggaggcggaggtcgcagtgagccaagattgtgccactgcactccagcctgggcaacagagtaagactcggtttcagaaaagaaagccaaactcgggccgagcgtggtggctcaagcctataatcccagcacttcgggaggccgaggtgggtggatcacctgaggtctggagttcgagactagcatggccaacatggtgaaactgtctctccttaaagatacaaaaattagccaggtgtggtggtgcattcctgtagtcccagctactcgggaggctgaggcaggagaatcacttgaacctgggagacagaggttgcagtgagccgagacgggccactgcattccagcctgggtgacagagtgaggctgcctcaaaaaaaaaaaaaaaaatagaaagccaaactcaagagagatgacagttggtgggaggaaaagcaagtttatttggagagccagcaaaccgagaacacagtggactatcatcctaaagtaccatcttaaatcagtacaattttttttttttttaggggcagagggaagagaagggcattgtgatcaagaggtgaccaacaggccaggcgcagtgactcataccaattccagcactttgggaggctgaggcaggaggatcacttgaacccaggaattcaagaccagccagggcaatgtagtgagaccccatctctacaaaacaataaataaaataaaaaactagctgggcatagtggcatgcacctatagtcccagctacttgggaggctgaggcaggaggatcactcgagcccaggaggtagaggctatagtcctggtttctagctccataaaaaagtaataataataaaaataaggaggtgaccactgcagacatctgagtgccagctagggtccgaggaggttgatgacttctttgtccttggttgggtcacaatgcccctataaatctttgaaaaaacaggctgggcgtggtggctcacacctgtaat

SEQ ID NO: 23317 - DNA, 1199 bp, Homo sapiens
aataataataataataataataataataataataataataataataaaataacacattgtcagggcaggcgcagtggctcacgcctgttaatcccaacaccttgggaggctgaggtgggcggatcacctgaggtcaggagtttgagaacagcctggccaacatggtgaaaccctgtctctactaaaaatataaaaattagccaggtgtggtggcgggcgcctataatcccagctactcaggaggctgaggcaggagaattgcttaaacctgggaggtgaaggctgcagtgagctgagatcgcgccactgcactccagcctgggcaacaagagtgaaactctgtctcaaaaaaaaaaaaaaaaaacacattctcggcccggcgcagtggctcacacctgtaatcctagcactttgggaggctgaggcaggtggattacctgagttcgggagttcgagaccagcctggccaacatggtgaaaccctgtctctactaaaaatataaaaattagccaggcgtggtggcagaggcctgtaatcccagctacttgggaggctgaggtaggagaatcgcttgaacccaggaggtggaggttgcagtgagctgaaatcgcgccactgcactccagcctaggccacagatcgagactccatctcaaaaaagtaaataaataaaaaataacacattctctgcacacacccttgcccactttggcttcctcctgcatgagaccctggttaaatccagccttcctctctgccgtgcctgcacccacacagcttgagtgagctaaaaaacaacacagccccctggccaggctaatttcaagtctgtgaacttgaccctcaggcggaccccaatgctgcctggcagccatatgacatttctctgatcccctccttcctcctgtcttctagacaactaattcacaccttttcccttctcctctaatcctttccaacacctcctccccccctttcactctcccttggcttcttattttgcagagaaaatgcaagagatgagaagtgaacttccacagccacccccgcctctaccacctacctgcacccttgcccacacccgttctcctgctgtgactgtcccatcacctgctcccaccttcccgcccacttccagccaccgtccctggttctcacctctctctgctgctcattcagtttcccccatgcactggat

SEQ ID NO: 23318 - DNA, 1038 bp, Homo sapiens
tacttcagtaaaaaatgtccagtgggccaggcacaatggctcatgcctataatcccagcacttcgggaagccaaggcaggaggatcacttgagctcaggaggttgagaccagcctggccaacgtggtgaaaccctgtctctactaaaaatacaaaaattagcagagcatggtggcagagtagctgtaatcccagctacctgggagtctgaggcacaagaatcacttgaacccagaaggtggaggttgcagtgagtcgagatcatgccactgcactccagcctgggcgatagagtgagattcagtctcaaaaaaaaaaaaaaaaaaaaaaaaaagcccagtggtttccaaagtgattccaaatggattccaccaggaatgtatgggagttctctttgatagtatttttagtgaattgcagtaacattgcactgttttgtgtttgctcattttcttttttcttttctttctttttttttttttttggagatggagtctctgtcacccaggctggagtgcagtggcgggatcttggctcactgtagcctcaacttctgggctcaagcgatcctcccacctcagcctctctaataactgggactacacacacacgccaccatgccctgctaatttttttgtagagacgggggtctcactatgttgcccaggctcgtcttgaactcgtgggctcaagcgatcatcccaccttagcctcccaaagtgctgggattacaggtgtgagccatcgcacccagctgtacatttgcttttacattgtcaaggtggaaacatctacagtctgttctgtttccatatttaagccctacatgctttaattgcaaagtttgctgtgtttttttaatcagcttttttgaggtgtaatttacataccaaaaaattcagccctgttaaagtggacaactttgtggcttttagtgactttacagagttgtgcaaccatcaccaccgtaacaaagcatgttcatcacccccaaaatatcccttgtgcctatttgtagtcactctgttcccagcctagc

SEQ ID NO: 23319 - DNA, 1056 bp, Homo sapiens
aaccccctgcactgcaactgcgagctgctctggctgcggcggctgacccgcgaggacgacttagagacctgcgccacgcccgaacacctcaccgaccgctacttctggtccatccccgaggaggagttcctgtgtgagcccccgctgatcacacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccgagctcacctcgaactccgtgctcatccgctggccagcccagaggcctgtgcccggaatacgcatgtaccaggttcagtacaacagttccgttgatgactccctcgtctacaggtgggtgcgggtgctgcagtcccagggcctcctcccaagcccagggggaccctccctcccacctgcccattcccttggccttcttgctcagccagggttctagatggctgtgagagctgttcccgccctcctttgccctgtctcctctctctatttctcactgtctctgtttttcgtgcttatagaaaatattcgctgagcacctacatgaacccgaccagggctgggcactggagtcctaacagtgactgagctcagcatgaaccctgccctcatggggctcatggtcgatatcactgctccccacaacaatctgattgtgcacctcttcagttaaacattttggagcatgaaacacacacacacatttacagtgacatttatttatttgtttgttttgaga

SEQ ID NO: 23320 - DNA, 1035 bp, Homo sapiens
gcctgcagtattcagtacagtcacatgctgtacaaccttgtagcctaggagcaataggctacaccattacagcctaggtatgtagtaggctatactatgtacgtttgtgtaagagtactgtatgatgttcacatgatgtatatctcagaatgtgtccctgttaaatggcccatgcccgtatttatgtaaatacaccgtataacacacacacacagtgtagggcaaccaaactggtgccatgggagccatccttcctttcccctgccctcaataccttgagcttagctgcccttattcaatctgtatttattcccatttactctaagtattgatggggaaccaagtcagaccagacccctcactggggggcggggaagtgggaggtgtgtctttaactgcatcttccacttctctctcccaaattcaccccctgcagggtccgccttagtaagcgccgggccaaggctggggttcagtcaggcaccaacgccctgcttgtggtcaaacatcgggacatgaatgagaaggaactggaagctcaggtaacaagcaccactggctcagggcacccatggcagggagggtggtggttgtaggtgaggagggggacaaaaacccagcagaacaccctccttcccctcattccaatcttgctgcttccaggaggcacggaaggcccagctagaaaaccacgaaccggaggaggaagaggaagaggagatggagacagaagagaaagaagctgggggctcaggtaaatctggacaggccagactctgggagccctgggagggtggaaaagtgggtttcatctctctccactcccttccagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggac

SEQ ID NO: 23321 - DNA, 1050 bp, Homo sapiens
cttcccagactttaaggtcaggcccaaggtgggaggtagaaagggacagcctatttgtgcctgttcccatctaaccccagtgcctccatctccctagatgtggatcaatccatgtgctcaggtgatctttgactcagacccagcccccaaggacacgagtggtgcagctgcgttggagatgatgtctcaggccatgattaggtaggtggtcctgctgtccaccttggcctgctccttgctgcctcttgtcctcacacttcattgctactccttttcccccaaccaggggcatgatggatgaggaagggaaccagtttgtggcctatttcctgcctgtagaagagacgttgaagaaacgaaagcgggaccaggaggaggagatggactatgcaccagatgatgtgtgcgtgggttgcggttaagttttggggattgggaagttttggggattgggatagggaagaaatggggctgaacctgtgccctcatcttcaggtatgactacaaaattgctcgggagtacaactggaacgtgaagaacaaagctagcaagggctatgaggaaaactacttcttcatcttccgagagggtgacggggtttactacaatgagttggaaaccaggtactcagcacactcctatctgattagcctggatctgtgcttcttaagaccctggggcatgcaagagccaccttggaggtcatttgtacctaagaatttgtcatatgcattggtaaacaagagcagcagatgtctggtcatgcacatgagctggacttggttctaacaggaggagccagaaaaaaaatctttttttttgagatggagtctcgctctgttgcccaggccagagtgcagtggtgtgatctcagcccactgcaacctccgcttcctgggttcaagtgattctcctgcctcagcctcctgagtagctggcatcacaggcgtgtgccagcatggccagctaattttttttgtatttttaatagagatggggtttcaccatgctggccaggctggtcttgaactcctgacctcaggtgatct

SEQ ID NO: 23322 - DNA, 1122 bp, Homo sapiens
agtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaatgtgagtgagcatgggtccttcccatgaggtagatgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaactgtgtgtggccttatgtgttggtattggatgtttaaccagacagaaatcagtaaacatcctggacctattgccagtctggattttgaccctccccagaagtggtcgcgctgggcttggtgtgggtgagtggaagcagaaggcagggggtctctgtctctacacctccagtagagtccagtgtgcaggcaaagctgagatggcagtcgtttggggccattagtggctgcagaccttggcggatatatggctcatccttgtggatgtctatttttttcaagcccagcctcccaaatagcttggattacaggtacccaccaccacgccatgctaattttgtatttttagtatcgatgggtttcactgtgttggtcaggctggtctcaaactcctgacctcaagtgatccgccttcccgggcctcccaaagtgctgggattacaggcgagagccaccaccc

SEQ ID NO: 23323 - DNA, 1173 bp, Homo sapiens
ccttcccttcagtccgcacacgacactcccaggccccgccccttccgcccacagagcccgccacttccgcctcacagggcccgcccgctctgagcgcctaagggccttcccgccgctgaccagacgccccgcccgttagccgcaacagaagccgtaaagctctctcccgtcgcgacgcagtgctcaaggcgcctgcgcagaccctgaaaagcggccagggtggcccctagctttccttttccggttgcggcgccgcgcggtgaggttgtctagtccacgctcggagccatgccgtccaagggcccgctgcagtctgtgcaggtcttcggacgcaaggtgagccagacgccggatgggaaggggaggggaaggagaaggccagggtctgggagaggtcggtgggcaggaatctagggggtaacatgggagctggagccggagctcacggggcccctgtttctcttgtatcttacagaagacagcgacagctgtggcgcactgcaaacgcggcaatggtctcatcaaggtgaacgggcggcccctggagatgattgagccgcgcacgctacagtacaaggtgctgggatccggcaccggcgttgagtggatggaggactcttggagacagagatgttgtagctcttgaaagctgggggggctggcatcagcaacgggatgtttagaagttgtgttgggtgtagaacagtggggtatttggcaatagagctgggcttggggttcagaagatgtaaaagctgagatggggttgttgaagattaagggtttgctttgagaactgggatgttaggaagctcacctcactggggcggggggacccaaagggtgaagggacaccgactattttttattttatttatttgttttgagagggagtctcgctgtgtcgcccaggctggagtgtagtggcgcgatctcggatcactgcaaccttcgcctcccgggttaaagcgattctcctgcctcagcctcttgagtagctgagattacaggcatgcaccaccacgcccggctaatttttgtatttttagtagagacggggtttcgccatattggccagagtggtctcgaactcattacctcaggtgatccaccagcctcggcctcccgaagtgctgggattgcaggcgtcagccaccgtgtgcggccgaattt

SEQ ID NO: 23324 - DNA, 1050 bp, Homo sapiens
aggagttcaagaccagcctggccaatatggtgaaaccccatctctactaaaaatacaaaaaaaaaaaaaaaaaaaatagccaggtgtggtggcgcacgcctgtaatcccagctacttgggaggctgaggcaggagaatcacttgaaccagggaggtgaaggttgcagtgagcagagatcgcaccactgcactccagcctgggcaacagagtgagactcgtctcaaaagaaaaacaaattttggtacatccatccatgcaacagaatagtaacaactaccaatacacccatgactgaatctccaaaacattatgctgagtgaaagaagccagacatcaggagatgtccagcatgattccattcatatgaaactccagagcaagcaaaaccaacctatacagacaatgcagattagtggatgtctggggctggagagggaggtggaaattgactgggaagagagagaaggaatgctttggggtgatggaaatgtggccatccagtccaccagccggtgcactccagcctgggtgacaaagggagactctgtctcaaaaaaaaaaaaaaaatgtcaggtgtggtggctcatgcctataatcccagcactttgggaggccaaggggggagtatcgcttgagccaggagttcaagattagcctgggcaataaagggtaaccccatctctacaaaaaatacaaaaattagctgagtgtggtggcatgcgcctatagcgctagctacttgggggactgaggtgggagagtcacttgagcctgaaagatcgagcctgcaatgagttttgatcatgccactgcactccagcctgggtgacagagtgagaccctgtctcaaaaaaatatatgggcagatgccaagttacagcctgtgcagcatagtgaaaccctgtctctaaataataataaaaataatatagatgctcaggcttcaccagagaccaattatcaaattatctgggctggggtctggccatcagtattacttgaaagttctccaagtggtgggctgggcacggtggctcacgcctgtaatc

SEQ ID NO: 23325 - DNA, 1944 bp, Homo sapiens
tgagactcaaaaaaaaaaaaaaaaaaaacctcaggctttaatcaggcaagttacctaacccatccaagcctcagtttacctgtctggaacatagacttgtgaagattaaatgagttaatttctgaaaggtgcttagagcagtggttggcccattgttacatcatctctgtgccttggcttcctggttttaagcctctgttgggaacctgggctctcaggcagatgggattgggtacttttgctacttgctgaataactcttggccagtgactttatgtctggacctcagtttattcatgtgaaaaatggacatgatagcaatagtcattagatggtagggttttgatttgggggttggaagagatgctgtgtatagtgtatgggcctaaagtaggcactccatgcatgagaactagcatcactgttcattaatttttaatttattttaggatggtctagtctatgcagtcgagttctcccaccgctctggccgtgacctcattaacttggccaagaagaggaccaacatcattcctgtgatcgaggatgctcgacacccacacaaataccgcatgctcatcggtgaggggtctgggggtggccccggtggggtaggacaggccaccgcaggcttctggaagaagccagtggatctctgattcggatggagttggagtggatgagcagacctcttgagtctgcaggaatagaaaggggtaaggggagctaggtgaggttgtggaggtggcagcttggcttcagagtcttggaagccacccttggagggccaacctcttctccttcagtctcctccccatctcctaggtctcctgtacttcctgcctcttgtatttattacactacccctccataaaaagcctccttttgggggtcctaatcattgtctggtgagagcatatcccagaaaactaagcatggcttgatctggaggggcccactgtgaatattaattactttgtttaaaaaaacattcaaagatataatataaaagttgaaaagccttataaaccaccgccagaagtaactgatgagaacaatttgatgtctgcttttcccaggttttaaataatcagttttcattataccaccttttcattttttgaaaagtcacactggcttaaaaacattatttttcattctgctcctttttctttctgtgttttatttttcccatgcactcataccatcccctttgttctgcaacttgttttcatttcacagtcctgcggacactcttgcctataagtgctcactcactcttacttgtctttttgatgacgtgtctgtctccccaccagacctgggagcgtctcgagggcagggtccgggtctgactcgtctctatgtcccccacgcccggcccagggctggccacagagtaggtggcaaccatggtttacaagaagagtggatgaatgatgtgactgtgggttttggactcatcttgggacactggagggagggggaccagtggaggtggggagtgaaactggaggcagggagaatctcccaggaacctgctggtgatgggcataggccccatgggaggatctggggtgatccctgtgactccaacttttaactgctgctcctttctccttagcaatggtggatgtgatctttgctgatgtggcccagccagaccagacccggattgtggccctgaatgcccacaccttcctgcgtaatggaggacactttgtgatttccattaaggtgcggggtttggaagagtctaagatggggtggcagtgttctagggaggtatcttctctatctgtatctgtcaaatagccacccaaaacagaggggccaagtctgcaaaactatagctttggatttaaagaggcaggagagtgcagcggtcaagtgcaaaattgagtctgaccatctgagtttaatcccagcctgctgtgtgactga

SEQ ID NO: 23326 - DNA, 1050 bp, Homo sapiens
aataaagcctgtctgagtctgttatttcttaaacatttcgatcttactgacaagtcgcaaactacttgtaaagtgcagcctatccttaaatgacagtttgttctgctttttcttgtttttcccctgagctgagagggacttctttaagcttggaagcagggagatgagttagggctgacatcatcctgtattcccctctgttttggggctggggttgacacttttcttccagctccaaggtcaggagtgggagagtatgaagacgtttgcagagtctagggggccctgttgtcacagcatgtgctcgtatgcagggctcactcttcacagtaattaatattgacatggaatgaattctgtgaatctgctatgcaaccaaggaaaccaggatattaacagtaacctacatctattcatgtactcctcccctatcccaaccccatattaatatctccttcccattcaccaatatcatgagttttacatttctcattcccttgctccttttcttgggcagtatgattgtggctgggtgtggtgcctgacacctgtaatcccagcacttcaggaggccaaggcaggaggatcacttgagccaggagctggagactagcctgggcaacatagtgagacccccatctctacactatgggagtagtggcacacacctgtaatctagctacttcagagaccgaggcaggagaattgcttgagcccaggagttcgaggctgcggtgagctgtgattgtgccattgctctccaacctgggcggcacagcaagaccctgtctcaaaaaaaaagcactaagcaaaaaaaattattatgattttaacatttattagtctgttgtgtataactgaaggtcattttcatgatcttgattgtgaatgtcttctattttatttgcccattctattgatggacatttgggttagtcttcacttttcttttgctgtggacattcttggaaatgtgtcctgctgtacacgggcacatgtatttcaggtttctcacctgagaggtattgctgggtacaaggtggtttaacc

SEQ ID NO: 23327 - DNA, 1030 bp, Homo sapiens
ctttctttgtttcttatgacaacatttttgaagaaaaaagttgttactttatataatgtctctcaattttgtagtttgatgtattcccataatgagattcaggtcatggatttttagtggaatactggaattactgcataatttatgtgtggcaaaggccatagtgcaaattaaatgacatgatctttgaataagatcaagactccttttgaaaggctgtttgatcagggaacctgcattgctctaccaccttatttcatggctatgagcatcaaattttagggagttgattctgacctataacaaatttagtgccttagctatgcactgatacctccagtttaaccactacttatttggtattccaagaactacccatttgtcttttttacagttttgaaattttcttacaaaagcaatacaacactggaacttttgggcccatgaagtccaagaggactttattaacattaaaacctaggggtttgctgcaacttggcctggttttctagactgtacaaaacaccacctatcttacgatttatattgagggacaagtcttgtgtttctgcatgggccagatcctttgagtggagatatttacaaccaagttaaaactgtttgtataagaatgtgtggctgggcgcgatggctaatgcctgtaatcccagcacttcaggaggctgaggcaggtggatcacctgagattgggagttggagacaggcctgaccaacatggagaaaccctctctctactaaaaatacaaaattagttgggcgtggtggcgcctgcctgtaatcccagctactcgggaggttgaggcaggagaatcacttgaacccaggaggcggaggttgtggtgagctgagatcgtgccattgcactccagcctgggcaacaagagtgaaactccgtctttaaaaaaaaaaaaaaaaaaagaatgtgtgccaccagccaggtgcagtggcttatgcctgtaatcccagcactttgggagggcaaggtggtcggatcatgaggtcaggtgaa

SEQ ID NO: 23328 - DNA, 1057 bp, Homo sapiens
gtttgggtctgccatttaagtttttaatccatttaatccattttcagttgatttttgtatatggtagattggggtccaatttcattcttctgcatatgcatatccaatattcctagcaccatgtattcaggagggtatcctttcccctgtacatgttcttggtgcccttgttgaaaatcagttggttataaatgcacagattcatttctgggttctctattctgttccactggtctgtgtgtctggttttataccaacaccatactgttttggttatcatagccttgtaatatattttgaagtcaggtagtgtgatgccttcagctttgttgtttttgttcaggattgctttcctattggttttttggctacatcagatctaagagttttttgtggattctttagtttttcctagaaataagagcatatcattggtaaagagggacagtttgattttctcctttccaatttggatgtcttttatttatttatcttgcctgattaatctggctaggacttccagtactgtgctgaataggagtggtgaaagtgggcatgtttgtcttgttccaattcttagaggaaagccttttggcttttcctcattcagtatattagctgtgggtttgtcatatatggcccttactttgttgaggtttgttccttctatgcctagtttgatgagagtttttatcttgaaaggatgtttattttcatcaagtgctttgaaatctattgaggtgatcatatggcttttttccttcattctgttatgtgatgtatcacatttattgatttgaatatgttgaactatccttgcattcctgggataaatcccatttggtcatggtgtattacctttctgatgtgctgttggatttggctagtattttgttgagaatttttgcatctatgttcatcagggatattggcttctagttttttgtagttgttgcatccttgtctggttttggtctcaaggtaatgctggcctcttagaatgagctagggagaatcccttctcttcaatttttgggaatagtttgagaattggtgt

SEQ ID NO: 23329 - DNA, 1269 bp, Homo sapiens
gctaaaagtgaaagaaaatgttgaaaaatataagagaaaaatgatgtgtcgcttacaatggaacaccaatcgattgacagctgacttcttatccaaagcaatggaggggatgaaggtagtgggatgatatattcaaagtactcaaacgacaaaagctctgtcaagcagtaacacactgtctttcaaaaatgaaggtgaaataaagcccttcccagacctaccacataagaaattgtaaaggttattcaaacaaagcaagtaaatctacatggaaattcaaaaccacatttttaaaaagaacaaaattaatataattaaaattacaaaaagcagcacaaatgcacatttctttttacttctcttaataaatttaaaaggcagttgtataatacagtatgtacataattatattgttgggcctataacatggaaatgtaatatatttgacaataacagcataaaggaagtaaatgacagcagagttgtattggagtaaggaaatgatacatgatagtaactagaattcataggaacaaaaaaagaaacagaaataggtggccaggggtcgcaagctggtggaggacctgcccatggaggagcccagggagtcagtgcttcttccctccctcccccactcccctccccactcccccccacctccccaagaatgttccactatgagtcttgggaggattgtcttctggatgaagatgaagatgaatttcagggactgagagaagaagatgaagagattgatcaattcaatgatgatatttttgggtcaggtgcagttgatgatgattggcaggaagcacatgagtgcctggctgaattggaagaaaagctaccagtggcagttaatgaacaaacaggcaatggagaaagggaagaaatggacttgttgggtgaccatgaggaaaatctggcagaaaggctcagtaagatggtgattgaaaatgaactagaagatccagctatcatgagggcagtgcagaccaggccagttttataaccccaaccaggaaatctgaattccagtatctgggatggatccaaagttatgaggcaaatctgaggaccactgctcacttaggaaatgtctacagtgtctgtattagaatatgccttgcctcagaggccccccagggtccagaaaatgattgggacctttctgaacatgcattaccaaggtggtcaacttcacctgtcattggcagtcctcctgttagagctgtccccataggcaccccacctaagcagatggccgta

SEQ ID NO: 23330 - DNA, 1029 bp, Homo sapiens
tgcctgacttaaattatattaaactgcttaataatttaggctccaaggaaatgttgaaaacaatggagtgaccagatagacggcagcggagcttagtgggctggaaataataccaagggggcagttatcttaacagagagatagggaaagatagtcaaaaagactcctgtttaaaaccattgtcacagcagggtaactgcatatgtttaaggctgaggaacaacacaaaatacttcacactgcaaggggaaagggaaatcgattttactaaaatagcttagccaaaacacaaaatacatagccaagcaaacaacaacaagaacaagctctggagaggggacaggcaaatcactacagtatgtttcctaatatgtctacttattaggaaaataataaaaagtaaattaagacatgcaaacaaatgggaaagttggacctatacacaggagaacagcaagcaggccaggtgcagtgggtcacacctgtaatcccagcacttttggagaccaaggttggcagatcacttgagctcaggagttttgagaccagcctggactacatgatgaaatcccatctctactaaaaatacaaaaattaggcaggcatggtagcacatgcctataactaggctaagacacgagaatcgcttgaattcaggagggagaggttgcagtgagccaagatcacaccactacactccagcctgggcaacagagcaagactcttaaaaaaaaacaaaacaaaacaacaacaacaacaaaaaaaaacggcaacaggttggcctatgacagggaacagatgtcatatttaatagacaaaaacttcgatgtagccattatatattcacagcagtaaaggaaaatataaagataacgtctcatcaaataaagaaaatcaataaggagaaatgacaaaatgaaccaaatgtaagttctggagttgaagactacagtaaccaaaataaaaaattcattagaagggctaaacaaatttgatcagcaagtaaatagaaaactttcaaacagatca

SEQ ID NO: 23331 - DNA, 1064 bp, Homo sapiens
ctcaaaccttgttcaacctcagagtattcatactggtgagaaaccctatgaatgtaaggagtgtgggaaggcttttagacttcacctacaactttctctgcatcaaaaacttgtacaggtgagaaaccctttgaatgtaagaaatgtgggacagccttcagacatcagtagcaacttactgaacatcagaaaattcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtgtgaagaactttcatcgtggcctgggatttgctcaacatcagagtattcatactgctgagaactcctttgagtgtaaag

SEQ ID NO: 23332 - DNA, 1047 bp, Homo sapiens
taccatctcacaccagttagaatggcgatcattaaaaagtcaggaaacaacaggtgctggagaggatgtggagaaataggaacacttttacactgttggtgggactgtaaactagttcaaccattgtggaaggcagtgtggcgattcctcagggatctagaactagaaataccatttgacccagccatcccattactgtgtatatacctaaaggattataaatcatgctgctataaagacacatgcacacgtatgtttattgcggcactattcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcaaactatcacaaggacaaaaaaccaaacaccacatgttctgactcataggtgggaattgaacaatgagaacatatggacacaggaaggggaacatcacactccggggaatgttgtggggtgggaggaggtggggagggatagcattaggagatatacctaatgctaaatgacgagttaatgggtgcagcacaccaacatggcacatgtatacatatgtaacaaacctgcacattgtgcacatgtaccctaaaatttaaagtataataataataaaattaaaaaaatatatatatataaacagaaaaaaaaaaaagaggagttggatgtttgttacaaagagcaaagccagacgattcttggaagatgaagcagtctaagcaagcaagaagataagagaaaggttatatcatgttctggttgctaaaaggagggagtggttagagatcagccacaaaggaggacagtgccctgataggaagttttgttctctgtgttaaggtttttggattttgtgctaagactaaagataaaccattcaaaaccagttttaagtatgatctgtaaactttgatctgaatcagaatcatctggtagagatattaaaaatacag

SEQ ID NO: 23333 - DNA, 1037 bp, Homo sapiens
gacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgt

SEQ ID NO: 23334 - DNA, 1094 bp, Homo sapiens
tggaagcctatcgctggggtctgagacaaaggagttaaagcacctacatgttgacataattttactttaaattcttctttcttctttaaaagttctgctcatttgcattctccatggagagaaaaagtaaattatactgacgctccgagagggaaacgctcttctcacatggggatccttgctcatggcaacaacctgtgcaccccgcgggctggaactcccacgaatccactaggctcggctcccttaggggtcagcccccatagtatgctgggatcaacctgaacggatcacagctcaaggcttctgaggctttttctgttcgggactgtatttcccagcggccaccgcgccagtccacttccggtctccggggtcgacgacatagcggggtaaggtcttcacgtctgaggaagagatctgtggctgcgggagatctctgcggattggggctccagcctgactgacccgacagtgcgggtggcctagggggaggcgctcagagtaggaacccgggggtgcagacgggatctgccggatccccaggcgtgtgtgtgcgcgggtatcagaggagggggattgtgagatcatgagtgacggaggggactgtgagtgtgtgcgtgaggttctatgcacaggcccgggagggcgtgtggacgcagcgcactttgctgagtgacactgtgccggtgcccctaggctcctgctgcttcctccctctttccgcttcacagctgcggggactgcagcagaggaatggccccagtagggaggtcagatattgagccgagaatgaagctttacacaagaaagcgcagaagtgcccccgagtgttccccaggggggcagctacatgttgagaaccacagcgtcctcagagctctgtccccagaaaccagctccaaactggttgtactggttgaatcgattcctcttccttttacttccttcctatttcgtgtgaagtgagggaaattgtggctatggagggagggtgttttcaaacttagtctgcgctccaagaaatgcctggagtctcacgcttgccgtatccttctccagtcgtatttttatccaaaagaaggacctggagg

SEQ ID NO: 23335 - DNA, 1023 bp, Homo sapiens
tgcccgccaccatgcccagctaatttttgtatttttagtagagacggggtttcatcatattggccaggctggtctcaaactcctgaccttgtgatccacccacctcagcctcccaaagtgcttggattacaggcatgagcccccgcgcccggccaattttagaagatagtttggcagtgtccaccaaagctgagcaccagtcatctgccctagctgtgtgcacaggagaagtggggacacacactcaccttagaaagtgtccccctcactcagcagcaggacttactctagccccaactggaacaacccaagtatccactgtgagaggaacagtcagatccactgtggagtgttctcacagtgggacgccacacagcagttaggaatgagctacagctacacacgacagtgtggacgcgtctcataggctaatgtcgagggaaagccgcacagaggaggtgagtccacagttcacaggtgtgtctgtgtgcagtggtacagatgggaagtagaggttaattcttgtgggggatggtcagtaaccgggaggggcacacagggccttccagggggagatgccacctcagcctcgcaagtagctgggactataggtgtgtgccaccatgcctggctaattttttttttcatattaagaaatatggagatggggtctcgctgtgttgcccaggctggtctcaaactcatgggttcaagcaatcctgccacctaagtcccccaaattgctgggattacaggtgtgagccactttgcctggctgcatatttcataattaaaggacagaaagtctagaaaaaaagaatagaagaaagctagtgcccccacgttcgaaataagaaccacagttcacaatggggacggtgggtggacagggcctggctctcggctctccctgcccagctgttcccaggtaccatgggggtgggccagagggtgaggagggttggatctggcctctctctgagcctcagagggtgaggctgtgtgtgctgggcccagcctggc

SEQ ID NO: 23336 - DNA, 1031 bp, Homo sapiens
attgtctgagacctgtcttttctctgtcatctgatggggggagggaggccgctgaggctcagggaatggcatgggatggcatggggggacgggagtgtgcttagtttgttgaaggtggcaggttggtggcttcctggtttggaaagaagggagaggggagagagagaaaagagtgtgtgtgtgtaagatggtggagggacaggcagatgctggtggctctgcgcattccctcaggtaccctgggctgcctcattcatactgggttacctcagtgttgggccatgggaatgacacggggagggcagggcacggctaccttgatgcttgctcagtcaggagtgactgtgggtggaggggccacctccccccagcatgggtgtcctgagtttggggtctggcctgcgcttaggccggggagctctgcttcccccagattggggtcgctggggacattgccacatctctctgctcagaatgggtccttgagagcgggctccacgccacccttgctggccttaccctttgctgagtgggcagaacagccagagggcctcagagcccggcgtcctcagggaaggggctggtgtggaatcccctcccgccctgaccagctcctctcttgtcttgcagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtaagaggccgcttttgcccgccagattctttctcccacgctggctcctcctggaaagctgtgccctgagaggcagaggcggagggtcttaccagcctgaggagccagcattccgcagccccaggcccacagctgcttatgcccccatttcgtggactccttcagtggtcatctgggcaggagagcagggatctgactgtgcatgagtgatctcattcatagccccattttatagatgaagaaactgaggcccagagaggggaagtcacgt

SEQ ID NO: 23337 - DNA, 1773 bp, Homo sapiens
cagcaccaggaaggagccccacccaccagctccagctccaagagacgcagatctctgcttccccacctgcctccctagcccatctgtgctgtctggcatcaaaatcaggtcagtgagagggggcgagagaaaaaggacttagtaagtggcaaggaaaggaattgagcttattttgagcctgttctgggcacagggcttcactctgtacatgttcattccacagatacttattaagtacccactccactctgtgcccaacaccctacaaagctctggggatccagctgtggctaaggcagccaagagtcctgcctttgtcgtgctgacattccagtgtgggtggtgggctgtcagcgtaagcaaacacatacagtaacatcggtggtgatgggtgcttaggggaaaatgaagggtaagggtaaggggaggtagggtgggcatgctttgcctagggaggttaggaaggcttctcaagaaagggacgtgagcagaggctgaagagagtggagaggggcctgagtttccacctgagggtgcagtgcctgcaaggccctgaggtggggcgtccccatgtatcctggcagctgagggagccaggcactgctgaagtgaagtgccctcagagaagcaaagggggatgttgcaggccgcgtagggtcctggggctgctttggggattttggcttttatgttgcatgggagggttcgagcggagaaggggtgggagctgactcaggtggtcacggggctccaggctgcaggaggggcgtgggcagagtgctgacttctttcactctataacattctctcactccttccctgctgtattcagcagcagtttagtccttttcgttgctgagtagtgttctactgtggatctacgtgtttgtttattcattctcttgtgggtagactcctggtctgttaccagtttggggttactgtgaatattgctgctgtcaacattgtagtacaagtcttttgtacatacactaatttccttgagacgaattgctaggtcgtgggataggcatatattgagctttgattttgactgcttaacagttttccacagtagttgaaccattttgcacctcccaccaataatgagtaagggttctggttcctctacatccgagccagcagttggccttgtcagtttttaaaattcgagccatcccaggtaggtggttatgatttgcatttgcctgtaactaatgagattatgtatgtttcttggttgtgtgggtgtcctctcctgtgaggtgctcttgctctttttaccttgtcttgagtcaacagctgcagctctggcccaggcactcagaagactcatgcccaggaaccttaggaagtaatgagtgtggtggggccgtgcagggactcccctccgcagggcgtgctatgggggttccataggcgagtctctgtccccctgcctgagtgtcctccattggcagccccccgagtgatcaggccatcttttttttttgagatgtagtttcgctcttgttgcccaggctggagtgcaatggcgcgatcttggctctccacaacctccacctcccgggttcaagcgattctcctgcctcagcctcccaagtagcatgtgccaccacgcccagctaattttctgttttcagtggagacaagatttctccatattggtcaggctggtctcgaactcccgacctcaggtgatccgcccacctcagcctcccaaagtgctgggattacaggcgtgagccaccgtgcccggcctaagccagccat

SEQ ID NO: 23338 - DNA, 1066 bp, Homo sapiens
cctggccagtgatgataatatttgatacgtgttgagcagttgctcttacaggctcttttgggaggacttcatgtggattaactcactgaaccctccaatagccttagagataggtatatgcagttattatctctaatatacagatgaggaaacagaggtgaagaaagggaacatgacttggtgacttgcccaaggtctcacagcaggtgacacagccagggctgaaaagctggcatttggttcctgaggctgccttgcctcccgcacccactctcctgcctcttagtgtggcgtatttccttcggatttcttttttctgtgcgtgtgacatttaaacacatacctccccgtgccctgaagtctaagacagtatgccctataaggtccatcattgatcatataactgcttttctgaaaagaatgcgataggtgagttttgtccatggattgcaaggtacatgccaatctcaatgacatcagcatgtgaaacaatacgcatattgtagaattgaggtgacagggcgtgtgtgtgtgcgtttcagaaaaggcatcccgcctgcattctgtcgtgccgcgagccttcgttagcgaatgctgatggtcccagtgtcagcacagcagggctggtttctgtgtttctgtgctcaggatggcttgttgtgttgtgtggccagaccgtctccacgtgctgggtgctgtgctgagcccttccctgcattagcctgtgatgaaagcgctgctgtctgtccttgcaaggacaggaggaaacggaggcttgggagtctagaaagtgggcaaacaaggaccccagtccagatctgcctaactctcaaggctgtgtggcatggtgttgtgggggagccaggccgcctgtacttcctgagatgaagtcatagggcaagtcatttcacttctgtgcctcagtttcctcattgtcatagaaacagtaggagtgtctgcctcaaagtgttgctgtgagggttatattggtatgtgcgaagcactcaaatgggcctggcacgtggtatgggctatgtgagccttgctctttttagtagagtcatga

SEQ ID NO: 23339 - DNA, 1045 bp, Homo sapiens
gcatttgttagctttggctatcctgtctaatttgcgtatgtatttattttttattttgctgcctgttccctcattcccccaactccccaatggcagggagttctgttttggtcactgctgaatccctggtgacccgagcagtgatgatgcagagttgttgtgatatttgtggaatgaatgaatgcaggattttttgttttaccttcacttggcacaaatgctgtggttctgttcaccactcccccctgaagtaatgaaagttatgggcccatccctgtgctgagtggagctggggacacagtgggggctaggacagactgtatccctgccttgtggaacccacagtccagtgggagaggcgacattacccacatagtcatgcaggtgacagaggcaagtgctgtgaggggaagggaaggctgagctctgagagtccgctgctcgtgggagaggggtggtcagggaaggcctccgtgaagaagatgggtgaacagagtgccaggcaaggggtacagcatgtgcaaaggtcttggggtgtgagagcagggagtcttcatggggccaggagaaggggagattgtgtgttggagcgagcagaccagtgaggctggagagcaggcggggccaaggcagatggcccctggcagcctccataggggccttggacgtgatccatgggcactagggagaggtcctgagcaggggagggacagggtcagaactgcgtggaggatcccgctggttgcagcatggagccctcagagtgtatggagcccgtggccaagcagactagaatatttgacatgatttctgtgggtgctgtaaggccctgggtggcgtgagggggaaggtgtgtgtgtggggtggcagggaggagaaggaatctgctctgtgcttattcttgtccccgtttcttttgcagcctgcccacggcttcaacctgcctccagccccacctgctccaagcagacagatggggcgagtgtagggagtgtgtttaaaagaaaaaagaaacaaaaagtctctctcttttttttttttgaag

SEQ ID NO: 23340 - DNA, 1092 bp, Homo sapiens
aatctttctccactaggggtttgttcctctggtcctctcctgccagcttttagagggtttgcctgatggggctaacagtggcagtgaaaacagtaatcatgaaattgatggctgacagtaactgagtgcattctgtgggccacacactgtttggaatgcttcatatagataaacttgctgaatacttgaattctagagcggtaggcgctgttgttatgctctcccttttagatgagaaaacagcatctcagagaggcagatcatttccagagctagtggatgcccagtgtttatagcattcaccccatgccaggcgtgtgacagggcttttgtacatgtgatctcacttaagtctcaaaacatacctgtggttaggcctattttatggagagctacgagctagttagaagtgtgataccattttacagatgaggaatcatttcactcactgtgaagtgcaaagatttcccagaggtctcatagctgaagtgggagaggtgtgatgtgagcccttggccaaccttggcctcagatcgtcttgtcaaggagaaactggaggagtggcttttgtctgtgagcatatactctgcccagccctgtgctttgggctttatatggtatttgtgtccttttttgcagagtccgaaattgaagttcagaggaagaattgccttccaccgcatcttatcagaccctatgggtgccagggtaggatttgaacccaggtcactgagcccctagtgccatgcattccttgctcaccaggttccaggctgggtgaaaggaaggaaagacataggatagagtcacctctgtcctctgtcctctacctatagaggtgactgtcctatgtctttccttcctcttacccctgagcctcaggctgccctgagcatctctgcctacagccagtccagcatttcttggtccctcctcagagtggaggcaaggcatcctttaaccctgggcaggtgtgtgctgggagaagaagacagcaagagagccatgcagggggtgacacagctaccagggacctgcgttagctagcagcaggacggtgaagtcggttctagctctgcgaccttggaccac

SEQ ID NO: 23341 - DNA, 1335 bp, Homo sapiens
ggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgagtgcgccagcgcgtgtccccgaacgccccccccacgatggtcgcgtccgggccccccgcggtgccgcgatgggctgtaccacccgtgcccggcggggggaccgcggccctcgagcccctccttcaggagctgagtgggggtggccgagcgggggcggtgggaccagcctcggggggccggggcggtggcggcgggccataccactgaggcggtggggggagcgctgcaagtttgcgggacggggagcgcaggccgcagcgtgcgcgggccgggggctggacctttcgggcgcggcgggcagatcgagcctggcgtgcgcgggctaagctatcgagggggcgcgccgcatcaagtgtagagggctgtacctttttggcgctgtggaagccgttgctgtgctgtatttacaggggtgggggcttctggggaggatgcttccccaactgtggctgggttatatcaccacggcgttgggggagccctgcttagaacgtaggggaacccaaatcagaggactgtgatgtttgtgatctttaagggactgggacggggcgggacaggccctagtgggttttaggggcgtattttgggaggactgtgatgccgattggtgaggaggggtttctgtttcctgtatttgacgtgtgtggcgttgggggtttacactgatctcagcctttattgaacttcttaacgactctggagggaacgtcatggttactggggtgctttggaccatggaggtgctgctctggattccattaccctctcagattatttaccaggcagtaacagttctttccttccataggggagggaggaaagctgtgttagaagtcactgaagttgtctgagccttaacattctgaagaggaagagggattgggcttggatttgaggagccgtgcccctgcacccgcttgttaaaacttgggaggaaggagtgtttgggggaacacctcttccccccagggaagctctctgggggcatcttgatcttgggattgtgaggacctcttcctctcatttggagacctcttggggctcagcaagacgcctgggctggagtaactagagcctccaatgggctgcttttcaacttcatccactcctaccttcccagagaagcagcaggagttcactcgtgggctgaacttggttggcagtggatgtgaagggtccaggaaccaac

SEQ ID NO: 23342 - DNA, 1050 bp, Homo sapiens
tgtgcacagctctgtgcttgatgcctggggtcataggttaagaacctcttgcctcctcttagcagccaagggatccatccttgaaaaccttcagtctgatcctgtaaccccctgggctgtaactctccggggctccccattattccagtaataaaggccatcttccccacatggtctgtagggccctgcatcatgtagattcatctcttgcatcgccccactttgcatgctcgcttgctcccctccagcctccttcccatcatggggcctttgctcctggtgaccccttggcctgagcactcttccttcccagactgctccatgttggcctctgtcctcctccaggtctcagcttgagagctgggaatgggcctgcagtcactgggctcccaggccttcccgtccaccatgctcttaagcctttgctggacccatccccacagcaatgacctcatggtgtcataaggcaaatgtggaaactgaggcccagggcgcttcatgtttctgacacccactcctatcacgccccgtccacctccatcacaaagtctcccctttgtcctgcaggtttggaagtgcctcaccctcttctggcctttgatttgtgtgccacaagcaaaaaagttaaaatcaggctgggcatggtggctcacgcctataatcccagcactttgggaggctgaggcaggaggatcacttgagcccaggagctcaagaccaacctgcacaagatgatgaaaccctgtctctacatttaaaaaaaaaaaaaaaaaggctgggcggggtggctcacacctgtaatcccagaactttgggaggccgaggtgggcggatcacctgaggtcaggagttcaagagcagcctgaccaacatggtgaaaccccatgtctaccaaaaatacaaaaattagctgggcgtggtggcgcatgcctgtaatcccagctacttgggaggctgaggcaggagaatcgattgaacctaggaggcagaggttgtagtgagctgagatcgtgccattgcactccagactgggcaacaagaacaaaaact

SEQ ID NO: 23343 - DNA, 1050 bp, Homo sapiens
ttttttgagatggagtctccctctgttgcccaggctggagtacagtggcgcgaccttggctcagtgcaacctccgcctcccgggttcaagcagttctcctgcctcagcctcccgagtagctgggattacaggtgcctgccaccacgcctggctaatttttgtatttttagtagacagaatttcaccctgttggccaggctggttttgaacacctcaggtgatccacccgcctcagcctcccaaagtgctggggttataggcgtgagccaccactgcacctgacctttttttttttcccttgagatagtctcgctgtgttgcctacgttggagtgcgatggcacgcttagctaactgcaaactctgcctcccaggttaagtgattcttgtgcctcagtcacccaagtatctgggattacatgtgtgtgccaccatgcccagccaatttttgtatttttagtagagacagagttttgccacatttgccaggctagtcttgaactcttgacttcaaacgatccacctgcctcagcctcccaaagtgcaggcatgagccactgcacctggctatttttggtttttaaaagcagtatgataccatttttttttttttttgagatggagtttcgcttttgtggctcaggctggagtgcaatggcatgatcttggctcactgcaacctccacctcctgggttcaagcgattctcctgcctcagcctcctgagttgctggcattacaggtgcctgccaccatgcccagccaatttttgttatttttagtagagatgaggttttaccatgttggccaggctggtctcgagctcctgactgtaggtgatccacccaccttggccccccaaagtgttgggattacagccattagccaccgcacccgacagataccttttttaaaaataaactttaaaattttaatatacacattagcttccctttgctgataactaagccgcccaaaactgtgctttaaaacacagacatgtatttttattttttgagatgggagtctcactctgttgcccaggctggagt

SEQ ID NO: 23344 - DNA, 1035 bp, Homo sapiens
aggctggtctcgaactcctggactcaagcgatccagtcaccttggcctcccaaagtgctcggattacaggcgtgagctgcttgtatcagtggttcattcctttttttgagacggagtctcgctctgttgccccaggctggagtacagtggcacgatcttggctcactgaaacctccgcctccaaccttcaagtgattctcctgccacagcctccctagtagctgggattacaggtgcacgccaccacacctggcagatttttgtatttttagtagagatggggtttcaccatgttggccaggctggtctcgaactcctggcctcaagtgatttgcctgcctcggcctcctgggattacaggtgtgagcgactgcagtcacaccgtctgattctttttgtatgtcaaatttgtaggcattggactacttcagcatgcacaccattaagtagaattcgtatttgtttccagattttttttttcttcaaagcgaaagatatgattgtcttagttcaggctgctataaccagatagtgtagactgtgtggcttaaatgacaaacatttgtttgccgcagttctagaggctggatacctgaggtcagggtgtcaaatggctcatttcttggtgagggctcttttcctggtttgcagatggatgcctgctttctgtatcttcacctctcaaggtggaggggagatctcttgtctctttttcctttttaagggcattaatcccggccgggcatggtggctcacgcctgtaaccccaacactttgggaggcccaggtgggcagatcactcgaggtcaggagttcgagtccagcctcaccaacatcatgaaatcccatctctactaaaaatacacaaattaaccaggtgtggtggcgcatgcctataatcccagctacttgagaggctgaggcaggagaatcgcttgaagccgggaggtggaggttgcagtgagctgaggtcatgccgctgcactccagcatagcatcagagtaagaccctgtcccagaaaaaaaataaataaa

SEQ ID NO: 23345 - DNA, 1077 bp, Homo sapiens
caggctctcacagggagctacggttgtgtacaaacatgcacacagtctcacaaagaacacccagcactctctcaggcaacagtcacacccttacaaataaccctcatgaaaacactctcaaagacaacctcatgttcccacacaccctaacggatgcaccactgcacacagatacaccctctgtgcaatacccacacacccacactctaaggcaacagccacagtcacacaggctcaccgccaacagctgcactcttggacacagacagtcttgtagatccctcagatgcactctccgaggcaatgtcatcacagacaatagccacaccttcacacagagacatagctacatggataacagccatggacacaccctttgaaagacgacagcctcatctcaaacacagacacaccctcacaggcaacaggcactgagccacaagttctcatagacaacaacggcactctcggatatagacagcagacacacactcacaaccactctcagacatcgatgcccttcagcaacaaccttcagggcctcagactcacagacaacaaccacacttttggatgcatccctcacggacagcattcacagatgcacactatcctacaccattctcagacatgcgttcttccagacagccttcagaaacacactcacagacattacttgcctgctcagatatagagcccctcatagacagcgttccagaacataccattgcacacttgcttacacacacacacacacacacatccccctctgctgttggtgctcccagtcctgggactgtcaggatggctgatcagtgaagactgtcctagtggctggccacctccacacccactccacacacccacagccctgcctctgacagtcatcagtgcaaggccccagaagccttgcctggggactagacacagttgtcacagaatggctgtgtctcagagttccagagacaagccaccatcccccataccccatgcacctgactcctgcacccctgacccatgcaattcccaactcctctgctgccctctgatcaccccactgcctgactctcatacccc

SEQ ID NO: 23346 - DNA, 1040 bp, Homo sapiens
gtctctttggggcgcaagacagtgaatgaccacagcacagagctgtctgggctgtgattggggagctcagaggacggtcccagaggaggttcctgacccagtcagatatcccagtagggcttcccagaagagatgatacccaaactgattcccaaaggtcatgaaggagttagcaaggtgaagggggtgtgggagaaggggagtgtatttggagcaggggaaatagcatctacaaagatggggcgatactagggagtgggatgcactggaggaaccagcggggcctgagcgtgggcagaatttggttgcagctgaggagggatggaaggcagggccatgggaggtggcaggcaagggtgcagtggaaaggatctttgggtgtcagacactcctagatttgaatccttaagtgtcatttctctcctctgaacctcagttttcccctccctaagatggggataataataccttgcaggtctatagtgagggttacgggacgtggggacaagtacctcacacatcgcttggcagatactgggggactgaaatgtagttcctctttttattccaggtgggagaaactatgggcacaactgcccagaggcaggactgtgccctgggagataagtaggcccctgattaggacactcccagagctggtgtgcagaccaaggggctgtggccagagatggccagggcagccttgacgttagacttgacagagctcatcagagattctcaccctcctctctctcatgccagaatttacagcatccaaccccctgaacatcacgagggaagacatgagagggccactttgcttgacaaggacgtttatcccttagggcactgactttcaaaagttattttgacagaactttttttccaattgcaaactccctcagaaccctgggcaagagcagagctgctctggtgaaggcagagatgggggtgcctcccaccccaccccacaggcaggtcccaaggcgctgccccataaagctgccagctggtttgaaaacttctgccccagggtgagt

SEQ ID NO: 23347 - DNA, 1088 bp, Homo sapiens
gccaactgtcatgtttcttccccccaaatttcaccccccacccagccatgcaccacccacccccactccaagatctgtgtcgcttctctcttccatccccctgtcctgctcagctccttctgagaggctgcagggtgttccctgggaaggagtctcccacttctggctctgccctccagcttcctctccttgtcccatccacctttcccactgcctctctgctcctgtgactagagaatgagggccccttctctccacccactcatctctgtgggtcccaaggatttctctgtgcactatagggaattctcatactcaccacccatcccctcacctctataggagctatttatattgggggaggcttgccccgcatctccaggctggcagctcctgcctcagtggctctcttgtgtctatgagccacatccttgtctttttggtaccctggtgtctgtaggcctcccttgtttctgtgaccttcttcggctctccttggctctctccctgccctgtggaccgctccccatatctgaggagtgctttctgtttccaggggcctctctcttgtgtctctggcttctcccgttttccttcgcgggaggtctctatgtccacattactgccccttgtctccgaggtccttttgcttgtctctgtaggctgctcccttgtctccatgggcctttctttcttatccctgggcttttcctgtccttgtccttgtggggtttgtgggcctcagcccacttctctggacagtcttgacggctgtctctcttctcttcatttctcttcatctctgtagccctctcccctcatctcagtggccttctccctgggtcttcttgcctctcatctctgtgggctcctgtgcccagggctgcctgggcagggcggtggcatggtgtggtagagggggtggctcgggggtgggccttccatccaatgcagctccttcttctcatcagcattctcctcgcggggggcccccagccccaaccaatacaggctccccctcccccgactcacctccctactctctctttgcctgcctccctcccttcctcctgcccgccctcctccct

SEQ ID NO: 23348 - DNA, 1105 bp, Homo sapiens
ccactgcacctggcctatttttaaaatttaatttaattttttttttttttgagatggagtctcactctgtcgcccaccgcccaggctggagtacagtggcacgatctcagctcactgcaacctccgcctcctgggttcaagtgattctcctgcctaagcctcctgagtagctgggactacaggcagacaccaccactctcggctaatttttgtatttttagtagagacaggtttttgcaatgttggccaggctggtctcgaactcttgacctcaggtgatccacccccccacccagcctctcaaagtgttgggattacaggcgtgagccactgcgcccagtccctaattttttttttttttttttttttttttttgagacagtctagctctgtcacccaggctggagtgcagtggtgtgatctcagctaactgcaacctctgcctcccaggctcaagcaattttcagcctcctgagtagctgggattacaggcatacaccgccatgccctgctaatttttcctagtttttggtagagatgggtttttgccacattggctgggctggtctcgaactcctggcctcaagttgatccatctaccttgacctcccaaagtgctgggattacaggcatgagccaccatgcccgggttttttttttttttttatagagatagggtctcactatgttgcccaggctggtctcagaactcctgggctcaagctatcctcctgtcttggcctcccaaaatggtgggattacatgtgtgagccactgtgtctggccagttgttatttttattagtatctccgggagcctaataataataactaacatctcttgagtgtattatgacgtgctaggtattatgctcaatgcttacatgcattactcagtttaatcctctcaacaaccctatgagagagaaactgtcatgctgactctacaaaacatcgaggccccagagaagtaactagtcgtagttcccatagttaggaagagtcaggattccaacccaggagttgaccttacagtctacattcttggcccccaggctcacctgcctgccaggcaggaagttcaagtggttgcatgttgaagggtt

SEQ ID NO: 23349 - DNA, 1034 bp, Homo sapiens
actccaaaagggttccattggtccggacggttctgccaggtaagggagattcaacaaatgcaggccagaggcaggagccgactaatggccgaggccgctgatggccgagatggctggtcagcgaggaggggaggctcgacaactgatgtgactcagagctggacaaatgatggcgcatttggctgaagctggctgggggcccatgaccagagaccaggcagccattctcgcctcagcggggaaagggccagatccggctctgttgcagcagggtgggtttcccagcctggatccaccatgcatcctgcctgccgtgtgtgtcttggggtctttgtatgtgtgcatgtttgtgtgcatgtgtgttcatacatttatctgcagttgtcagcatgtgcctaccttcgtagaactttgtatctttgggactcctggtgtgcatctatgtatgtgcctttgtgtatgtgtttgcttgtgcgtctatgtgtacatgcccacccacaaagtgttcagggacctttcttgttggactctgcatttttgggtccgtgtgtgtgtttgcgtctattgaatgtgtagaaagctttcttactgtgagacactatgcactcttgagcattttttttttttttttggcgttgggttgaaggttggggtggggaagaagcgatgggtctggctctgcactctgagccttccatgtatctggtggcccatgaggccgtctttgtgcatctgtttgagcctctgtctaggtgtcggcgggtgtgggcttgtgtgattgcctgtttcagagtttgaatatctgtgtgtccacagcagcatctccctcggagcatggatgtgggtggagtgggccagaccaggatgaggggggcatctccctgaatctcatcagacctctggaggggggtcacacaacccatgctgagcctggctgggacccagcagcacagcacagtgcagaccacccctcctcctccttttccccccatgacctttgagcacagcagccccaaatacatatttatcagagg

SEQ ID NO: 23350 - DNA, 1047 bp, Homo sapiens
gcagacagcctaagtcccctcaggcttctccactggtccccagtaattatcctgtcaactaagctcatcaaagaccccttcaccactccacggactcctcttagcccttctagacacccataggcctctctcagacgtttacaacccttcctagcatccctctatgaacattctcatcctctacaaacatcctgatagattgcagaccgtcaccttcaaactcccacggaccccaatcccctcgtggcggttgcccacacgcagcggcgcatgccccacgggttctggcggttaaataaccctcgctatcctgccccatgtcgccgcccttttgagccgtcttggtcccgcgttggaatccctaggccaaggggctcgactgaaatttttactttttgactcagagctgccatcagagggcagcaggtaccatttggctgggaaactgcaactcccagaaacgcccgcgcctagccgcgcgtggtgcggccacctgctttgtgaagggagcggaagtgttccgcactttgccttctgggtaatgtagtctcaacaggctttggcgctaccgacccccgcagttgtgtccgcggggaattgcagtcaggaacaaactgagtggacaggactttcttctggtttcagaaaggacaggacagttagtataagcacaagctcggattaacgtgaagtccagagactccatttcccaccattccaggatgcgggaggggctgagaacgctttcattctacttctaagtatttccgggggaggaagagacacatacagacacaggaactctgtttcccagcgccttttgggggctactctccttcgggtattaatcgataaataggacgactcactgagtacacaaaacctgaggcagctggcttccttatttttggctttccgggatcttgtaatttaggaagcggaggatgcaaaacacaagagtgggaggcccggtgccgtggctcaagcctgaaataccagcacgttggaggctgaggtagaatcgcttgagcccaggaattggagacc

SEQ ID NO: 23351 - DNA, 1138 bp, Homo sapiens
cagtaaagttcatcgcagtcccggcctcccacccggcaagtcagtccatccatccatccattcattgtcagtcaacccgcttcagccggctccactggggcctagccctgacccctaccctttccaggacaacgggccctggcttggcttcagacctccacacctgcctcagcaaaagggaaggcctcatttctctagggtgtcacattattttcaggtctcaaaaggcggaacaaaggctgacagaccaacagaaatgctgcaagcctcaggcaggggcaggtcctcagttacaagcatttatcaatcagcatggggacccgtgggaggttcccatgcaggaaggaaactaacaccacccctcagccccagggaccccaaactcattgcttcccctgccgtagaacacatcattagcccagaatagacctggagttggcttcagacacacgcaggctcagacaggctcagagggcagacggactggagcccaagggcactcgctgtcacagcaagacactgagcctcacaccagtatagcatacccagaggcagtacagactgtagttaagaaacgtgggcgtcggagatccggttcctcaggctgggagctgtgatgttctgggcaggagactccctctttccctgcctcagctttctgagctctaaaatgggtatgatgataggagtacctccttttgtgaggttagaatgaatgtagagcgtttggcacaggcacgcagcaaaccctcaggagaagtgaaggttattgttactgttagtccccaccggacggtgaacatcctaaaagcagggctgtatctgccttgtttaccctgtatttctagagcctggtatgccaggcaaataggcactcaaatatttattggattaataagtgaaggaatgtgtgaactgtaacagagatcataataatcacgcttcccttagggttgtcatgaggagtcagaatccagttgggcagggctccctgcaaaacgagccattcacaaaggctcattcctgcaaactccaagatttgcctgtcatttcctgaagccccgccctcgtgccaggctttagataaattaatcagacctcactcctgcctcaagggcatctgggctggctggagcaa

SEQ ID NO: 23352 - DNA, 1030 bp, Homo sapiens
tgggaggaccatttgaggccaggagctggagaccagcctaggcaacatagcaagacccctgtttctacaaaaaaaattctaacaattaaaaaaaaaaaaaaaagctctgcccctaggctggaaatcaaggctgctctgatgtcacaaagtgacatagatcctccagatgagagtgggatgtcctattctcactactgctacgattacaaagagcagactttctgacagctcatgacttgagactacagtttttcagccccaggtccttggtgtaaatgaacacaagctcttttcagaggttcacaccccaacagaagatgaataatccccaatctgattattcaagagataatgcaaaattatctttttttttttttttaagatttcttcctggaaagagagaaacattcctgataaaatgcttatgcaatttctggatgaactttaatgggatcaagtgttgttctggtaaccaggcacccactcaaaagtccctcaagatattaatgacctggaaccgaacgaatatcttttttttttgagacagagtctccctctgtcgcccaggctggagtgcagtggcgtcatctctactcactgcaacctctgcctcccggaaccgaacatctttttctaaccatgactatcctaccacctgctagaaaacggccccacgggacgcggtggctcacgtctgtaatcccagcactttgggaggacaaggtgggaggaacgcttgagctcaggagttcgagatcagcctgggcaacatagtgagaactccgtctctgcaaaaaacaaattttatatacatgtatgtgtgtgtgtgtgtgtatatatatatatgtatataaatatatatatagatataaatatatatatataaaatgtcgggtgtggtggcaacgtgccatagtcccagctactcgggaggctgaggttggaggatcgcttgaacccgggagtttaaggctgtagtaagctgagatcgagtcactgcactcaagcctgcgtgacagagcgagactct

SEQ ID NO: 23353 - DNA, 1367 bp, Homo sapiens
ctcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggctttgaatcttgatggggtggcggaggcccctggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcaaaaacagaaaaggaggatctgagaatccaagcgatagaatcccttttgtcgtagacagaaagagcaaagtccagagagggcaggcttgaggcccaacagcacacagtaaggccctgtgggtctg

SEQ ID NO: 23354 - DNA, 1492 bp, Homo sapiens
attataggcgtgagccaccgcacctgccctcactccctttattaaagccacagggcctcatggctgttcttcctgcagcccaggacctctgcactccgcctccctcagtgggaaatacccttcccgcagatctcctcagactctcgccctcgtgccattcgagtcaacttcaggccttccctgaccatctaacatagcatcccctgttactctccctcacttctgtgttttccttcattgcatttacctctccttaataggatactgtagctttccttatgatctttctcccccattcgaatgtaagccctaggagggcaaggtccccagcacctcacacagtgcctggcacacagtaaatatttactacaaatttgctgaataaggagcatgaggagctggcttgtctgatccgtggagttttgctgttcatctccttcaggctcgtgtgccctcctgttggtactcagggaggcaggacctggcaggagtcctgcctgaagcagccacagattgcagaaatgcctccagaagagactggctcagaacctatggccacaagggctcttcctggcttcaggccccaggagaccgctgggaggtgttggggggaacagctttgggcacacggaccaggcagaaggaagggacaggagcttatagggaggggagaaatggaattaggaagcagatgccttcagagctaggtagtgcctttgaatcctagctcttactgggcatgtgtctgtttcctcctcagttcctcatcagcagcattatgttgtgtagattcagtgagttaaggaatttaaagcattcagcttagtccctgttacatagtaagcagttgatggagaaaacttaatgtttgtattagtaaccctggggacagggatgagctgagggtctggccaacagcaaaaaaggcttgctggggagttggttgttctgaccagatctaatgcagctgagctgtgacttcattctgaaacacctattcctaccaccatctgggattcattcacatctaggtgtgccaggcactgttctgggcactagggacacaggtgtgaacaaaacagataaaagagagaaaacagataaaactccttggggagtttacattctggtaggagtattggctcaggccggcacatggcagagccttgtttttaaggtcttgtctacaggtgggcttctcagagtaggggagccccttgagattgtagatgtgtttgtgtgtgtatgaggagaatgtccctgtattttagcaatcccattatcccttaccttagaaaacaggtttatgtactcttaacctattgtaaaaaattattttaaaataacataaactgaaaattccactaaaaaaccacacagatttttttttttttttttttttttttgagacagagtctcactctgttacccaggctggagtgcagtggcacaatctcggctcactgcaacctccgcctcctaggttcaagtg

SEQ ID NO: 23355 - DNA, 1030 bp, Homo sapiens
tatttgataattaacagctaaaagtatatatcattatatatcaggcaccattctaagggctttacacataccgacctcacagtaatacacagagttttgatcatgtggttatccccgttttatagatgaggaaactgatggaaaaaggttaaggagtgtgcctaaagccacacagccaggaagaggcagagctgggatctgaatcctggcagactggcggagtctctgcccttcaacacctcagtgtactggcttcattaattgaactaatggatctctttatggataggagtgaaattgtgtgcttcaaaacatgcactacccccgcctcccaccccctgacatgggccacagatgaaaagcttagggagcaggcagggcaccacggctcacatgctcagctcacagggtcacacttcggatgcatccaaggctgagaaccagagctctcacacacccctgcctgctcctctccacaggacttatgttttccgggcccagagcgctgaaatgaaggaacgagggggcaaccagaccagtggcatcgacttctttattacccaagaacggattgttttcctggacacacaggtgccagccccgcctgcctttgccccaccctgccacatcctgcattgagcctcttcctggaatgtgattaagccagaaccctgcgtggattccatgtgcttccagtcaagccatggacatactggctgccctggggcaaattgtgtcttttcttggcccttagtctcttgtcacttttgcccccatctcattcgccttctacacagtagcctaaaggatttctagtatagtgctgaaaagtgtgggccctggagaatgtgtgttctgatcctgtctgttagttcttaccagctgggtgactttcagttttaaactcccttaaaccacagctctttatctgtaaatagggatggtaactgtacttagcctcttaggagtttcaaggattcagtggaacaatccaggcaaagtgcttggccaggacctggcacaaggttag

SEQ ID NO: 23356 - DNA, 1031 bp, Homo sapiens
gcacctggccccatcttctttcagattttttttagtctcaatattcttcagaataagaacacatgctgattaagtttagtatttgctaagaaagagaatatttttaaagttagaagaatgacacaaaaccatataaactccagaccagttgagcacaaataaaagggaataaactgaacaaaaaaagacaagaaaggagaacaaaatatacacacagatagtaaaagcaaattatcccagactgcactaaaaaaaaaaaaattatacatatatattctaaaagacactacgaaaacataatgacaaaaaagtttgaaagaaaaagaacaaaaaaaagatatactgtactgagcaaatggcaaattacagcttcagtttcagaggtcatggtagaaaataaaaaaaaaactgacctcagctactcgggaggctgaggcaggagaatcgcttgaacccgggaggcagaggctgcagtgaaccgagatggcgccactgcactccggtctgggcgacaggcgagactccgtttcaaaaaaaaaaaaaaaactgacctgatgtctggcgtatgctttaagacaaccatctgcagcctttttggcaccagggaccagtttcacggaagataatttttccacggatgggggcgggggagatggtttggggatgataggttccacctcaaatcatgaggcattagttacattctcataaggagcgcacaacctagatccttcacatgtgcagtccctcctatgagaatctaatgcccctgctgatctggcaggaggcagagctcaggcggtacccctccaatcacctccttctgtgctgtcaggttcctaacaggccacagactagtaccaggtccgctgcccagaagttgggactcctgctttaagacactctaatttaaaaaaaaaaaaaaaagtggggtggaaggaggaggagatggtctgcagcaaatgttgaacctgagtgttggttacgtggaattcactgcaccactcttttgacagttgaatatgcttgaa

SEQ ID NO: 23357 - DNA, 1100 bp, Homo sapiens
gagaataggaaaaattataatgtttgggagactatgccattcaaaaatcatctctggcatcagtcatccaatactcccgttctctctgaaagacagaacccccaagttctagttggatgcatgtccacattccccagtaaatatatgaatgatactgggagacaaatttctgattcttgaagaatgaagatgcaacatagaatgggggtaaggctagaaaaaaaacactatgatattaatttaagaactagagataaaagcaggaactcatcattaattctttctacctttctacttctcttcctatctgtataactctttcccctccttcctagagggaaaaaaaaaaaggcacagctattacccagatcttgatgtttaactaccatcccccaatcagaagaatctgagttctcaaagaaacagcaaattccatggatggtgcaggaagggtacaagatgagcttggaacactgtattgtgtcagagtaaagatgtgctccaatttatttaaaaatacatgatgggcaaacaggacagaagggaaacttccttagagtagaacaacaatctaacaagtgttggaggaatgatgaaagttgaatatatcacactttcgcaccatcagagcaattactgatttagaccagacttacagaatgcttaaactagtggaggaaaatttactgaaaaacaagctatttagagtcagaaagtgtctccccaggagttgcctttgtaattattaattacaaagaaaaaaatagtaatttcgcagtggaaaaacccagcaccgccctccccaatcaagtgttccaagttaacatcacctataaaggtacaaacatacctcgtttcctcacgtgctgcacaccacttacagagtcctcatgggaaaaaaatgtgtaatttaaatccaattgtaaggaaacctcaggcaaatccaaattaagagacattctacaaaataatctcaaaaatatcaaggtcattaaaaacagaggtagcaactcagattaaaggagtctaaatgcaatgtgtaatctttggactctagagcagaaaaacaataaatatattattgggataattttaagatt

SEQ ID NO: 23358 - DNA, 1775 bp, Homo sapiens
aagcaatcctcctgcctcaccctcccaaagtgctgggataacagatgtgagctaccacagctggcctatttttccaaattttattatgaaaaaatttaaagatgcaaaagtgttgaatagtattaattcaaactatattgtaatacattaaagaagttaatatagcttgaattaatactaacctagcttccaaaatataaaaaatcctgctcccgtatctctgtcctcctccctttaggatttgaaaaattacatctttatacattgtgtgccccattaacatagatttgtaactattttactcatttttctttaaatcatataggagttatgagccaataatacaataatattggcttttgtgtttacctatgtaattactttaccagtgttctttattaatttatatggcttcaagatttagtgttttttcacttctgcctgaagtattttgtatttcttgtagggcaggccaactagcaatgaactccctcagtgtttgtttatctaggaatgtcttaatttctccttcatttttgaaggatggttttgccagatataggattcttggctaacaggttttttttatttcattactttaaatatgtcatcatactggcttctggagatcatggtttctgatgagaaatgggttattaatcttattatagaggctttgaacatgaggtgtcactttctcttgttgattttgagtctctgtctttttatggtttgattataatgtgtcttggtgtggatctctatgcatttattcttcttggagttagttccttgagcttcttctatgtgtagattcatgtcttataagtttgagaagtttttgaacattatttcttcaaatattccttatactcctttctctctcctcttattgtgactcccattgtgcatatgctgatatgcttgatggcatcccacaggtatctgagttctacttactttttcttctgctcctcagatggaataacttcaatttacttatcctttagttcactgatttttctgcttgcttaaatatactgttgaaatcctctagtgaattttcatttcagttattatactcttcaggtccaaaattcatggtttttaaataatttctacctatttgatatctttttttcagacatgattctcctggtttattatttttgttcatggtttcctctagttctttgagaatatttaagacagtttatttaaagtctttgtctggtaagtccagtgtctgtgtttccttggggacagtttctgttcatttattctgggaatggaccataattttttatttgcatgctgtgtactttttttttgtttgttttataatgtggtatctcttaaagtcagattcttcctcctgctcagtttgttcttatcttattgtggatcgtaatggtttgtttagtgactgttacaggtttaattttgtctcccaaaaagatatgttgaagtcctaacctgtgaacatgaccttactttgaaatagggtttttgaagatgcaatcaagatgagggcattagggtgtaccctcattcgatacgacagtgtccttattagaagagtaacataccatattaagactgaaacacatggggagaatgccatgtgaccacagagacagagcttgaagtgatacagctaaaagccaaggaatatcaaagatcaatggataccagcagaagctactaagtggtaatgaaagagagcatggcccttctgacactttgattttggaggtctaacctggagaaaactg

SEQ ID NO: 23359 - DNA, 1048 bp, Homo sapiens
agatgggaagtcacagaaggcttttgagccaaggagcgacatgatctgacttacatgatctggctatgtggagaatggactggagggaggtagaaggaggaaggtcatgtgcaagctgctgcagtaaaccagggcgatgaattctggggtcttgggccaggctggtggctgaggaggtggtgaggaggagaggactaggctgtaccccgcaaagactcagagctccatggttctcacctgaacacccatctccttggatttctgtctccatcatccgaagcttgtcttcttttcccaactgtaatatcacatctagtttgaagggttgatagcctgtgaaaaagaaatggcatatatataaagtgaatgcattatagtcaaaaattttaattccaacaccaccattttcatgcgctctaagtagtatttttcaaaattgtgatcatgagctattgtctgaataccttttaatttgtgatccggtacacaaatacataaatgtaaatcactgaaatcaagtgatcagataatttgatcctaaccattatctacttttatcacatcttctttcctgtttttacttacaattttcgttgcactgaatgcagttcctgacaaggagctataatatttctacttcatttcattaaacacaataataatgtaactcaccaactgatttcaaaacccaccaagatttcacaactgcaatttgagaaaaatagacaaggtatagacaagatgtccctgaggaattagaaaattcacatccccaagttcagggaagcattttaagcgtcccaaagtcttaaataattgaaagcaggacagtccagagggctgatattcagttacagaaggtgcctgtgctcacccactgacagcaggttcctgaagttctccagcatcacatcttggtacagctttctctgggcaaggtccagcaaccccagctcctccctggtgaagaccacagccacatccttgaatgtcaccatctcctacaacatcaagcagatgtaatctcaatcttatggccaataactgc

SEQ ID NO: 23360 - DNA, 1067 bp, Homo sapiens
ttcttcacatttgtatggtttctctcctgtgtggactctctgatgggcttgaagatgtgaactccaactgaagcctttcccacacacatcacatttgtagggattctctccagtatggacttgctgatggtcttggagatgcgaactctgactaaagcccttcccacatgtctcacatttgtatggcttctctcctttgtgaactctctgatgggcctgaagatgagagatctgactgaagtccttcccacatgtgtcacatttgtagggtttctctcctgtatggactctctgatgggcctgaaggtgggaattacggctgaagttcttatcacacacatcacatttgtagggtttctctccagtgtggattctctgatgggcttgaagatttgaggccttactgaagcccttatcacatacctcacatttatatggtttctctccagtgtgaactctctggtgaagaccagaattcctattaaatatcctgtcacttacttcccatttgtatgtcttgtctctagagtgacctctctgatgggcttgaagttgtgatgtctgactgaagcctttatcatatacatcacatttacaggctctctctccagcactgtctacacagtgaatgtcaaaatctaagctatgatggaagcccttcccacacctgccacatgtacacaacttctctcctgggtgagtaagctcatgagagggaagacaggagttctggttggagctccgggcatatacctgacatctgtagaggttctctcctgtgctgactctctgatgaggttgcagatgtgagccctgactgaagccctcaccactgtcaccattcctatagcatttctctcctatgtggaaacactgatgcctgggaagccctgagctgtaacctatgcccttcccgtactcaacatttacatgaggcttgtctcttaagtgtagttgctggtgaagttcaagattagagccaacacttaagccttttccattttcatcagaggtttgctctcctgattggattatgctatgctgggatgattccttcacacagtctt

SEQ ID NO: 23361 - DNA, 1041 bp, Homo sapiens
ccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatgtggggattgtggtaaacgctttagttgtagctcaaatcttcatacccatcagagagtccacactgaagaaaaaccatacaaatgtgatgagtgtggtaagtgcttta

SEQ ID NO: 23362 - DNA, 1032 bp, Homo sapiens
tgatataaaaatagctactcctgctcgtttctggtttccatttgcatggaatatctttttctaccgctttaccttcagtctgtgtctttatcggtaagatgagttatgttgccatttgacttatcttctttctttgtgtaattattttataaggcctgcaagttttatacttttgtgtcttttatcatggcaagtatcaaccttttgttttcatggttagaactcacttgagcattccctgtagacctggtctagtggtgacaaactccctaagtatttgtttatttggggaaggcttatttttccttcatttatagagcttattctagtaggatacaaatttttttgttttttgaagcaacttgaaaatagaatccaatctcttctggcttgtaaggtttctacaagttgaattgtgtgatggagcttcctttataggtgactaaacacttttctcttgctgattttaggattttatccttcatataaaccttagtctgatgactgtatgctgtggtgagttccatcttgcaatgtattttcgtggagttcattagatctcttttatctggatatctaaagctcttgctagattaaggaagttttcctcaattatttccttaactaggtttccaaactttttactttttcttctccctcaggaatacctatgattcataggtttggttgctttatgtagtttcatacttcttagaagctttgttttttcttccttattcttttttctttactttcgtctgactagattaattcaaaagacctgtcttgaagtaccgagatgctttcttctgcttgtctagtctattgtaaaagctttcaactgtattttgtaatttcttcaatgattttttcatttccagaagtttttatttgtttggctttttaaaaaaaagatacctatctctttctctttggtaaatttctcattcatatcctgaattgattttttgtattgcttttcaaatttcttttgtatctcattgagcttccttaaaatcagtatttcaaatt

SEQ ID NO: 23363 - DNA, 1077 bp, Homo sapiens
tctactgttttgtatatgttatctggcattttattttaaaaacacaagatcaaaagttgagaacaatcttctgccaatagatagcagaccaatcaataaaaccacacttatagataaccatattttggaactattagggaattttacataactgattgatgtgctgaagactccagtgaaaagggcagataatatgcatgagcagatagggatttcagtaaaatttaatagtcaaatgggaaatgctaggaaaagaaaatttatgctactgcttttacttttatcagaatgcttttgaaggacttatgagtaggctcaacatagttgagaaaagtgtcagaacttgaatataggtcaatagaaatcatgcaaactaaaacacaaaaagaaaaagtgtgaagaaaacaatacaaataggacaacattgtaggatctaatatttgcatacttggaaacccagggtcgggggagagaatgggaagaaaagatatttaaagagataatggctgagaattttccaaaaataataagacttcacccagattcaagaacgtcagaataccaaagcagtatttttttaaaaaaagaacaaaactagaggtattattgcccaatagctaaaaatggatggacagtgcaaagaaaatattaatggcagacagaggaaagggacacattacatataagaagcagagtgagaaaaacatcagacttatcatcacaaaccatgcaagcaaaagacaatggagttacatctttaacatttagaaacaacaataaaaaaaatgatcaatcaaaaatctaagcctggtggaaaaaatctttcagaaggtatgcaaaataaaggcattttcagatgaacagaagctgatagaattcactgttagcagacctgcactgtaagagatatttagcataccagaaatagacttggatctaccaaaagacataactatgaaaatagttatttcaatcattttaagtgtaaaataatttttatttttattactccaaaatataattcagtaaagcaaaattaggaatgaggttttatgaatttagaggacatacaaaaat

SEQ ID NO: 23364 - DNA, 1063 bp, Homo sapiens
ctatttaggaaagactaagcaaccaaatagcaaagatccctcaggataatgaggtttatgtttggaatagcatgagcagattactacttaggacacagattcctaggaacattcctcattgaaaataaaatggattcctggaaataggtaactagaaattttggccagaaatggtttcatatgaagaactgagaatgcgtgggaagtatagagggcaagtgggcttattttcatatatgcaaagcaatattaaggaactctattttcatgttttagttcttcccctcatgtagcattgtctctttcctctgggatatgttccctgatgtgagagtcctctgaatagaagggtgcttccctggctcagtgctgaccgtctaaattatacttgcaaaaatgctttcatgaggcaaagttttagttactctttgatatttaagatttgattaacatgtctttctgacctttcccttgaatcatgaatttgaatcctgtggatgaccatatattgaagcctctgatcccagaaaggtaataagctgaaagttgaactgagagaccagataatagaggttaatacccttgggataggaaagaaaacttaaagggtaactgatggggttatccttagcaaaattctatccctatgagatgaccctaagtggagccatctctatgaggattaatccagagattgttgcacacctggcagtgtcaggtctgggaaaacagttgctgatgttttcatggagtgtgaaatactgaaagctgcgggcatcccttggggaccactgacccacactttgaagaaccctcaatgagtctgaaagaggttcagtatctcttgggaaggatgtgttccaggctccaggcctagtcttacatggccagtggggttgaaagactgtgcccctgcaatggtcttttcctaagacagttgaacaaagttccaagtctgtctgtcctattttaaccatctttaagaagcacaaaggggatatgagaaaaacagatgctgaaatgaaaattttaactgatatcttacttatctcacaagtcgtgt

SEQ ID NO: 23365 - DNA, 1063 bp, Homo sapiens
aagtgtaagccaccacgcccagcctacagttcttttttagttttttaaattttttcattctttttttccgccaagactgagtcttgctctgtcacccaggctagagtacagtggcacgatctgggctcactgcaacctccgcttcctgggttcaagcaattctcctgtctcagcctctggaatagctgggattacaggcatatgctaccacacccggccaatttttgtatttttagtatagatgcggtttcaccatgctggtaaggctggtgtcgaactcctgacctcaagtgatccacccgcctcggcctcccagagtgctgggattacaggcatgagccattgtacctatccctttttctttctcttttttagaaatggggtttctctgtcacccaggctggaacacggtggcaagatcacagctcactgcatcctcaaactcctgggctcaagggatcctccccacctcagccaccctaactctaagcagaagctcaaatagtctacagttctaaattctgtgatttgtggagtgtggtggtgcacctgtagtcccagctactggggaggctgaggcaggaggattgcttgagcccaggagtttgagtctagcctgggctacatagcgagactccatctccctctctctctctctcacacacacacacacacacacacacacacacacacacacacacagtcatggttccaacacgggcttctaatattgtgcctcttaaaattcctgctttatcgatctttgccctctccctgctgacgcccccctgtccccgcaccctgagtccctttcttaccagactctggcaggctgtcctcaccagctccggacgggcacagagaggatttatagtggttgagacccacttccgctccacagccacaacccccatcctttgtctaggccaaagtcctggccaacagaactgcggagggggtgggtggggacagaaagggcaatgacgtcccccaaggtcacgtcacagggaaccttctctcaagtgacagggaaccctcactctgagaattcgcctccgacaga

SEQ ID NO: 23366 - DNA, 1034 bp, Homo sapiens
cagcccactcctgctgttgaactccccctcttccctcaggctcagcacagtcggggtgcttcctaggggtgggagtgcaccctcgcagcacacctgcctccctcttggcagtcgctgtgagcatagtgaagccggccattgcacctttgcccattccccgggtgaaacgccagctccagcagggcagggactgagtctgtggcccactgtggctggcattcaggcaacgtggcctgcgttgaccctcaggttggctgcacttgcctgcaggggaaaatgccccctctgcagcccactctgagggccccttcccttccccgcctctcacccctgccttggcacatgccctttgcttggaatacctgccacctccggccccctcctggagggcaggctctgcactgcactgcccgggccccttgcactcagtctcccagcccttcccagattgtcagttggcatcatttgggcacctgtcaaccctgccaggcaaggtaggtgagctcctggaggacactaggaaatgtctgtggcatgaatgagggagggacataaaggagcccttagcgagtggggacacagacgtgttccaccagagtgcagcctggccctgcctctgggagctttgctgtggacacagacgtgttccctcagagtgcagcctgggccctgcctccaggagcttcgctgtgggaggaggtgacacgggagccgcagctaccaggcagcgagctctcgcccgggctgttctaggtgctggctacaggagcccacagaacagacccccttccttcctggggttctcctccagccaagggcttcatccctcattggctggggccgtctccttgtttgacagatgtggaggctgtgaatgcaataagtaaggctcccggaactgccttgaagtactcaggttgcctttaccaacccttactccttgtgaggatcctggaggtagctgccattaatattcccctcctttgggctggacgcagtggctcacacctgtagtcccagctacttgggaggca

SEQ ID NO: 23367 - DNA, 1058 bp, Homo sapiens
gccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcagggctctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttgg

SEQ ID NO: 23368 - DNA, 1071 bp, Homo sapiens
ctcaagaggctgaggcaggagaatcaatcacttgaacccaggaggctgagcttgcagtgagccgagatcatgccactgcactctagcctgggcgacagcgcgaggctccatctcaaaaaacaaaaacaagaaaaggtcatgggagaaagcttgaggctctggctcctggctttggcgtgggtgctgggcagcccatgcggtgctgggagagtgagcagtgggcggggctgtgggctctctacttgggatccttcgtgaaagtttgcacaggtgtgggcccgaagcggacaggttggggtgtattttggactcagatgcctggtttggggcttaagcagtcatgtttggtcgcatttactcccaggcagtacggggtggagattggggtgaagcgagggagcaggagagggaatgactgagtgggtgcagctgtggctgtagtggggtaatctcacccctccttgcctgccctctgcaggcttcaccatcatcatcgagccctttgacgacagaaccccgaccattgccaaccccatcctgcacttcaggtgggaccctgcccggtgagggtgtgaatgctctgtgggtcgggggcccagccccccgggccctcactgccctcatctctctccagctgcatggacgcctcgctggccatcaaacccgtatttgagcgtttccagtctgtcatcatcacatctggggtaaggacccttccccgtcccctcctagtccctgacctccctccatgggcctcctggtccctgcccagtcctgctgagatccctcccactgtcccgccacagacactgtccccgctggacatctaccccaagatcctggacttccaccccgtcaccatggcaaccttcaccatgacgctggcacgggtctgcctctgccctatggtgagtgggagaggctagggctggggccgggaggggagatgggggcaaggggccgccctccttccttggcttcccccactgctcaggcaggagagctttacagcgaagaggctgggttcgggattcagacagacttaggcttgattctgcttctctgtgggct

SEQ ID NO: 23369 - DNA, 1158 bp, Homo sapiens
atgtgggtgttgactgcattcctctgtgagcccatggggttccgacaccgtgtgtgtccccataggtgcgtgagaggcagtgggagaggctctgggtgtgaatgcgtgaccatgtggccatgcgggattaatgccatgactggggggttctgggtgtgattgtgcgtctcttgttttgatcagaacccacttagggccaggtgcagtggctcacacctgtcatcccagcactttgggaggctgaggcaggtggatcacgaggtcagaagttcaagaccagcctggccaacatagtgaaagtccgtctctactaaaagtacaaaaattagctgagtgtggtggcaggcacctgtaatcccagctacttgggaggctgaggcaggagaatcatttgaacccaggaggcggagtcgagatggtaccagtgctctccagcctggatgacagggcaagactccatctgaacaaagaaaaaaaagaaaaagaaaaaaagaacccacttaggaggtcgtgctagcaggtgtgacaagtgaccacatgactctggagtgtctgattattgctctgtctgtgccattatgcggcaatggctatttgtgacatgcaggtgtacagcgtgggggtgcaagtttccaaaacaggcccagtgcccaccctcactgagtgctcattggctggggagacaggcacgtgaccgtcgtgatggcggaggcagggctgctggtcctgctcatgcttccgtctgccccccgaccccgtctctcctccccgccagattctgtgctgaacgcctccggtccctgctgcatactctggagatcaccgaccttgctgacttctccccgctcaccctccttgctaactttgccacccttgtcagcacctacgccaaaggtaagctcacctttttctgtccctgctgggcctcctagcagctggaatcagggtcccagcagggtctagagggttgttggcaggacacacagggctttgtggggtttggcttggaagtgtgggccctattttgaaggcagtggggagccatacatagttcttgagtaagccttgtgctcagatttacattttcacagacttcctcgggctgcagagtggagaaggatggcatgggcagtggtaagggaggaggccagagaaatt

SEQ ID NO: 23370 - DNA, 1034 bp, Homo sapiens
ggaggatcacctgagccctggaggtcgaggctgcagcgagccgtgatcgcgccactacactccagcctggatgacagagtgagaccctttctcagaaaaaaagtaccctgggactcctgccaaccccgcgggccatttggccttcctgctagctgagaggaacagtctaggaaccacccttttctactgggtttctcttccaggatctgccactgaagcgggagggggtgggtcccagtagcctgcagtctgtccttccgactgtagctctctcattagaggagctgcaaggtgatgaaggcatcctgaggctgtacctgaaccaccatgtggatctccacaatgggtacagagcttattaaaatcaggagggaaactgggagggttctgatggggagaggcccaagagtcaccctatgagctggggaaactaaggccaggggtaagcaaagggacttgccagagatgccacagccagtgaggggctgactgcccagggtggtgaagtagtaggggcagagtgagaggcttggattaccccagctgcagagtgaggagggagaggcgatggctgagcagaggctgggagggtgacgatctctacacagaggcccagaccatcccagaggtggcgttgatagtgggagaccctctctatcccctctcagagcagccccagatcacaccagagatcatagcattgtgtaaactgggtgaccattccacctgggcccgcttttgggaagctgcaggtgaaagtgggagggccgggctttccccgacttccatcctcacctcccttctctaaagaggtaaaactggcctggaccaagatctgcccagatagaaagccaagaaacaggttctgaaacttttcttttcttcttttctcttcttttttcttttcttttctttcggagacagtctagctccgtcaccctgacggagtgcagtggtgcaatctcggctcactgcaacttctacctcccaggctcaaccaatgatcctgcctcagcttccgaagtagctgggat

SEQ ID NO: 23371 - DNA, 1031 bp, Homo sapiens
tgtagtttatagtttaaacaaacatggtaacagccctttcccaaagcagacctccttcttgtctggcgactggattgcctttgtaggactaacattagccacaagattagaaattatggtttaggagtcatgcagctggagggtacaagattctgaccctccctaaactgctcctaagatcagtgcttgagatatttcacagaccctgcacttgatggatcagctggccttacccagatcaataaactggcccatctgatcttgtggccccccaacccaggaactgactgagcgcaagaagacagctccgactccctgtgatttcatctctgaccaatcagcactcctggctcactggcttcccctcacccatcaagttatccttaaaaactctgctccaccgagatcgcaccactacactccagcctgggcgacagaccgagactccgtctcaaaacaaaaacaaaaaacaaaaaaactctgctccagctgggcccattggctcgcatctgtaatcctagcactttggaaggctgaggggggtggagcacctgaggtcaggagtttgcaaccagcctggccagcatggtcaaaccccgtctctactaaaaatacaaaagttaggcgggcttggtggcgggcgcctataatcccagctactcgggaggctggagcatgagaatcgcttgaacccggggatggaggttgcagtgagccaagatcgcgtcacttcattccagcccaggcgaaagagtgaaaatccatctcaaaaaaaaaaaataaaataaaataaaaataaaatctccctgaatgctcagggagactgatttgagtaatggtaagactcctggctggggcgcggtggctcacgtctgtaattccagcactttgggaggccgaggtgggtggatcatgaggtcaggagttcgagaccagcctgaccaacatggtgaaaacccgtgtctactgaaaatacaaaaattagctgggtgtggtggcgcacatctgtaatctcatctactcaggaggct

SEQ ID NO: 23372 - DNA, 1050 bp, Homo sapiens
attgtgctaccgcactccagcctgggcaacagagcgagactcatattcaaaaaaaaaaaaaaaaaggccgggcgcagtggctcacgcctgtaatcccagcactttaggaggctgaggcgggtggatcacgaggtaaagagttcgagaccagccgggaaacatggtgaaatcctgtctctactaagaatacaaaaattagctgggtgtggtagcacctgcctgtaataccagctattcgggaggctgaggcaagagaatcgcttgaacccaggaggcggaggttgcagtgagcagagattgcaccactgcactccagtctgggtgacagggtgagactctgccctgaaaaaaaaaaaaaaaagaaaagttcaggtgtgcagcatacaacacaaacagccgtttagggcagtcctgtgaggggcgggtatagtagccttggggactttgaggtcctcattcagaatctcccccaccccccaaagtgctccaatgaggctgtattggtggccaccttccaccccacggaccccactgtgcttatcacctgcgggaaatctcacatctacttctggaccttggaggggggcagcttgagcaagcggcaaggcctctttgaggtgagtgccaggggtttgggggacaggctggccctgagagaggtagttagggacaggcagggaggtagcaagatcccccagagggtggcaggggtttgggattacagggacgctgagatgttgcctgctggggcctcagtttctttctccataccatggtgatgatccaccttaactctggagttaagagggtgaccgggcaccatgaggtggaaggatcacctgagctcatggctgcagtgagccgtgatcaaatgatcactccagcctgggtgatagaacgagaccctatctcagaaaaaaaaaaaaaaaaaaaaaaaaaaagttgtgaggattcaaagggatgaagagtacagcagttcctagcagatagtaaatggtcaataaatgggtactgtggcaaggtggctctcgcctgtaatcccagcatttt

SEQ ID NO: 23373 - DNA, 1072 bp, Homo sapiens
tttcccatatcaattgtggatttaacaaactttcccttgtcatttgtaagtttatggctgtcatgtgtagagatggtcgttttttgctttatctatttggaagccatagtatttggatcatgtatgttgagaacttttgtgtataatgggtcacttccacctccctcccccagccctagggactcatgtagagaagtaaataattggtcattttgtttcgtcatcatccattgcttttgtcagtttatttattttttatttatttaatttatttttaatttaatttaagacagtctcgtgctgtcacccagagtggagtgcagtggcctgatctgagctcactgcagcctctacctcctgggctcaagcaatcctcccacctcagcctcctgagtacttgggactacaggcacgtgccaccacaccctgctaatttgtgtattttttgtagtgatggggtttcaccatgttgcccaggctggtcgcagactcctgagctcaagggattgtgtcccccctctgcctcccaaagtgctgggattacaggtgtgagccaccgtgcctggccaagtttttttttttttttttttaaggggtaatgttactcctctacttgtctcttggttcgtgttttcccagccagttttttgccgtcttttgattttccatatttttggttcacaatgttttacaatgaatagattttcatggagtagttgctgaaggctgacctagtgtagggccttatgctgggctcagtgtgggggagttagaagatcctgtctcaggcctggagagagacccaccccagacgatgacccagagtaggcagggaagagggaacccagaggtcccctctgggcaggtgggtgatttccaggaagggagttggagaaggcctctctaataaaactgcatttgaacacagacctgaatgaagtaaggaattgagccttgcagagggggaatgtattgcagttggtgggaacagcaaatgcagagaccagggaaggcaagagcccggtaactttgaggaatagacagcaatgagcccaccgcatggacgccctgg

SEQ ID NO: 23374 - DNA, 1060 bp, Homo sapiens
tgaagagaaaatatttctaactaggtttttcttgttgttgttgttgttagtttgcttttgttcgtttaacttttgggtcattaaggcctcattgggcagtttgacaactttgtaaattcaccttgaaacagtttggtttattgtgagctttctgggcttaattcattggctgtgatagtaagcttatggttgaaaacactggcttcagagaggcgcagggtcaaaaccctgcttctgttgctgtgtgaccttggccaagctgcattcccactctgggcctcagttttcttttccctttttttttttttttgagacagagtctcactgttgtccaggctggaggccagtggtgtgatcttggctcactgcaatctccgcctcccgggttcaaatgatgtcttctgcctcagcctcctgcgtagctgagattacaggcttgtgtcaccacgcccagctaatttttgtatttttagtagagatgaggtttcaccatcttggccaggctggtctcgaactcctgacctcaggtgatgcaccctccttgacttccctaagtgttgggattacaggcgtgagccactgctccgacctctttttttttttctttttttttgttttgaaccagggtctcactttgttgccctggctggcatgcaggggcatcatcttggctcactgcaacttccacctcccaggatcaagggatcctcccacctcagcctcctgagtagctgggactacaagcgtgtgtcaccacacctgcctaatttttgtagagtcagcgtttcaccacgttgcccaggctgatcttgaactcctgacctcaagtgatccacccgcctaggcctcccaaagtgctggggttacaggcatgagccccagtgcccagccagcctcagtattctcatgtaaaaatgggaccacatttaaactctgagcttctcgtaaggagttgacgtggtaactgatgaggtggcatatataaaatgcctggggtgtattatgctctcaataagtgtgaggtctttctatgatttttattctttcaagaaaaggtact

SEQ ID NO: 23375 - DNA, 1045 bp, Homo sapiens
gggcagcaggtcacccctgttcaggctctgagggtgccccctcctggtcctgtcctcaccaccccttccccacctcctgggaaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtggggtgagtgcctaccctcggggctcctgcagatggggtgggggtggggcaggagacaggtctgggcacagaggcctggctgttgggggggcaggatggcaggatgggcatggggagatcctcccatcctggggctcagagtgtggacctg

SEQ ID NO: 23376 - DNA, 1057 bp, Homo sapiens
gggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctc

SEQ ID NO: 23377 - DNA, 1061 bp, Homo sapiens
ggcccagggggagctctggtaaaaggcggctgagttttcttccacccccttcccaagttgccctcgtggtccagccgcctggatcgggaagacaaaggcctctggagggaggtcggggctgcttgttgcccatccagaggaatcttggatggtgggatttgggcatggtcttggcaaggtctttctcccagtgtcaaggctcggggggatgcctgtgtgcctctcccgacggctccctccctccctggttcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccaggtaccccttccccccaccaggtaccctttccccccacccagggtgtgcggtgggcggccccctgggtccctctggttggtggggactggatggaggcggacacaagaaggccctgcactgctgggagttctggagggttagggcccccggacctgaggtgtgcaaatggggtctctgtgccagagctgcccccagcgcccccttcctgctctccacccagcaagctcacatccctaactccatcatgaccatcttggaggccagcggcaagcaggagccagaggccaaggaggcgcctgcggggcccttggaggaggtgagggccctgcagcccacccatctggatccccagactcccaccccctaccccaagccagcaaggctcaccatggcctcctcctgaccccgagagactcaggccacccctgcctctgggccacccgtctcccaggggatgctcctgctgggagttgggggtctgggggacaactgccccttcctccccatgctcttggtgaagaactcaaagaccacctcagggtggttccttctctttccggccgtcctctgagccacccacctctgagcttctgtgtggccctccctatccccaggatgatctggagcccct

SEQ ID NO: 23378 - DNA, 1114 bp, Homo sapiens
tcaggtgttctgcctacctcagcctcccaaggtgctgggattacagatgtgagccactgcacctggcctgtttgtttctgagacagggtgttgctctgtccgcaggctggaatgcagtggtagggatcacagctcactgcatcctccacctcctgagctcaattgatcctcccaccttagcctcccaaaatcctgggattacaggcgtgagctggccaaattattattaattatcataattgttgttagcagtttatgcagtagccttcagatcttttcccatgtacataaaaataatagtatacttagccaatgtttactgtatatactaactcatttaatcctcaaaatagtcttgggaggtaagccctgttactatccctgtttcctagaagaggaaactgagagccagagaagttaaatgtcttgcctcaggtcattctgcgtatacataaacacatacttgacaaaaatggcttgaactgcatgtattgtcctctgatgcaacaggctgtcagggacctcttttcaggataatatactgagattcaccttttttttttgagatggagtctgtctttatgtcccagactggagtgcagtggcatgatctcggctcactgcaacctccgcctcctgggttcaagcgattcttctgcctcagcctcctgagtagctgggattataggctcagctaactgttgtatttttactagagatggggtttcaccatgttggccaggctggtctcaaactcctaacctcagacgatccacccgtttcggcctcccaaagtgttgggattacaggcgtgagccaccgcgcccggcttcaccaattttttttaccctgtttcctctgctggtttttggtttatcctttcagatttttttccttttttaacatatatattttttcccctttcttttttttgagtcaagttctcactctgctgcccaggctggagggcagtggcccgatcttggctcactacagcctctgccttcacctccctgagtagctgggactaccaggcacgccaccatgcccagctaatttttatattttctgtagagatagggttacaccatgttgcccaggctgctctccgact

SEQ ID NO: 23379 - DNA, 1133 bp, Homo sapiens
attttggttgatctgaatgtattatcatgaaaaaagtggaaatgtttattatggggttttattttattttattttattttttgaggcagagtctcattctgtcgcccaggctggagtgcagtggtgttgggattacaggtgtgagccaccatgcccggcctgttttttttatgttttgactggggacggcatgccatgccggttgtctggtggccaggatccttggcttacgtaaacagacctgggggtaaaaaacaattcctttcagataaacagtactgtagcatagtggtaaggaagatatgcagccatgctgctgactctgcctcttacaagctatatgcctttggtcaggtcactttacctccctggtcttcagtttcctcatctgtaaaatgaaaattaaaaatactaactcccagcctgggcaacatggcgaaacccttctctacagaaagtacaaaaattaaatggggattcgcctgtagtctcagctacttgggaaaatgaggtaggaggatcgcctgagcccgggaggcagagattgcggtgagctgagattgcggcactgcactccagcttgggcaacagagtgacaccctgtctcaaaaaaacaaaaaatgtaaacctaactcatgtatattaattctaatatatacatattaattcatttaaaccttggtgtctgaggtttaaatgagttaatatgtatatcttagaattgtgcttagcacatattaagtgttctctctctctctttctctttctctctctgtgtgtgtgggttttttttctttttttttttaatttgaaacgcagtttcactcttgttgcccacgctggagtgcaatgatgtgacctcggctcactgcaacctcctcctcccaaattcaagcgattctcctgcctcagcctcccgagtagctaggattacatgtgcctgccaccatgcctggctaatttttttgtatttttagtagagatgaggtttcaccatgttggccagactggtctcaaactgctaacctcgggtgatccacccgccttggcctcccaaagtgctggcattataggcttgagccaccgtgcccggccgtgttcaatatatattaactgattattttttctttttt

SEQ ID NO: 23380 - DNA, 1033 bp, Homo sapiens
tgcaaaatctgtttgtttgttcgtttgtttgtttttttgtttgtttggtggttttttttttttttttttgagatggagtctcactctgtcgcccaggctgcagtgcaatggtgcgatctgggctcactgcaacctctgcctgccgggttcaagcaattctcccacctcagtcaactgagtagctgggattacaggcacctgtcatcatgcctggctaatttttgtatttttgtagagatggagtttcaccatgttgcccaggctggtcttgaactcctgacctcaggtgatctgcccacctcagcctcccaaagtgctgggattacaggtgtgagccaccatgaccagccaaaaatctgtattttaaattacttgttgcctgattgttaagccaatgtcacatattttagggttttgttactgcagtgccactaccaggtgccaagttatgtgttagtcagggtacaggctaagctatgaataccaaaaaacctcaaaatacaatgacccatgattctggatatgatgaaattgtttatgaaagaccaatagtgctgctaggagtaatttgaaatgccaattaaaaatgtaaaaagcagcaatgattatttcaaagcattggtgagctgctaaggcaactaggagtcaagagaacaaaatctcaaatatgggggaacagtatagagagctgagctgagccaacattttgcagtttctgtctccagggcatttgatgcttctgggtatggggaaggagactgaagatctgggcaaaagagttgggcagaagaatccttctcagacacccaaagagcaggaaggacaaaattagacttgaaggactaggacctggggaaaggagaagttaaaaagagcctaatgattttctggttcctgtttgaggacattgcagaactctgaagctacatggggtagagtctaagaagccaggaagaaagcctctgaaaagcagaatagagtttcagcagacttgcaatgctgaagagacaagaagagttcaagagctgccagg

SEQ ID NO: 23381 - DNA, 1087 bp, Homo sapiens
agccgggcatggtggtgtgtgcctgtaatcccagctgctcaggaggctgaggcaggagaatcaggaggccttctcaaaaaaaaaaaaaaaaaaggaatcaaagcccgacatggtggtggtggcacatgcctgtagtcctagctatttgggagactgaggctggaggatcacttaaccccaggagtttgaggctgtagaatgatactgcacttcagcctgggtgacagagggagactccatctcttcaaaaaaaaaatgggtgaggtggggtggctcacgcctgttatccaagcactttgggaggctgaggtgggtggatcacttgagtgcaggagtttgagaccagcctgggcaacatggtgagacactgtctctacaaatacaaaaattagtcaggtgtgatggtgtgtgcctataatcccagttactagggaggttgaggtgggaggatggatttagcctgggaggtcgaggtgcagtgagctgtgatcccgcctctgtgctctggcctgagtgacagagcaagactctgtctcaaaaaaaaaaaaaaaaaaaaaatagaatcacatagttggatcttggaaatgcctgctctgtcagtagcattcaggagtttaccacatgctagaagatcttgggatcttcacagccccactcatctagcccagactttctagtttacatttaactcttatctctcagatgtaaatggttctatgattctgagattctttggtgctccagtgcctcctgtttccctggctggggtgtctgcaggggtgtgtaggaaggcatggatggggccaggcgcagtggctcactcacgcctgtaatcccagcattttgggaggccaaggtgggtggatcacttgagtccaggagtttgagaccagcctggtcaacatggtgaaaccctgtctctactaaaaataaaagaaaaaattatcagagcaagtctgggcccggtggctcacgcctgtaatcccagcactttgggaggccgaggtggggaaatcacgaggtcaggagtttgagaccagcctggccaacatggtgaaaccccatctctactaaaaatagaaaaaat

SEQ ID NO: 23382 - DNA, 1022 bp, Homo sapiens
ctgccctgcacggctgaagagctggtgaggagatgggggatgggacgggttggtggctaggggggtgacttggcccaggcatggggccaacgcactgatgtgtcccctccattcttgccaacgacagagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaaggttagctgggcctgtcggggaggacagacagggtcagaacctccttcccgccccaacctggtcttgtggcaggacacaaggatctgagccttgggaccccagggcctcagaaggggagggccctgaatcctagtgttctgggacctttggaattctggaatcttagaacctcagttgtgtgtgtgtgtgtgtgtgtgtgtgtgtgtgtgttgttgttgttttttggagacagggtgtcactctatcacccaggctggagtgcagtggcgcaatcacggctcactgcagcttcaacctcctgggttcaagtgatcctcctgcctcagcctcccaagtagctaggactacaggtggtgccaccacacccagctaattttcttttcttttttttttttttgagacggagtctcactctgtcgcccaggctggagtgcagtggtgtgatctcggctcactgcaaactctgcctcctgggatcaggacattctcctgcctcagcctcctgagtagctgggactacaggcgcccgccaccatgcctggctaatttttttgtatttttagtagagacggggtttcaccatgttagctaggatggtctcgatctcctgaccttgtgatccacctgcctcgacctcccaaaatgccgggattacaggcgtgagccaccgcg

SEQ ID NO: 23383 - DNA, 1027 bp, Homo sapiens
cctccggagtagctgggattacaggcgtgtgccactacacccggctaagttttgtatttttagtagagatggggttttgccatgttggccagtgtggtctcaaactcctgacctcaagtgatccgccggccttggcctcccaaagtgctgggattacaggcgtgagccaccatgcgtggcccacactactaagatttaatcacactacttagggattgcctggattccaggtctacagaaaagagaaagtggggtacagggggtgagcagacctggagggatagtgaccttaggggtgggggtgaggagaggcattttcttttggaaagttggggttggggaaagagggggaaccaaaggggcctcagaaaaaggaaggtcagggttagaagggggaacaggtgtctctagggagatggacaggagttttggggaggactagaaggaggtgcttaccatagaggactggggctgggtcagagctttggcggggacttttgaggcatccattgttgcagtgggaaaaggtggggtgtgaggcgcgttcagggcctggggggcagatggggtgatgtcggggctacaagctggaactaggggtggagctttggagggaacctttgaggtatcccttgttggagtgggaaaattttgggtgtgaggcgtgttcagggtctgggggacagatggggtgatggcagggctacaagctgaaactggggacagagctttggggggagcctttgaggtgtcccttgttggagtgagaaaaggggtgtgggtgtgttcagggtctgggggacagatggggtgatggtggggctacaagctggaacttggggcagaactctaaggaggggtgggcctgaaggggctgatacacttacggatagtagtgccttttggaggagatcgtgctggcggggggtgatgggacaggaccaggtgagagattgggtggaaagggcacaacttctcaagaagagacctaggaggggcagacgccatgtctcttactctctggcgc

SEQ ID NO: 23384 - DNA, 1071 bp, Homo sapiens
ggagaccccatctcttaaaaaaaaaaaaaaaaaaaaaagttaaccgggcgaggtggcacacgtctgtagtctcagctacttgggaggctgaggtgggaggatttcttgagcttaggagtttgaggctgcagtgagccacgatcatgtcactgcactccagcctgggcaacagagagagaccctatctctaaaaaagaaaaaaagtagaaaaagaaaaaaaaaagttatgatgtccatggctcctgccacgaaaatgctaaattaaatcagaatctctgcaaagtgagatggaatctgcacatcagtatttttaaaagcccccaggtgattttctaagacacagccagaagccagttcatccactcactattccagtagtatagatgggcatgctctcagcaccttagagcagtctatggcccttggtccctcttgagggtgggggcagctgcctttttcatggctgccttccctgctgctccggcatactgcagtgcccagtgaaaccggctcaatgaatgaatgacagaagtctggatttacacctttagtgaccttgttcaggctttaagtactctttcatatcataagctggcctcacttgaatttttatcttcattgttgtctctcccctaaacctgagttttgttttgtttttgtcatttttattattttttgtttttttagacggagtctcgctctgtcacccaggctggagtgcagtggcgcaaactcagcttgctgcaacctctgcctcctgggttcaagcgattctcctgcctcagcctcccgagtagctgggattacaggcgcctgctaccacacgtggctaatttttgtatttttagtagagacgggatttcaccttgttggccaggctggtctcgaactgctgatcttaagtgatctgcccacctcagcctcccaaagtgctgcgattacaggtgtgagccaccgctcccggccctgttattttgttttgaggcagggtcttgttctgtcacccaggctggaatgcagtggcatgaccaccactcactgcagcctctacctcccagactgaagcaatca

SEQ ID NO: 23385 - DNA, 1049 bp, Homo sapiens
cagggttgcaccacgttgaccaggctggtcttgaactccggacctcaggtgatccacccaccttggcctcccaaagtgctgggattgcaggcatgagccactgcgcccggctctgcctccttgatcatgcacctggccctgtgctccaccttgtctgggcagagttcagaggtctttgtctcctctcaaggggaggacagactttagagaacaggctcacctgcacaaggtcaggatcggtcccagctacattagccaccacactttcggtgtcagcaggccagagctgctggtgtggactccagcaaccagggaagcagtgattggacctctgaatgaccagggggctttggagagaccaggcaaagcccatgcacttggccatgggctgaaaagactgctcgggccagggttgggaccaacccttgtccagcacaggctgcgtgccgctcctggggccacagaaccatgctgttccttcttccttaatggagcccgaaaaattctgtattgagctcccagtttctgggccctgcttggggagacagctgtgaatagagggaaatccctgccttctggagccctagaaccttccttggagagctagtgggcagtgtgagcagctgccgggctgtcctggcagtggacagttccgaggggcaccaggtgtgaagtgggtgcgtgggtgattggagcccagctgcctggggcttggcagagctggggctctgggctgtccagggaggagctggcagccctgacacagcccatttcctccctgcggtgggtgcagacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcggtgagtgggggccccggtgcctcaccctggagctgtgcgggatctggaggctatcagagtggttcctgctgaggccccaggcctc

SEQ ID NO: 23386 - DNA, 1317 bp, Homo sapiens
taccttttttttttttttttgctccttgaggggatctccctatgttacccaggctggtctcgaactcctggggtcaaatgatcgttctgccttggcctcccaaagttctgggattacaggcgtgagccactgtgccccgtctgtggctacttttacctgcccctaatctgagcctctcaggggtggcaggaacaagccatgtcgttcccctgctctaaacacttccccggctccttgtttctctgaggctttttcttaggatgaaatgcgcattcctccggggctcaccacccagcacctgtctcatcccctgccactctccttgcctcctgcagcctgtaccactgacctctcaggcctgggctcgcccttgctgcctcagggcctctgcacgggccctttccctctccagggccctctccttatcttgtgaagtcctgctggctcgtgcttcctcaggaaagcctcagtggcccccagggaggagggcaggctgcctgatgtctctctgtgcatctttaattcattgccctgctcatggctgatgatcctgcacacttgtgggatggtccagttgtgtcccccattccccttcctctcaactgcaagaccccaaggggtcaggctcacctttgtctctccagaacccagcgcagtgtggggacttgttgggcgagcatggagactctgcccagcagaggaaggggagagttcccggctggagcccaggctctgagggcattcctgccagggtcatgtgggtggaagacaggggccctcaagccctgggtgtcggtgtctgcatgactgctgggatggatgcgaagacactgaggcagctccccccaaccccagctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagtgagggcagcaagctcagagccgggggcaggggcatctggggacgggggtgacagggtctcagtgacatcaggctcctctgtcatcccacaggaatgcggcgctagatgtggaacctatacatgctttccgggctcacaggtagggaggtgcccctgagcctgctagaaactcgtcctaaatgcagcctgactcctgacctgctcactgccatcgcgggaggcccacggcaggaggcaggacagcagggggctctgagtccccgcccccttcatgatatacacag

SEQ ID NO: 23387 - DNA, 1069 bp, Homo sapiens
tgccacattgacccaccagtttactctcccatcagcggcacctcttttacacacctttacttgaacacttagtgctaacagacggtgtgacttcccctgtgagatcccttaagagctaggcagtgtcagattttcctgatggactctgaataacttttctctgaagagcttaatacagctgctcctagcagaagacctgccgtgcgaccctgcttggtacctgtgtgttgaatggcagagaaggcagcccccagggaggtcctgccagtagtcaccataagtttggagcaggaaggtggcggagctgcagtctgataatgagcaggcatttgctaggtgggggattctgagaagtaagtaacgtggtttctgcccatccgaaacttccaggctggcagaggaagcttgtttgtgcaggggaccgcagagctgtagatgttcatgcacagttgattgtgtggctctgcccctgttctgtggcaactctgagaggggaagctttttgaggatgggagggaccttttaatgagggatctgaactggagatttgtataggagcagcgacagggacctgcagtgagtgcggtgccagcagagaatgtgcggagctgcccctgcccacttcagcttcctgggggcccattcctgccagcagctgctgaagcttgggaaggaggcccttaggagatgcagggctagatggcacgaaacggggactcttcccagctagctgggacaggaagcagcgaattcagagaggcatcagctcctgggaggactgaattgctgggactcctccgaagcctttagatgtcgccttgctgggaatagctggaggggcggagaggcagtagctgccaggtatcagaaggttttgggagcgcatgctctgcggctctggctagagggagtggcagtgggtggatatggtgagcggcacttccagatccccgaccgaccctcaggcctaccttggccctcgcagaccagacagcccgtgggggctgctggcgtttgcagcgagggagagactggccactgacgcttcccgtttttggtgggtttccac

SEQ ID NO: 23388 - DNA, 1036 bp, Homo sapiens
tgcacagtgcagggaagggttctttggagtggaagtgtggacagagcagggaatgtaccctaggagcctggatgggagagcttaagagtggaagttccactttgggggtgtgcaggagtgggcgcgatggcactgagatggcacgtgtgttgtaggatgtaggtagagagccctgaactggagtgtggggtgttgggcatgtccagtatggaggtgagggtcctgggatggtgccaatgaggacgagttaggggttaccctggggtgatgctttaggggggagaattttgtagagcccgaaggcaacatgaggaggcatctcggaacgggggtagactggggttggggggaaggggatatgtttgtggaagtcttgggaaaagaccccgtggtttttggggtagcttgggacagggatgttgaatggaagagtctgaggagttgggctagggtttgtgacctcgtggagcgtcaggtccattggcagtgactggaggaccatggagatgtccggatttgaagggatcaggaatggcccgctggaagtctgaagattcttggactgggttattattagcagaaattgtcattacctgcttgtagcagcccacctttccccttccgatttgccgtttgctatctagtaggaagctggtacccaaataaatagctgatgagaattgtgtcggtagggatggggtgcggtggctcacgcctgtaatcccaacacttggggaggttgaggtgggagaatcccttgagcccaggagttcgaggccagcctggccaacatagcaagacctcatctctacaaaaaagtacaaaaattagccgggtgtggtgacatgcgcctgtagtcccagctactcaggaggctgaggtgggaggattgcttaaaccccggaggttgaggctgcggtgagccatgattgcaccactgcactccagcctgggcaaaagagtgagatcctgtctcaaaaaaaagcattttgttcataggatgagtaaagaccctccagtaactctccccctgccc

SEQ ID NO: 23389 - DNA, 3022 bp, Homo sapiens
tggttggggtggggtaggcgaggcctcacctgggctggacctggagggtgggcggagccccggtcagcaggttaacctaactcagctcccccatcccttgcagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctgtgagtgtcagggggctgcggatgggacccccggacccctgttgacccccatcttctcccacaagacaggcatctgcctaacctcccaccttctccctcagggtcacggccacagcgtccagcgtgggggcagcgggcatccctgctggaggtgtcctcactctggccatcatcctcgaagcagtcaacctcccggtcgaccatatctccttgatcctggctgtggactggctagtgtgagtgtgggtctggagactggggcagggccaggggtacccctgggaaagaggatgagtgagtgagagtccttagagcctctggacagaagaggaagagaagaaggaaggaattctggaggaaatggggggaaccttgagcattcctgagggcaaggaatggcatctttgtggctctaagagggatgtcagaaaagtagagcgtctgtgtggtgaatacagcagactcttcagccagactgctcaggttcacatcccagctccaacattcactgttgtgacctcgggaagtgcttaatcttcctgcgtctcagtttctccatctgtaaaacggggagaagaacagtctctccctaaggattagataacagacacacctcccttagagcagcccccagtaagcagtaattgctacataattatttgctatcacgattaagctattaagagtataaagattggaaagcagccaggcacggtggctcacacctgtaatcccaacattttgggaggcccaggcaggtggattatttgaggttaggagtttgagacaagcctgaccaacatggtgaaaccccatctccactaaaaatacaaaaaaattagccgggtatggtggtgtacgcctgtcctgtgatctcagctactcaggaggctgaggcaggagaatcgcttgaacttgggaggtggaggttgcagtgagccgagattgtgccactgcactccagcctgggcaacagagtgagatcctgtctcaaaaaaaaaaaaaaaaaaaaattctggaattaattattggcaatggttgcacaagtctgaatatactaaaaaataccaagatggacacttttaaaaggttaattttatggtaggtgaattataattttttttcgagacacagtctggctctgtcacccaggctggagtgtagtgatgtgatcatggttgtgatcactgcagcctccacctcccaggctccagcgatcctcctgccccagcctcctgagtagctgggactataggtgtgcactaccatgcctggctaattttttttttttttaaatatatataaagatgggatctcactatgttgcccaggctgactccaactcttaatttttactttttagattccagggggagagaggcaggaggcttaggccttggccctttccttccctctcaccctctcccctcccgcttactttgctgtcatttctacccctttagcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaatcaggtgttcttgagaatttgacttaaagcactggccactgcaatgacagtatctgctcatcaagaaacaccactgggctgggcatgggggctcacacctgtaatcccagcactttgagatcactccaggccaggagttcaagacaagcctgggcaacatagtgagacatcgtctctacaaaaaaatacaaaaattaaggccgagcacggtggctcacacctgtaatcccagcactttgggaggccgaggcgggcgaatcacgaggtcaggagttcaagatcagcctggccaacatggtgaaaccctgtctctactaaaaatataaaaattagccagacatggtggtgggcgcctgtagtcccagctactcaggaggctgaggtaggagaattgct

SEQ ID NO: 23390 - DNA, 1720 bp, Homo sapiens
tactaaaaatacaaaaaattagctgggcgtggtagcacgcgcctatagtcccagctacttgggaggctgaggcaggagaatcgcttgaacctgggaggcggagggtgcagtgagccgagatcatgccactgcactccagcctgggcaacagagtgagactccatctcaaaaaaaaaaaaagagagacatgttgcccaggctggtcttgaactcctgggctcaagcgatctgtctgccttcacctccctgcatgctgggattacaggtatgagccaccgtgcctggcctatttttattttttgtagagactgggtctcgctgtgttgcccaagctggtctcgagaactcctggcctcaagtaatcctcctgctttcacctcctaaagtgctgggattataggcatgagccactgtgcccagcctctttatctttcatcatctgcagagagcgtattggctcaagtcatgctagctgccatagcaaaccaacccaggaagtgtgaatggcgcaccttgatggacatttctttctgtctcccatgtgaagtccaaatctggtgactgcttcacatggtgatggaagcactgagactttttttttttttttttttttgagatggagtttcactcttgttgcccaggctggagtgcaatggcatgatcttggctcacagcaacctctgcctccctgattcaagcaattctcctgcctgagcctcccaagtagctgggattgcaggcatgcgccaccacgcctggttaattttgtatttttagtagagacggggtttctccatgttggtcaggctggtcttgaactcccgacctcaggtgatccacccacctcagcctcccaaagtgctgggattacaggcatgagccaccgtgcccggcctgcacggagagttttatctccgggctgctctacctttgaggggaaagagagcatgagattggcatgggggcttcaggggccaggcctgggagtggtgcccatgctgaagcacacattgctggggcttctcctgacctcaggaaggcaggaagatgtgggtagggtgctgagcctcacgcctggccactgggcccgtggaagaggcaacaagctgtctcctgtgttactgatcaggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccaggtacggccttggggtgggctagggtgggatgtttaatccgctaagcggcatggagcggatgaaattttctctgcccgggacattgtatctgggtacaggggccatacttcaggagattctcataaggtcctggatttatccccacccttaaaaagataggaaatgattgccctagagatttatttccctctttcttacactgcctccccgtggccctggaggcactcttttttttcttttgttttaaacaatggcgtctcgctctgttgcccaggctggagtgtagtggtgtgatctcagctcactgcaacctctgcctcctgggttcaagtgattctctgcctcagcctcccgagt

SEQ ID NO: 23391 - DNA, 1044 bp, Homo sapiens
ctgccagaggcaggtgcggggcattctgtttgggatggggcaccctctattcactctttggagccagatgacctgcatttaaatccagcattgaccattccctgtctatgtgattttaggcaagtgattttccttctctgcttcagtttcctcatctataaaatgggaacggcactttgggaggaggtgggtggatcacttgagatcaggagttcaaaaccagcctggccaacatggtgaaaccccatctctactaaaaatacgaaaaaattagccaggcatggggacacgcacctgtaatcccagttactcgggaacctgaggtatgagaatcacttaagcctgggaggcggaagttgcagtaagcggagatcatgccactgcctgggcgacagagggaaactctgtctcaagaagaaaagaaaagaaagtgaatacggtacacggaaggtcttaggacagtgcctggcttattgcgtgcctacagtaaatcctagtagctaatatttattgggctttttgcttgtataacttctggatacttcccactggccagaacttgggtatctagcctcccttctctgcacaagtggctgggaaaatatgcctttcttctgtgacttacaagaagggactggggagataactagtcagtgatgatggatgggcgaccgatgatcgagtagtctagggaagtgatgttgggaggcttttattttattttatttttttgagatggagtttcgttcttgttgcccaggctggagtgcaatgacgtgatctcagctcactgcaaactccgcctcccgggttcaagagattctcctgcttcagtctcccgagtagctgggattacaggcatgcgccaccatgcccggctaattttgtatttttagtagagacggggtttctccatgttggtcaggctggtctcaaactcccgacctcaggtgatccgcccacctcggcctcccgaagtgctgggattacaggcgtgagccaccgcgcccggacttgggagtcctcttggcttggagccatccc

SEQ ID NO: 23392 - DNA, 1531 bp, Homo sapiens
actgtcacacaagagtaagggtagccttgtaaacacagatgcatattcatgagatatgaagccgtcccttttctccctccccgccaccgcctcccaacacacccagatcctcccccatactctcagagccgctggcaggccctccaggaggaagtggctgatgcaagctgtccagggtattaagtttgctgcatggggtggagctgaggcccggggcgacctgccctggcctgccgtgggaggccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactatggtatctaataaccctctgtgtgtctgtctctgcagaaatatcttcccttccaacctggtgtcagcagcctttcgctcagtgagtcctcaggggtgtcctgaggggatgggggtggacagggagggatgccagccagggggagcccttgctacctgattttggttagttcctggaaaaatgcatgtcaatgagaatacgggctcagagcctcctgtgagttttaattctagctgtgtgactctgggtaaatgtgtttacctctctgagcctcggttttccacctctggaaaatgggggtattgatcatcctgccccatggggttgccagcagatgaaatgagatcacattgaaaggatgtggaagggcaggctttgagcattgttagcttggcatggggttgggaggccctggtaacgatggacactgactcttcccaaccccacctacagtactctaccacctatgaagagaggaatatcaccggaaccagggtgaaggtgagagcagtgggaggcagcgggggctctacctctttgcctattgctataattttttggttttatttctgccttagtctttgctgtggaatttgattgacactctgcagtccttccccaatttctgtcttttctgccttctggataggtctctactttgtcccctcttttcccaccccaggtgcccaggctcttcctttctccctcaccccccaaccccattccatgctgccctctccctgcccccttccatccaccctcaacctgctcaaactggcagccagccagaggtttttgttgttgtttttctgacacaggatctctctccatcattcaggctggagtacggtggcacgatcacagctcactgcagtctccacctcctgggctcaagtgatccttctcacctcagccttcccagtagctgtgactataacacacctggctaatttctgtatcttttatagagactgagttttgccatgttgcccaggctggtcttgcactctcgggctcaagtgatctgcccaccttggccgcctcgcaaagtgctgggat

SEQ ID NO: 23393 - DNA, 1206 bp, Homo sapiens
cagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgct

SEQ ID NO: 23394 - DNA, 1066 bp, Homo sapiens
acaggtgtgagccaccgcgcctgaccttttgccatctctttgcatcgatctttgcttttgtttctctctgtgtgtctccttgcctctctccctgtcactgtctctctctctcccctgcctcccccttggtctctttttttgctgtctctttctgatgaccttgttcccatctctgtgcgtgtgtggctctctccctgcccatctcttaccatctctgccttcctctcccaggtcttaaacgaatatttccacaatgtctgtgaactggacctggtgttcaacttctacaaggtaggctcctggtgaagaggaggctgaaggagccagaggagggggacgggggggacccgtggtgcactagccacccggagcctctgctgaggtctgtgtcccagctcgaggggcatcagagccccagcttccagggtccgggccagcatcctggggggcctcgtctcaccccagggtctcccctcacacaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccttgccgtctttgagcccttgcctgtctcccctgggaaccagatacctaggatgccttgccttcagtccatcagtcagtcagtcaacaaacgcccctcattgtgctgagcaaggtgagacacccaggtgctcttcagacctgctcctgctcaccaagggcccccaggctggaaggggtgatgggtttagattccaggcactt

SEQ ID NO: 23395 - DNA, 1065 bp, Homo sapiens
gggaggcctgctatcctgcctctgggccacttgaggggcctcaggaagtgtgtgcttgtggctgcatctgcccgtctccctggcccaccatgtggctgcaggccaagctcttcattgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtctttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttattttaaaaagcttgtgggtctggtctctccaggctgccccagaccatcccttgccctgggaattaacgagggtggaaggtggctggggggtgaaacaaggacctattctctcagcggtcggcctcagggtaacatgaggacactgagggacaatttgtgcctccaaacagtgtcagctgtcctcagtggatgg

SEQ ID NO: 23396 - DNA, 1034 bp, Homo sapiens
aaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctgacacgggtgcccagcccaagggtgctgagggcaatggcaagagctcggcctccaaggctaaggagcccccgttcgtccgcaagtctgccctggaacagccagagacagggaaggccggtgctgatgggggcacccccacggacagatacaacagctacaaccggccccggcccaaggctgctgcagcccccgctgccaccaccgccaccccaccccccgagggtgccccaccccagcccggggtgcacaacctgcccgtgcccaccctcttcgggacggtgaagcagacacccaagacgggctcaggaagcccatttgctgggaacagtccggcccgcgagggtgagcaggatgcggcatccctgaaggatgtttttaaaggcttcgaccccacggcctcccccttttgccagtagtgtccagccag

SEQ ID NO: 23397 - DNA, 1050 bp, Homo sapiens
gcagcacttgacccgtttcattctcttttcctggcttttagtgttgaacatggtcgagttcactatgagatgcatggtgtttccttactgattgttagaaagaaaccgtgcaactcctatccatccaaaataatttaaaagtacaggaaagagtacagaaatccctggcctctccagaatctgtgttccagagggactgtttctgtgtgtcttttcaaagctttctccttgcgtcttacaaacgtacatccaatgttccatcctgtttccacctcataagcgtttgcccgcatcactcaaccctctctgtgaacctcattcttcatgtaggcggggctacccatgggccgctctgttcccctgagacctggggagggcaggcaggggcaggctgtgcgtccttctccatcgccatcggtgtgggtttgcagtgaggggcaggggggctggagttggcacctggaggcccttcccgacatgaaccctcggttcttccctgccacagaggactacgggcactacgaagagctgccaggggagcctggggagcacctcttccctgagcaccctctggagcccgacagcttctctgagggagggcccccaggccggccgaagccaggcgccggtgtccctgacttcctgccctcagcccagagggccctgtacctgaggatccagcagaagcagcaggaggaggaggagagagcgaggaggctggctgagagcagcaagcaggaccgggagaatgaggaaggcacgtgtccgccccaggggccggggcacaggccccaggccgctgtgcaggggagcggcggtggtggggtgttccaggttgggtttcctgtcaggaaggagcccatggctagggaggacccctgtccagggccatgaagccgggctggggctgctgcatgtccctgagaaaactggcagtcaggggtggctttctgtgttgggttcaggagagaccctgatcccatggagtaggatggagggctagttcctggaggagacagtggccaacaggattgaccgcctgtgccctgc

SEQ ID NO: 23398 - DNA, 1021 bp, Homo sapiens
ttctgtgggtgcgctaggtgtgtgtgctgctgggctgtgtgggattagagttagctgtagggtgtgtgtgtgtgtgtgttgctgacagttggtgatgatgtttgagggttgcgtgaggagggtgggttggtgtctggtggtgtgttgaggtctgatggcatgtgtctgtgtgtgcctgatctacgtgtgtcctgagagttggtgacatgtgggtgtgttttgggggtgttgatgtatgtgtgtccgtgggtgtctgttttgtgttgatatgtgagtccagaggtgtgcaggtcttatctctggagtgagtgtgtgtgtgtggagaggggcatgtttgggaactgaggcagtgcctagcttgtgtgtgtgtgtttgtgtttgcaaaggctgcattgtgtttgcatgtgcccctgggcatatcaacagtgggtcagtgtgtgagactttgacagtttggatgtgtggggatggattgtgccagccagtgtgcgcagtatgtagagtgcttgtgatggtctgtctggatgctcctgctttggtcgggggtgtgtgtgtattgtgtgtactgagtagtgatgtccgagactggggccatctcagtgtttgtgtgcaagtgggaggtggggtgggcggtcaggctggccagtcccgtgtgagtccttgtgtgtgtgctgtgggggcctcgctgtgcctcactgccctccctgtgtgcccgtcgctgtgttgggaaagttgtccccaccagcccatgctgtgagtcccaagtggagtgagtttgtgttgtgggactgtcacagccctcatacacacacctgctagacccctccatccgtcctgtgtgagccctgtccttgctgtgagagccgtcctgtgccccctgtccctcctgtgtgcccatcaccgtatgcacgggaggctctccaggccagccaggacccggtggtgtcatcccccggctgggcgtgtctctgtggggccgtcaccccctccgcatgcacacacacctccactcttctccatc

SEQ ID NO: 23399 - DNA, 1030 bp, Homo sapiens
gagggctcccgactgctgagctacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatggtaagggctgcttgcttgtcctgacacccccgggtcccactgcattgccccagccttgcgtcccctctttcagcacccccagcactgttcttattctgcggccaaaccacttggggagggggaagtgggagctggggggattaggtcacctgagctggcctgggctggctgggtcttcacccagctccccaccagcctgacggccccctcactccacaggcagtcatggttttcattcatagaacttaggttattgagctgggcagggtggctcatgcctgtaatcctggcatgttgggaggctgaggtgggaggatcttttgggcacaggagttcgagacca

SEQ ID NO: 23400 - DNA, 1029 bp, Homo sapiens
gatgaagcccatgctgctattctgaagtagggaagcgtgcctggaatcggtcctctgcggggcctgatgagagggatgctctcgtttactgaacgcccgtggtgtggccagctctctgctgggcacgccgtggggtgctgcctgcaagattgctcgtgcttcagcagccctgcaaggtgtggagtcttatgcctagttacacataaggaaacgcaggctggcacacgatgagctggcgctgaggccaggcctgtctgactactgtcagcatttattttattttattttattttatttattttattttattttattttattttattttattttattttattttattttattttatttttaccaccacaagaaactctctagaattcccattcctgggtggcaggcacccctttgagcgtatttctcttcctttgtgtaatagcaaccattgagcaccttttccattctgcgctctgtgccaagtattgactatgtgtcatttctaatcctcacaaagactcctcccaggccagattcattgtctccattttatttcatttttcattttttgagagacagggtcttgttctgttgcccaggctggagggcagtggcgcgatcatagctcattgcagtctcaacctcctgggctcaagtgatcctctcacctcagcttcccaagtagctgggactgtaggcatatgccaccatgcctggctaatttttagtagagttggggtctcactgtgttgcccaggctggtctcaaactcgagatcaagcaaccctcctgcttcggcctcccaaagccctgggattgtaggtgtgagccactgtggccagacatgctgccattttgtagataaagaatggaatctcagcactttgggagcagaggcaggaggattgcttgagcccaggagttcgagaccagtgtaggcaacacagggagaccccatctcttatttaaaaaaaaaaagcctcagggataactagccccaggtcgaacacttagcaaagtacctgaaacg

SEQ ID NO: 23401 - DNA, 1031 bp, Homo sapiens
agcacttactgtgcccgggtactgttccaagcactttgtcaacttgtttaatccttatgacaacccatcgttcggccccgtcatgtggatcaggaaacagtccagagtggaggagggaggagactgagcagggggtcgctggggctggaccgcaggagtctccatcccgcttccgcaggtggatagtgacaagggcatctcccttcgcttccctcggtttattcgagtccgtgaagacaagcagccggagcaggccaccaccagtgctcaggtgaggtcctgggaagcaggggtgggccgcccagctgcttggccctaccagctttttagcgtggtggcctctctggaaccttgtggaggtgggagcagccagggagcttctgaccaccccgtcccaccctctctccgcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggatagctactttgtgacagggtctgtgctgggctctgggggcaaagctgtcatgggtgtcacctgcatagcatgtagccatgtagccatggcctaggaactgccagagccagtgccagccatggaactgcctgcagtggtgggcgtcttctctatctgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctcca

SEQ ID NO: 23402 - DNA, 2970 bp, Homo sapiens
gggcccagccgccagtgctgggtggaaaggctggtgatgcggatggcccgcctgccaagggcctggagtgctcggtgcttatcatgaggacactggggagccatggaaggattgtgagcaggcaaggggcagcatccagggggaagaggagctggaccccagctgtagagaagagagaagagggcaggagagatctggcagacagtggatgtcagggtgaggaggcaggaggaatgcctccaggatctccctgggtgactggatggatgacaaagccgtcggcagcttgggaccctggtgaggggcaggcacctgcagggggcattaatcaccccagcgtggggcaggcatgagcaacctctatctgtgggcccccagggccatccaggaagtttggaaacgggtctgaggctcaccaggtctggctcagagcccagggttcgggctggtcagtgtaggagggatgaccacccactggtgggttctcatccgcctggggagaggatgtgctgggagcactggagctggcttagggccatgggcaccaacatttagggaaggcaggggtttcaggctttcatgagaggacagagggactgagaaaggttgacttggatcaggaaagagttacgggcttatgggagccagaggagatgagactcaagattttctcactcattcactcaagatgtgtttcgggagcactgacgtcataccagacccagcacacacggggtcggttaagaatactctgagctgcaggtaacagaaaacccaactacattggcttggacaaagaaggatctgtttttctcacaaaagaagttgcagatgctggctttcctgcccaacaatccatggcagctggggcctcttccactgtctcatgcctccacccttgatgggtcgtgttcacactcacactgctctccgtgccgccttgtggcccccgtggctgtccaagtcccgggtttgttgtgagttgttggccactttggagaatcccgtcccctttgatgtgtgattcgataacatcccattggtgaggctcacactgtcggctctcccatttgtggcagtttcgcttcaggcgcgaggcccaccttcatgtgctctgtgccgcggctgagcatctgtggactgaaacgcgcacttgttcgttcattacggattgctttccctttcattcttttctgtgttagggttagggcgttatctcgataggtgtaggcaggttatgttatctccacattttatttcagaccagaaaagaggtgacacacagtatctggtgacaagggtgtgttggttctgataggttgagagctgcttgtcacagctgtcaccgtgacttgaggctccatctccccagctcttacacccaggcgcccatgggacccagctctggacagtaagtggggccagagcacatcccacgtgtgtaagctggtggctccaaaacaagccgaagggtctttggtcactgccagagatgttcatgacccgccagaggaaagggtcccttggccttctctgctctgtccacactcacttccctagtgaccttgtcccgcctgtggctttaaatcccatccgcgccctgatgacaccggcccagatgtctcccctgagtgtggtcatgctcgttcatccaccgctttcctggctccacgtgcatgtttgctgacttcctacagccagcgtggctgggggcacgttccccaagccatttctaccaagtgggtgagcgttagacacagggaggtgcagggactcgccacaagcacacacagctggagaaaattcatccaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgctgtgagtggggcgggccgctcatcccggaccccagacatcttggggacctgaggccacgcgtgtgtcaggaaggcttctgggtagaccatcagctgggtcgcatcagtccttctcatggggtgcacagcttcctctcctccttcctgcacccaatcctaggggagtctcctcttcagagtctagcagacctaatgccatggctgccacatgacaggactcagtaaatacttcctggataaagggagagggaggcaaggaggagagctagctcgttcttactgccctaagagtgggcggccatgggagctgggacatggggatggggtgagggaaggagggcaggtattccaaaatgcagggcagcagcacggctggtggggtggaggtgtggtccctgccttcaccaggcactgacggctcttcccctgactctccagtccacagccaagaagatagacatcatcaaaggcctctttgtggcctgccgccactcagaagcccggttcatcgctaggtaagcgtgtgggcctgtgaggctacagagggggactgcaggctcggaggtgaaaggagggagggactggcagctggaatcatcacaaatgccctgaccatccttggatgagaaaagcatgagcaggaggcccagcccctaaagagtgggaagggacaccatttcctttcacaggccagcttctgtcccttggtagtgctgtctagagaaggcccctgggcccctgtgggtgaagcatgctgtgattgattggtgaggtctgcctcggcttgggcgcgggccctgcagcaggaagccagggtttgtttgccatgacagtgagagcaaatccattgagggctcacatcatggagcatttcttgggagccctgccctgtgccccgtgccttacctcatcagttcctac

SEQ ID NO: 23403 - DNA, 1152 bp, Homo sapiens
gaacacttggaggcagttaagatctgaggggagcagtggggagctcaggggacctgctggaatcggtactgtgccaagtacattacatcattgtttactcgtggggattatttctattctgcagtcgtgagagagcaaagcacagagaaattaagtaacctgcccaaggtcacacagccaggaagcaggagggattgaagggtgcggcctgcactggggcagtgactgtgtgcaggcagagaaggggagagggcccagagccttccagaggctacatcagtgggtgtgagctctccgggatgggagcacacgagccagcgaggtcagatacaccaagccctttgcctccccagctcggaagcagctcccgaaacggaccattcaggaagtcctggaagagcagagtgaggacgaggacagagaagccaagaggaagaaggaggaggaaggtgagcccccagaaggagagaagtgtgtgtgtgtgtgtgtgtgtgtgtgtgaagccaagaggaaggaggaggaggaaggtgagcccccagaaggagaggtgtgtgtgtgtgtgtgtgtgtgtgtgtgtgtgtgaagccaagaggaaggaggaggaggaaggtgagcccccagaaggagaggtgtgtgtgtgtgtgtgtgtgtgtgtgtgtgtgtgtgtgtgtgtgtgtgtgtgttttggatctgcaagggcaggggcctgagagctcaggatgtttggaccctgccgatttgatgcctgtgtccaggcatccaggaattccacctaccaatatgggaacttttgttctgaaaacattgtgggatatatttgtttggacatcttaatttagtaataattcaggcacagtttcccatttttatttgctatttttatatttatttaatggaaactatttttcctctaaatgatttccttttccttgtaaattttaccataaagttgcagttcccaaacattcttagttcacagcacccttgatgtcttagtaatttttttatgatgctcctaggccaataccttatcagttctattaagtagttatgtccaaacaactattagatactatacatacattggaaaaaaagtaatatttgtgctttttttttttttttttttttgagacagtctcactgtgtcgctca

SEQ ID NO: 23404 - DNA, 1024 bp, Homo sapiens
ggaaggtcctactcatcataccttcctcataggatcgtcatgagcatgaaaagagttaatataggtaaagcacctacacagtgtctggaatatggcaagcagtaagtgttcactaaaattctatacctaccacccttagttctgtcaaaagtgagtgaatgttttattgtatttaccttaactttttttagaaataaaaaatttcagatagtcctgtatctgcttctggtttagcaataacatcaaaagttgaggccttctgtgaacgctgccctaacagattatcttccttccctctgtccccagaggcagccactatcaaaattatctattagcattccatgtatatttttatgcacccataaacaatgggaggtatgtttctgtgtgttaaaagcattgtatacgtgaaaaaggactcaaactcattagtcatcaaagacataacaaattaaaaccctaaggaaatgccactacacatcagcagaatggtcaaacaaaagagactgataacatcaagtgttgatgaggacgtggagcaactggaactctcacccatcactgatgggaacgtgaaatggcacaagcactttggaaaacttcatggcagtatctactaaagcaaattttatgtctctcctgtgacccagtggtgccactcaagacaaatgggcatctaaagctgtgtacgagaatgttcatagcagcactatgtgtattcgccaaatacttgaaacctaaatatccaacaatagagtgagaaaataagttgtggtatattcctaaaataaaacactaatcagcaccaagaatgaacacaccattacaacctccaacaacacggatgaatctcacaaacctaccaagtgaaagaagccagacatgaaagagaaactgatataattcccatttatataaagttcaacagcaggcaaagttaacctctatcgttaggaggctagatagtggttacccttaagtggttaaccctgtgagggggcaccaggaggtttcttgggactgg

SEQ ID NO: 23405 - DNA, 1046 bp, Homo sapiens
ggccctctcctcctctcatcttcccactggggtcccctttggtctccgttctcaggggccaactccagggacttctccaaggggatccccctcaagtttctgacctccagccccctccccttctctacttctgactgtggccccttccattctgcagttctcagtccccctgccctttcatcgtgcagctgcgcccccctccaggggcttccttcaagactcctgaccctctcatagtcaaactgggtccccctcaggtcggtggtactcctgcgatcttccagctgggccaccctccaggtatacccttccaatcctcttagcgcctggtcctccaactgggaccccctccagacataaccttccagtccccaatctttctcaccctccaactggggccccctccagtctctaatctctggccctctcaggtgccctttctctaacttcgaccctctcaagacacccccttccagtcccctcggcttctgattctccaaccgaccccctctccaatctctgatctgcagtgccctccccttctcaccttcgaactgagccccgccccagtctctggtttccagtgcccttgcccactccttctccatctgggctcccctccaaatacttccttctttcggagcccctccccagtcgcctgtctccaggcccctcaccctctcgttctccccctgggctcccctccctggctcatcctccagccaaggccccccgccatcgggcccctcgggcaccgcctccccggccgcgtcggcccactgcatggccaccaggtcgcgaaggcactgcgccacgccacgcgaggggctgagacgacgcagcagtcgccggcggtggcctcgcaccagggcacacgcgtccaggtctctggccgcctcgaaggcgcggaagcggacccacatgtcgcggcggggctcccagttgcgctcgaagtagtccacgaaggcggctgggccgtgggcgtggagctcggccagcgcctcgtcgtaggctgcgggcgacgacgcgccagccaggcggcacag

SEQ ID NO: 23406 - DNA, 1039 bp, Homo sapiens
aaaggatatattttacttaagaagccccatggtagagcagactcgagagactcaactgagccaagcaaagatccagattttcttcatctcagctctgtcatcctcagtgtggacttcattatcacaccataccaaggtaatcatcagcaggtctaggcctgatcatgtctctaggccttcttaggagtgatagaatctttattagaagcctcctaggccgggcgcagtggcttacgcttgtgatcccagcactttaggaggctgaggcgagcaggtcacctgaggtcaggagtttgagaccagcctggccaacatggtgaaaccccgtctctactaaaaatacaaaaatttgccaggtgtgatggcgcacacctgtaatcccagctactcaggtgactgaggtatgaaaatcacttgaacctgggaggtggaggttgcagtgagccgggaacgtgccattgcattccagcctgggtaacagagcaagactcaaaaaaaaaaaaaaaaaagcttcctagttctgagcacagtggctcacacctgtaatcccagcactttgggaggctgtggcaggaggattgcttaagccgaggagtccaagaccagcctgagtaacatagcaagaccctgtttctacaaaaatataaaaataaaaaagcctcccacctcaacctgagcagactcgttgaccaggactgggtcacaggcccattctgtggccaggacatttggcatgagtcagtcatttgaaggtagaatcgactcatgtcaagaagttgccactgggacgcactggtccagatgatggaggaggaagcttgagttgctatggagatgaattcattgtggctcctctatccatctggccccaggaggccttgtcggtagaaagaatgaaggaacgctggaccatctcaactgttccctggatctgggactcccaaccaaccccagaagccaagaactcatcacggaaaccaaaataagattgttttattccaatcctgaagaacaatagtccaaacaattcccctcccct

SEQ ID NO: 23407 - DNA, 1083 bp, Homo sapiens
tgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatt

SEQ ID NO: 23408 - DNA, 1969 bp, Homo sapiens
cgccgatggcgggggcctgggaggaagggaggaggagggaagcaggcgtcagcacgtgactcggccctgaacctgtgtccttagctggccccggctggctggtgcttaaaggtacaggcgcctcctttcgaaccaatcttctggaaccttagagcagcttctcctcctctttccagcgagtagctcttagactctaacttgagagcttttcagtgcagtagattctttttctctggacagtctggggtctaagcttaggtcgtggattcggtaagtaggattcaggctagactgtgcatctgaagtcctgaggttttagaagcaatagccccatcgcttctcggccttttggctaagatcaagtgtagaagcaatagccctgattcgtgtgttacctagggcaagtcagttatgactgggactcagtttccttgtttgtaaaggtggatatggctccatgatctctaagcatctttatggcttaggggaaccttcatttttctcgttattttggagacggagtctcgctctgttgtccgggctggagtgcagtggtatgatctcagctcactgcaacctccacctccagggtccgggttcaagcaattctccagcctcagcctccctagtagctgggcttaccggcacccgccactacacctgggcaattttcgtacttttagtaaagatgaggtttctccatgttggccatgctggtcttgaactcctgactaaaggtgattcgccgcctcggcttcccaaactgctggggttacaggcgtgagccactgcgcctggccaagggaaccttcatattttatattagggagattaatccctggccgaatttatgctagatcccagaaggactttccatgtggctatgataccacagcaaaaagtagcttcaggaaaccccctccttaaaatacacactcagctgacacgtgctgtttccccaaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggtgagcagagctggatgtgggagatagacttggctggagacatgccccacagccagggaggggccttttctcacagtcaagcctgggcttctccttgggattagtgctcagcctctcctggcctgcagccacagattagtcctccttggccacggggcacaagggggcaggggcctgaggtttataaagacagtgtcaactgggcgaggggcctcactcgtgtaatcccagcattttagggggctgaggcaggaggatctcttgagctcgggagttcaagaccagcctgggcaacatggcaaaaccccatttctacaagccacttgggaggctgaggtgggaggactgcttgtgcctgggagattgaggctgcagtgagccaagattacaccactgcactccagcctgggcaacagagggagaccttgtcttaaaacaaaagacagtgtcactgtggggtgctgactcagccagctctgctaggtctacttgtagagacttggagcttctcctattacttgggtccagagctccaccaggcacacttgcaaaggacagtcttcctttggcaatgggatatcagcctgtggcctgtctctccttactcagcaggcctttgatctctgatgtgggacttcctttggagtgattgcatttggctaggatgaagactgtgccagcccctttaggccttgtttcctgggcctggacttctcactggtgggagacttcaggcttctgttagcagccagtgccactttctgatttggggtgatttgagcagtcattgcatc

SEQ ID NO: 23409 - DNA, 1079 bp, Homo sapiens
tgcttcctaaccggggcatcgatgacatcctggaggatcaggtggagcctgatggtaggatccaaactgctagatttaggggaggtgggggctgaggttctggactcctgcgtccaagggaggcgtgagctggggagctggatcctggaaatggggtatggggggctggcgcccggacccctgactttccaagctcatgtaccattctttatcccgcagaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttcagagacctcatggatgttcttacatgcccccgaccccggtagatggctccctgttgtttggggagcctggaaggtggttatgccttttggatgcaggagaggagcaagaaagagtggagagggagaatgggggagccggaccctgacctccctgggttctggttggagatgaaaaaattagaagcatcaggtctaagatcagcttctcttggaagcagagcctgagacaagatataaatgccagtcatttattaaagaagtgttctggctgggtgcggtggctcacgcctgcgatcccagcactttg

SEQ ID NO: 23410 - DNA, 1043 bp, Homo sapiens
gacaggccacactgagaaagtgttattgggcagagacgaggaaaggtgacgagggagcaagccctgtgggtatctgaggaacagcaaactcgaaggccccgaggcatgattgagacgcggtggggagtcccatggggctggagtgacatgtctcatagagaaggggtagaaagtgaggcaagatggagggcacctgtagtgccagctacaggaggcaggaggatcattttggccctggaggttgaggctgtagtgaggcatgattgcgccactgcactccagcctaggcaacagagtgagactctgtctcaaaaaaataaaaaagaagtcgggcgtggtggctcacacctgtaatcccggcactttgggaggccgaggcgggtggatcacctgaggtcgggagtttgagaccagcttgaccaacatggtgaaaccccgtctttcctaaaaataaaaaaaatcagcagggcgtggtgacacacatctgtagtcctagctactcgagaggctaagcaggagaatcgctcgaacccgggaggcagagattgcagtgagccaagatcgcgccaatgcactccagcatgggtgacagtgagactcggtctcaaaaaaaaaaaaaaaaaaaagaaagaaagaggctgggcgcggtggctcacacctgtaatcccagcactttgggaggctgaggagggcagatcacttgaggtcaggagttcgagatcagcctggtcaacgtggtgaaatcccatcggtactaaaaatataaaaattagccagatgtggtggcgcacgcttgtaattgcagctactcaggaggctgaggcaggagaatttcttgaacctagaaagtggccgagattgcgccatcctgggcgacagagcaagactctgtctcaaaaaaaaaaaaaaaaaaaaaaaaaaaaaaaaaaaaaaaaagaaaagaaaaaagaaaaagagacaaagaaagaaaaataaatgaggccagagctatgggaggattttaagtggaggagtgaccgtggggctgttgtgtgacactgcta

SEQ ID NO: 23411 - DNA, 1900 bp, Homo sapiens
caggaggactgccctccagccctcgtgttcccctcatccaagcttccaacccctactccaaactatgggctcccagtcccctcttccccctgagctagaggtctggggcctgagtgccccctacatccccggcccaccccaccccaggccccagaactatggacctcggccggggcctgccctcacacgcttgggcccacagtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgggacgtggcccagcccagggcagaagcgggtggacagcctgccatcggggtgggagccacagacggagagggtgcagggtggacagccccagccagagagcgaggcaggcttggacacaggaaggaggcgtgataggacacccagacagatgcagggcctggaagtgggtgggtggatcccagacatgggcgaatggacagacagatggcaagtatgagacagactgagacggagatccaagaggccaaggtcctcagacccagagagaaagagagcaagatcgaaagacagcctggtcaacatggcgaaaccccgtctctaccaaaaatacaaaaattagctgggtgtggtggcgggtgcctgtaatcccagctactcgggaggctgaggcaggagaatcgcttgaacccgggaggcggaggttgcagtgagctgcgattgggccactgcactccagcctgggcgacggagcgagactctgtctcagaaaagaatgccagccagccaggcagagctggggagaagtgggcctgaggtcaggaaggagcaggattctggagcttgaagttcaagttcaccctccacttgctgcctgtgtgtccttggctaatggacatgctaatagcgtctaccttctagcggtgctgggaggaggaaacagttaataaggacaaagtggttagtagagttcttggcatgaaggtagcacattgtgtgggcggtgattgtcattgttatgatcatcgtcattattgttactaacagccaagcttggagagtgagggggacaggcagaccaagggagaagggtggatggagccacaggcaagagtaatagactggggacagaagagaggccaccagatgtttcagaaagccagtcctagaaggagagagaagcatggaatatcggggaagagaggagaggtcagtggacagacccacaggacagagtctgagatgggcagatcagggattagagaggagggggagttccagggccccagggtgaagacggaaagagacacgctgttgtccaaggagaaagccatcaggcggcacgctgttgtccaaggagaaagccatcaggcggcagggctaagggacagacaggtccaggctggggatggagaggcactgtggttcctttactcattcacagcctctggtttggggtggggtctggaatccattcaggtccgactgtgtccctaagggaacccagaacagcccagtcgcttcctgagggcagctgcttcccacgtgctgggggcctaagaatagcccccccccccccccagcaaaagggcagacaacagctgggagggggagggacctcagagcgaggctccaggcagcaaaaagccaggtcggcgaggagcggggctgcttctccactgctgtggcagcaggcccagaaccaaagccatggtctcagggaggaaaacagccaactggagaaatgtggcagaggcagaagtgagacagcaagtcttagaaacacggcagtgg

SEQ ID NO: 23412 - DNA, 1032 bp, Homo sapiens
aggaagtgttctttctatacaacagagacttggacaggtgaatcagaccacagtccttgtttcattaagttttcaattttggagggggaaggaaaggagaatgagacagccaaaaacttgtgctaactggtaactgaagtgatgggtgaggacaggagacagagccattaattctgtctggactagtcagatggggccttccagaggaggcaaccctgagttgaatttctcccagtaatcttttttttttctttttcttttttttctttttctttttttttgcttcctcctcctcttcctctctctcccagcagattttttttttttaatttaaatttttgagaacagggtcccactatattgctcaggcaggtcttgaactcctgggctcaagccatcctcctgcctctgcctcccaaagagctgggattacaggcgtgagccaccgcgcccgacctctcctagtaaccctaaccctcacaaataaccaccattttcttctagaagatgcctgggaatatacatgtgtgcgtgtgcaagagttcttgacagcatatagttaggaaaggaattgctgagtagggtgtgctccccttcaattttatcatatattgtctggttttcaaagtggcgtaatgcattgccctcccatcagggatgtgtgagacttccatttgttctactttttgcacaacacttgattaaacttggttggacttttaaattgtttccagtctggtgggagtgtaatggtagtttttttgtgtattttcaaaaaaaccttttattatgagctattacctacatatggaaaaatgcataaaacaaggccgggagcagtggctcacgcctgtaatgccagctcttagggaggctgaggtgggaggattgcttgaacccaggagtttgaaatcagctgggcgagacccttcctctaacaaaaaaaaaaaaaaagtgtataaaacaatgcactgtgtaacgaaccgtgaagtaaacatcacctgtattaagaactagaataaccctagatgc

SEQ ID NO: 23413 - DNA, 1034 bp, Homo sapiens
gggtgtgttaggatcgtagagctgggggtcgggcccacgttggggtggagtctcctccaagcacagggctgaggcgggtcagtccgggagggaactggaggaggggggcttacctggaactgcacatagtcccagctctcctcggccgcggtctcctcggggttggtgccgtacttttggatggttttctctacgacgtcccgcaagcttcgctccagctgagaggccaccagtgaggctgggccttatcttccccgccccacccctccccctctcaggctgtgccagcctcaggcgggccctgtgcatctctgggccagtctcaaatccttactgaatggctagctctgtgtacttcaggtctgtctttctgtttcttccactatttctacggctcataagtctctgtctcttctttcagggcgtctatttctttctcttgttctctctttttcccgtgtgtttccctttggagctgtttatgcctgtctcccttggtccaggtcggtgtgtctttctattaatttattttttgagacagggtctcactctgtcacccaggctgagtgcatggctcactgtagcctcaaactccctggctcaagtgatcctcccacctcgacctcccaagtagctgggaccccaggtgcacaccatcacacccggattttttttttaaatatagatggggtctcactatgttgcccaggctggtctcaaactcctggactcccacctcagcctcccaaagtgctgggattatgggattacaggcgtgagccaccaggcccagcctcttatttctctttatctaggttagcccctgtctgcccttgtttcggtctctctccaccctctcccaccactcccttccctctcctccctgctgggggtgggtggtggccactgcaggaagctcacctgggcccgctgagtggagatgaggattcccagggtgatctgtgtggcaaacaggagcagcagcatcccaaaatactggggagcagagtggagagatcaggctgaccacccct

SEQ ID NO: 23414 - DNA, 1043 bp, Homo sapiens
tggcctgaatctgcttctccgttgatccttccaggtttctagtcacatccaggttttggcccgaaggaaatcaagggaaatccagtccaagttgaaggtagggaccaatgcagacatcctgagagggggacagagactgggggtgggggaccgagacccagaaagagagggacagagacccagggagagggggacagagacttagagcggggaggactgagacccagagagaaagggacagagacccagggagagggggacagagacttgggggaggggaccaagacccagagagagagggacagagacccagaaagagaggaggacagagacccagagagagagggacagagacccatagacagagggggacagagacccagagacagagggagacagagacccagagacagagggggacagagacctcaggtgagggacctctgtggtcagggcggggggtgcagtcatccagggtggggagtcagtggcccacaaagggagatgcatagggatggtggtgcggttgctgagaccctgggcagggagcgatggcatggaggaggctgaaggttttgctcaggacagcaggaaggatgggccgtcggtcccctcccttgaccactgttcctgtccccctcccttccctctgctcctgtccctcctttccctcttcctggcggtctcatatcttccccctcttgtgctgtgaaggcctcctcttcatctccgctggtttgttttcccatttcctgacctttgcatgacctgcctactctttgtgcccagaaatcttcatttcctggtggagattcctcattcatttccttctcctcatcctttggatttcctggttcctgttggccggagaccctcattttctcccccttctgggtgtgtgggggtttttctgtctctttttctggacttggggacggtcgcttctggttttttttttttttttttttttgtatccagcagctttccctttctttctctctaggtctgaaacccttcccttccggtctgttctcgaccttctg

SEQ ID NO: 23415 - DNA, 1027 bp, Homo sapiens
cagatcacgaggtcaggagttcgagaccatcgtgaccaacgtggtgaaagcccatctctgctaaaaatacaaaaattagccaggcgtggtggtgcaggcctgtagtcccagctactcaggaggctgaggcaggagaatcgcttgaacctgggaggcggaggttgcagtgagccgagattgcgccactgcactccagcctggtgacagagcaagactctgtctcaaaaaaaaaaacaaacaaacaaactattttttttttttttttagagatggggtctagctatattgcccaggctggtcttgaactcctggccttaagcaatcttcctgccttggtttcccaaagtgttgggattacaggcatgagccacggcacccagcctcttttactcatctttctattggagtggctgtaattttcttcttgatttgctggagtttcatgtaccatcagttctgctataatgcttattttgaaaatgtgaatttattccaatgcagttgatatatcagggaacaatttgagcataacaccaatttcacatttgcttatgtgcatccaaggtgaatccaggaaactgcactctgctataagtgtgtgtgtgggaatacacaaagcacacatacacggcacttcaaacaaataccaccaccgcagttccccgggtgttaggagccacacccatccacatctggtactaggactttccatcagatctcaaataaccctctttccaccacatcacagtaattcacaaggcgctccctccaccccacacccattgccacaacaaacttcaagtctttgtcaaggtcaactgccatatttttggagtatgttggtatgtcttaaccacctagcccgtgtgaaactgttctctccttttgtattctgttcttatctttttctttaagcatcaccgacaaagtttacgaggattgtgacacaatcctgttttctctgtaagccttgtggtttttgactgcaggattttgcatattgctgtgatttctatgaatgcatgcc

SEQ ID NO: 23416 - DNA, 1042 bp, Homo sapiens
ttttttaagagatggactagggttggggatgggtttccattaagttgcccgggctggtctcgaactcctgggctcaagcagtcctcccgcctcagcctcccatagtgctgggatgacaggtgtgagccatcacacccggccaccagaagaaccctactatatccagagctggctctgcccctttcctgctcacagccctccggcagcctccacctcccccaggacaaggtcccagctcctcagcctggtgtttgaaggcctgtggcacctggcaccccctaacctgttgctaaatccacagtctacttccacccagctacctcacagtcctgagatcccaacaagtttccaacctcagtgcatgttcttcctcctgcctctcagatctctagctacctctacttaaatactgctcttgtggacttgcctggtgtggcggcctcccaggcatgtgactctcagcaggtgacttggcttctctacgttgctaatggtgcctactcggcatgtaacaggcctggatgaacggtagctgctgcggttacattattagcttcagtttgcccgcccaggctagatgtttaatcagatttcacagacttcacagtgtgagttggggatgtgacttcgtatgaaagtgaaggaactcaggctcagagagggtgagacgtaggagcatggccactgcgcgagctcggggctggctgtgggtttctccccattccctgcccatctgggaagtcgctgccaccccctacgcttgtctgctgactcccagtcctcctgcctcccgtacccaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtgagtgggtggcgggcaccgacggagggatgtgacctgggggc

SEQ ID NO: 23417 - DNA, 1022 bp, Homo sapiens
tttgccatatatttctagctccacacttggccagcatttgaccccatttagcttgagtgcggccatgtgattaattttggccagtaaggtgtgaggccatgtgattacatctggccaatgagatatgagcagaagtgacacatgtgaattcagcaagagcacataattgctaatggaagaccagacccctctgcctttactatgtccattggcaaccttcatgatctgtccgcacgggctccaagctgacactcaatacagcacgagtgacaaaatccaccttggctgtttcaagccactgcaatctgggggtaatctggcctttcctgatatacacaatttttttttcccaaataatcccagtttaaccaacatttgttaaaccaatcaactaccaagtctgagtttcctagaagaacaaactggcagtacatataggttggatgacataggctaggacacaatgacaacatggacaaagtgttttatactggccgggcacggtggctcatgcctgtaatcctagcactttgggaggctgaggcaggtggatcacctgttgtcaggagaccagcctggccaacctggtgaaaccccatctctactaaaaatacaaaaattagccagacgtggtggcaggcgcctgcaatcccagctactcaggaatacaaatacagtctcctgattgatcctccaattcaagcaggagaattgcttaaacccggggaggcggaggttgcagtgagctgcactccaatctgggcgacagagcgacattctgtctcaaaaaatgctaataggctgggtgcggtggctcacacctgtaatcccagcactttgggaggctgaggcgggcaaatcatgaggtcaggagttcaagaccagcctggccaacatggtgaaaccatgtctgtactaaaaatacaaaaaattagctgggcatggtagtgggtgcctgtaatcccagctacttgggaagctgaggcaggagaatcacttgaacccaggaggcggaggttgca

SEQ ID NO: 23418 - DNA, 1009 bp, Homo sapiens
ttcccgctgcccaccctcaggacccttccttcccagagcctgctgtcaccttgacactggcccagcagagtcctgaagccttcagccagccccacctccagcctttgccccagctgtgcgcctgatcgattcttgagacccaagttagaagccagctgtagggggctttccccgtgccccaggctgggcccagggcttccttgcagcctccacaggcacaagccggcttgcgctgtgtctgtcccacacaccagcttgccctgtctttcccaggctgaaactctcctaaagctccctgtcatcccaaagttcaattccttcctctggctcaggccagtgcccacctctctggccttataagtctgaccccggggggaggcaggaaggagatgacaagaaacacagaggggactaaaccatccaggagaaagacagcgaggaaaagggggaaacatttggaagacagctgggacaccacccccagaggggtctcacagaccaaaacatgtagaacaccaagagaaagttctagcaataaagccaagcaacgccacaaatgctactcacaggcactctccccactatttttattactattttttttttgagacagagtttcactcatttcccagactggagtgcagtggtgcgatctcagctcactgcaacctcgctcactgcaagccgcgccatcatgcccggctaattttttttttttttttttttttagtagagatggggtttcaccatgttggccagactggtctcgaactcctgacctcaagtgatccgcccgcctcggcctcccaaagtgctgggattacagacgagggccaccaagcctgacctcacttattgttttttaaaaccaaaaacatctcaaagcaaacaagggaaagctccgcaaacagcctggcagcaggaaacccacgagagtttccccgtaataggcgcctccaggcgggggaaaacaaattataagggtgatttatttttatcttattacaaa

SEQ ID NO: 23419 - DNA, 1054 bp, Homo sapiens
aagcggtggttctagaatcttccttaaaatctctctctggctgtttcctaacttttccatggttgtcttagctgattcgtttttcctgtggggaaaattgctgttggtcctgcgaccagagctcctttggtagcttctgggcctggggagtgggaaggagaaagtagctgctaattagccgtcaggtgacttcaggggaaagcaggagagaaggttgaaaatcagtgaatccacaaatcatttagctactgccttgaggccatcctgtgtagcaagtggcagaggcaggattttggtaccctgggcaagtcgccccctctgagggcctcggtttcctcatctacccgggtgaggagaataagcctgcttaaaacgatttctaagatacataaagaacagtagagaacagtgcatgtagcaggcggccttttgtgtgcaggtggggatagtgccaaccacgcttttgtttaaacgcacagcaagtctctgcaaagatgtgcaacagcagcctgtctccagggagcagggctgggaggctgtgggactcagggaagacaggccacactattcccttttgtaccttttgagctacaacaatgtgaacatactacctattcacaaaatgagttagtttgtttttttgagaccgagtttcactcttgttgcccaggctggagtgcagtggtgtgatctcggctcactgcaacctccgcctcccaggttcaagcaattctcctgcctcagcctcccgagtagctgggattacaggcatgcaccaccatacctggctaattttgtaatttttttttgtagagatggggtttctccatgttggtcaggctggtctcaaactcccgacctcaggtgatccgcccccccacaccccgcccccccccccccagcctcccaaagtgctgggattgcaggcgtgagccactgcgcccggcctagcttttatgtctttaaatgcccaccaatgtcactgggttgtggcagggtggtgcggcctcctgggtagtgagcacacgggaacatttaggcattgaaacatctg

SEQ ID NO: 23420 - DNA, 1054 bp, Homo sapiens; identical to SEQ ID NO: 23419

SEQ ID NO: 23421 - DNA, 1011 bp, Homo sapiens
tgatctgcctgcctcagcctcccaaagtgctgggattacaggtgtgagccaccgtacccaagggggttattttttaaataaaattttttattttggaataattgtagattgactcaacagaaaagttgcaaagataatacggagaatttctgtatgcccctcacttggttttttccattaacattttacattactttgccacatttgtcacaaccaaggcaacatcagtatgttaccattgaccaaatgccattcttgattctgaccacacttgatgctgattttggtagttgttacttaatgccctttctgctccttccggatgccttcaggatgccacgttatatttaggcatcatggctccgcagcctcctctggcctgtgactggttttagactttccttgtccttcatgaccttgacagtttggaaaaatgctggttgggtattttatggaatgtgcttccatttggttttgtctcagactgggattgcgggatattgagaggatggccaggtaggatgctatttttttttttttttggctttttttagtagagatgggggggagggtcttactatgttgcccaggctggtcttgaattcctgattcctgggctcaaacgatcctcctgcctcaccctcccaaagtgttaggattacaagcctgagccactgtgcccggcctgggttttttgttttgttttgttttttaatttttttggttttttgagacggagtttcactcttgttgcccaggctggagtgcaatggtgccatctcggctcaccgcaacctctgcctcctgggttcaagagattctcctgcctcagcctcccgagtagctaggattacaggcatgtgtcaccacacatggctaattttgtatttttagtagagacggggtttctccatgttggtcaggctggtctcgaactcccgaactcaggcgatccacccgcctcagcctcccaaagtgctggtattacaggcgtgaaccaccgcgcctggc

SEQ ID NO: 23422 - DNA, 1011 bp, Homo sapiens; identical to SEQ ID NO: 23421

SEQ ID NO: 23423 - DNA, 1069 bp, Homo sapiens
ggccccatcccctggcagggattcagacatcgaggccccagctgcgtccttttctccatcccttgcccttggcttcctttcaaaccgtccttcagcttccactggataggaactatctcccaaccctgccaaaaatggaagatctccgttttcgtttagtcacagggtagccatcttgccccttctcatgcactgggccctcctccaccagccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcggtacacacaagcttctttctccttccttacctgttgcgggcaggaagtccttcttgggatctgaccaccttcccttagagcacttactgtccactctgccagtttttgagcacttgccctatattttcttgggcctataggggctgtgttatcactgaggcagtatacagagtagcagctaagagcatagactgagcttgtcccacccgtgggcctgcatgcggcctagaacagctttgaatgcagcctaacacaaatttgtaaaccttaccaaaacatgcgaattttttgcgatttttttttaagttcatcagctatcaatagtgtatgttatgtgtggcctaagacaattcttcaatgtggccccaggaagccaaattttatacatacctggcatagactctggagccagattatatgagttcaaaacttgactgcacccctcttactagctgtgtgaccctggccatttcccttccctgtgcctcagtttcccctgtggtacgaagtggcattaagaatacctacctctggaccaggcacggtggctcatgcctgtagtcccaccaccctgggaggctgaggtgggcagattgcttgatctcaggaattcgagaccagcctgggcaacatggtgaaaccctgtctctaccaaaaatacaaaaaaatagtcgggtgtggtggtttgcacctgtggtcccag

SEQ ID NO: 23424 - DNA, 1048 bp, Homo sapiens
gcatgccttagttttgtaagtgaaaaatgccatctttggtagaatgtttgttgtcacttgcacccacgatggaaatctctgacttctacgctcctaacctccaatctgtatggcttttccctgtgtccacaggtgactttggcaggctatggcttcgccttccgctattgcccaagtggcaaacacgtggcctacgtggaaggcagcaggagccctcacgagggggaccttgagttcattagcatggacctgcacaagggatgcggtacgaggccagggatgggtttgggaccgcagagagatgcttcttatacaagggcagctctaggagttcacagccagagacagcaggtggccagacaggagaggcactaagggcgccaggacagggattggaaccacagacagcgtcccgaccgcaagggaggtgggtggggtagcggttcagcactaagcatagtgggaggctgggcactggggagcctgagttccagaggttggggttcaggatctgttgtagacttggaagatgggagttgcctaggagtcatccaggaggggctgttgaggaggtggttggccaccacatctggagtgtgggagggagatctgggcagaggctctgcagtatctcagaagttatcagccgaagccctgggagaggatgggatcatccagggaaagtgtacagactaggaagagggcccagggcagatttcttgagcccctctttctcacatccctttatatcatggccgtccacatgcctgccacatcctcccatcagactgagctcccccagtacagggatggcacccctgcctccagcatcgggtggtggaaggccagcacggacaagtagtgcttgtcgagtgcttacacaaagcgttgtctaaattaagcgttgtcttatgctcaggaagcataagaaaaataaactgtcagagtctcccccgccctcccccactgaggctgggtttggtacccatccttctgggctcccgtgtgttctgtgtcctttgtcactcaggtagtcgcacgctatagc

SEQ ID NO: 23425 - DNA, 1034 bp, Homo sapiens
acagccttctgcccctcctgtcccccaccaggatgccaaggatgggcgcttgttcaatgagcagaacttcttccagcgggccgccaagcctctgcaaggtacctgacagggaactgggcaaggaggggagagtgaggggggcgccaacttggtcacagcacttgacttctacctgcaggcatgagaagggtgggcttagattaaaggcccaggtttgctcccatctgtgtccataacctgactcctgtgacccctcaggcctcagtgtgtgttgtgactggctcacaccagctcttggaagccaagtattaaattttcaggctgggcgtgggttgacgcctatactcccagcactttgggaggctgaggtgggcagatcacttgaggccaggagtttgagaccatcctgggcaatgtggcaaaaccttatctctactgaaaatacaaaaattagccgggtgtaatggcatgcacctgtgatcccagctactcaagaggctgagctgagagaattgcttgagcccgggagacagagattgcagtgagctgtgattgtgccactgcactccagcctgagcaacagagccagaccctgtctccaaaaaaaataaaaataaaaataaatttttaggaagatggcaagctggttgttacagacagccagtactagcaattaaattatataggccaggcgtggtggctcatgcctgtagtcttagcactttggcaggctgaggtgggtagatcacctgaggtcaggagttcaagagtagcctggccaacatggtgaaaccccatctctactaaaaatacaaaaattagccaggcgtggtggcgtgtgcctgtaatctcagctacatgggaggctgaggtgggagaatcactcgaacctggaaggtggaggttgcagtgagccgagatcatgccactgcactccagtctgggcgatagagtgagacttagtctcaaaaaatatataaaataagttacataattttacaaataaattatattcaaaacaaaggtaatgaacc

SEQ ID NO: 23426 - DNA, 1103 bp, Homo sapiens
ttggccttgtgtactgccactcagccgatactggtctctaggaagcttctcttgagtgccataggctcgcatccagacctcctcatcgtccgccagagcctctttccagcctctttggcgcccccccgtgcctgctgcagccttcattggagcgcatgtcagtctaggctccacatccctttcggcctcactttctgggctgggggccctttgcaggtagggacccagcacaattagtgtatataccctctgcccagccagtgcccaggacacgggaggcctgaggactatgttccttctcctgttcactgagcccctggatctgaagccacagccacagtggcagtgtgaggcgtcccctttgctcctcattatcctctgggcccagaggcctcttgccattacttgcctttaggggatggtgggtgggaggaacagagtaagcgatgtcttttcctgtgtccaagtctgtctcccaccacacccaccccattctcttgccaggctaggagcccttctagggcagggctttggtctaacaaattttttggcccttttctatctcaggactgagtcctttttcaggatgtttttgggtaaatgtctagaatgtcctttattccctggcaaacttctcctcatccaacaagatccaactctaacatcccttcctccaggaagcctaccctgacttctccaggcaggatctctttctcttttgggccctaatatctgtctgtactgccctgtctcagacccgcatctgactagctgtgtctagagcagacttgcccaccaaactgggcactcctgagggaaggatgcaggtccgactcctatctggtgccccaacatcatcacacaaaggcctgactcatagaaggtcccaggaaatgtttgttgaatgaacgaatttgtaaaggaacagtattttgcgtgctgtttcactccccatctaacttttctctcctggatggtgcttttactttattcttacatcctcctgcaggctccgggagcagacccccaacccccaaaagcagccctcagaagaccaggaagagccctcaggtgaccaggggtagccctcagaagaccagctg

SEQ ID NO: 23427 - DNA, 1071 bp, Homo sapiens
agaccagcctggccaacatcctgaaatctcatctctactaaaaatacaaaaattagctgggcatagtggcgcatgcctgtaatcccacctacttgggagtctgaggcaggagaattgcttgaacccaggaggcggaggtcgcagtgagccgagattgcaccattgcactgcagcttgggcaacagagtgagactcgatgtcaaaaaaaaaaaatctgaaatccacagtagtccagtgaaatttcccttgagcatcctgttgacactcaaagtttcagattttggagcattttgcatttcagatttccggatttgggatgctcagcctgtgttggatgtcctggtcacatcttagtctgaacatgccttcacctgagctcctggtgttcctgccgcctgccctagacttccccattgccatgaatagcactccattcatccagtttcccaggccggaccctggggatcatccttgagttctctttgtctcgcaccccgtgacacacccaccccttcagcaaatcttgttggctccctctttacaatcagtgcagtatcagcccacttccttctccgcacctcccacatccctggtcctcacctctcttatgcagaagccttcttgccctctgctcccctctcttgtccctgtagtcgtcttcacgcagccaccagagagatcctgtgaatacagtcagagcccatcattcctctgctcatacttccccaagtgaggtgaagggaccaggtccccatttcccctcagaccccacctcccgaccctcctgctattccagccacactggcctcctggctgcccctccacacctcagcacgcctgggcctcagcctgtgcgcttgccgctccctcctggacgcctcttcccttatgggcctgcatgccccactctttcactgccttcaggttttgtttttagttgtttttgtttttgagactgagtcttgctctttcgcccaggctggggtgcagtggcgcaatcttggctcactgcaacatctcggctcactgcaacctccgtctcccaggttcaagcaattctcctgcctcagc

SEQ ID NO: 23428 - DNA, 1045 bp, Homo sapiens
caacggggtggtcagggcagggtggggatgcctgggggggccggggcgctcttatgtctggctggctggaggcccttgtctccttcatgtgccccatctctgtgcagtcatgtgcagtgggaatgtgtgtgtcccatgcaccggtgtggggagggtgcagtcagggctgggtgggattggggtgaggagatgggtgcactgacacctttcccctccctggctgctggctgacttgcttcggaagcttaatggatgggattggcccagggaggtgagaggcgaggggcagggaggggatggggtcaggaggggaaggacggggtgcctggggggcgtgtgaacgtgtgtgcacgaccagagctgaggtttcttggtgtgtgaacgtgtgtctctgtaggtgtgcatgacacgcatctgtgtgcatgtgtggcctggatgtacctgtacctatgcccggggctggagggtctgccctgctctgtatatactggtgcctttgtggctatgatgactgtggggctggctctgcacatctgtgcttctctgaatccgtgggcaagcaccacagggcatgtcagtgagtctgctcacacacatggacaggtgggtctctgcacacatccgtccctctctgtgcatgtcactgtgcgtgtgtactcgcacattaacgtgtgtgcatgcatgtgcgtctgtctgattgatctgagattcaggacctgggatgttgggggagggaagggcagaggaggggaggattccagggcttgggcctccagaaggacagggctgtgggggagggagggtcataatttggtgtctaaaatatgacactctcctccactgctccccccaatccagggaagagtccccttgtgcgtagcatccttccattaaatgtgtccaaacctacgtgtctgtgttctggccagtggggatgggtcggggatgggggggacagagaaatggcaacatggggagagagggtggggctggggtgccaccctgcgccccgagtgtctgaggcgcttgaccgttgtgcgtgttt

SEQ ID NO: 23429 - DNA, 2142 bp, Homo sapiens
catcggtttcctgacttgagcggggcccatgcccctgccgaggaggctcagcctggaagcagctagcccatttcctatctcccccaccacgaccccagcaaggatctctacttgacttacctccttcaggcaaccacctagaaaatcgttgagtttgttcatgtcacaagtgaaagtattttttcatgcattcatcgttggcacgtcgtcctttggcaatattaaaatctaccaacaaatgggaaaagttaacatttgcaccatcttgccatattcaaaaaccttgtgcttaagtgttttgaaagtaagtttcatggccgaacgcggtggctcatgcctgttatcccagcactttgggaggccgaggtgggtgggtcgcttgaccctaggagttcaagaccagcctgagcaacatggcaaaaccccatttctacaaaaaaatagtaaagtgagccaagcgtggtggtgcgggcctgtagtcccagctacttatgaaggaagtgggagaatgcctttagccaagatcgcgccactgcactccagcctgggcaacagagcagactcttacttgaaagaaaggttcatatttcactcaaaatagtgtacttgtgtacctacagtaacatttttctacttaatgttattagcattgtcacccttaatactgcaatttaacaatctgctttgtgcctgttgttcctcagtcatcttcgaaatgtcttttacagctgatatgttcaaacctgactcagtcgagggtctctcctcattattatttacaagttggctttgtttcttcttccttctctcaataagttcttccaggggatttgtgtcttggcagctttctctgtttatgggttatgtgcagatgtaggcagtgctaaagaaacctgcaaacagtgggggatgaacaccggggacatcttcatgtagtgcatttggggtcctacccatcccatgaggacagtcccccgaggacctgtgacactggggaggttggggcatcttggtgtctccatgagcaaaactggtcattcctaccttctggatgagttttgcatttcctactctttttgagacaagtcttgctctgtcgcccaggttggagtgcagtggcacgacttggctcactgcaacctccgcctcctgggttcaagcaattctcctgcctcagcctcccgagtagctgagattacaggcattctccaccacgcctggctaattttgtattttcaatagagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtaagtggcctcaggacctggttgcagaggggctggggctcccatgatgtccagcactgggctctgatcacccctgaggacacagtgcaccccaggacctttgacacctgggggtctgaggggccccagttttaatggcttgtggacttgcagactgtttcctcccccactctcactgtgtctttctgtgttacaggtgcagcttcaagcttaggaccacccaccatgcctatccaggtaagaacccttgctcctgctccttcactcacctgggtttaaaatatctcactgtctaggttgacttcataccgtacctctagaaactgattgatgtgccaatgattgtactcagtgtttacatacaaaaaccatctcaggctgggcgcagtggcttacacctgtaattccagcactttgggaggctgaggtaggtggattacctgaggtcaggagttcgagaccagcccagccaacatggtgaaaccccgtctctactaaaaatacaaaaaattaggccgggcacagtggctcacgcctgtaatcccagcactttgggaagccgaggcaggtggatcatgaggtcaggggttcaagaccagcctgaccaacatggtgaaaacccccatctctactaaaaatacaaaaaatagctgggcgtggtggcgggtgcctgtaatcccagctactcaggaggctgaggcaggagaattgcttgaacccgtgaggcagaggttgcagt

SEQ ID NO: 23430 - DNA, 1073 bp, Homo sapiens
ctgtgatttttcaggcaggctgctcctctgaggaccacccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggtgatgaaggtcttggggagggggctggactcctgggtctgacggaggaggggctgggacctggactcctgggtctgagggaggaggaggctggaagtctggacccctgggtctgagggaggatgggctgatagcctggattcctgggtctgaggaagaaggggatgggggcctggactcctgggtctgaggaaggaggggctgggggcctggactcttgggtctgaggaaggaggggatggggccctggactcctgggtctgaggaagaaggggatgggggcctggattcctgggtctgaggaaggaggggatggggccctggactcctgggtctgaggaaggaggggctgggacctggactcctgggtctgagggaggaggaggctggaagtctggacccctgggtctgagggaggatgggctgatagcctggattcctgggtct

SEQ ID NO: 23431 - DNA, 1072 bp, Homo sapiens
aatgtgcctttttctctctttatattgacttagattctcacaatcgacacatcatcacagcactgccttttatcctggggtaaggatatttggcctgatttttgtatttcctacagacctgagtgaatcatatgagaatgtatcaaagcaacctagaaggtgggagtgctcaccacagtggtgttcctgtatatatggtgttagaaatctttgggaaggcgcgggcatggtggctcacgtgtgtaatcccagcactttgggaggccgaggtgggtggatcacctgaggtcagaagttcaagaccagcctggccaacatggcgaaaccctgtctctactaaaaatacaaaaattagctgggcatggtggcgagtgccctgtaatcccagctactccagaggtgcggttggagaatcacttgaaccctagaggcgaaggttgcagtgagctgagattgcgccattgcactccagcctgggtgacaagagcgaaactccgtctcaagaaaaaaaaaatctttgggaaagttcattgactgttgcatgcagaattaaagaagaatgaatctgaaacagagtgacagcacttacatttatgtgaagagctgagaagacttcattttatcttgcttcccacagatgttggttcctaagacttaagttggcctcttttctgggtacttattgtttgagcgtgatggatggactttttccattctctgggcatctccttctcccaaagccttcagagttggagggcgtaagggtgcttcatcattggtaatttcttttctttgttcccagtgtgacctcttcgatttcatggacttaacaatgctatttatatgttgatgactcacagatttctctctacaggctagatatttccttatcctcctacatttgcctgggaattgcttggagatctaatagctaactcaaacttcaagtcatccttgcttcaccgtttcactcatcccacaaatccagtccatttagcaagtttagactttactttctccttatatctcgaggtcctctactcctttctctaacagttattttcactcaagc

SEQ ID NO: 23432 - DNA, 1002 bp, Homo sapiens
ctgttgtgcctacgtgtagacttcttgcttgaaaagttgttggatttcttgagtttgaattttggagtgtttaatcagttctgaaaaattttcagtgttagatctttggatattgtttctccattacttgattttctccttcttcttgagaaattatcaaactcaaggaggtcataggaaccctcagtttataattagtccatcagaaaaataggaggcctggatttgtgatatatggttggccctccatatccatggcttccacatccatggattcaaccaactgaggattgaaaatatatattttttaagcatctgaactgagcacatacagacttttttattgtcatgattccctaaacaatatagtataacaactgttaacataccatttacattgtattagatattataagtaatctaaagataatttaaagtatatggggctgggcacggtggctcactcctgtaactccagcactttgggaggctgaggtgggtggatcgtctaaggtcaggagtttgagaacagcctggccaacatagtgaaaccccatctctactaaaaatacaaaaaattagctggttgtggtggcgggcacctgtaatcctagctactcgggaggctgaggcaggagaatcgcttgaacctgggaggcggaggttgcagtgagccaagattgtaccattgcactccagcctgggaaagaggagcaaaactccgtctcaaaaaaaaaaaaaaaaaaattagccaggcgtagtgtcacatgcctgtagtcctagctacttgggaggctggggcagaagaattgcctgctcctgggaggcggaggttgcagtgagctgagattatgccactgcaccccagcctgggaaagagagtgagtctccatttcaaaaaaacagaaatgtatatgggaggatgtgcatgggttacatgcaaatctgcaagtactattccattttattttattttattagagacagtcttgctctgttgct

SEQ ID NO: 23433 - DNA, 1043 bp, Homo sapiens
ctctgcttacactggagtcatctttcttttgcttgaagaatatccgttaggatttgctgtaatatgtaattcctcaaggatatttttgctgagtatcctttatacatttatacttagaatactttgcaagtatcaagatgtggatggcggccgggtgcagtggctcatgcctgtagtcccagcactttgggaggctgagatgggtggatcagttgagctcaggagttcaagaccagcctggccaacatggtgaaaccccgtttctactaaaagtacaaaaattagcagcgcatgtggcgttcacctgtaatcccagcttctcaggcggctgaagcaggagaatcgcttgaacccaggagatggaggttgcagtgaacagagatcacgccactggagtcttactcactccagcctgggcaacagagtgagtgaaactcagtctcaaaaaaaaaagaaaaaaagtcaaagatgtggatggtaatgaataatttaaataagatagtgcttattatttgcttaggacagtgttctcagattgcagtatcctagaatgtaaaaagacctctgaaaaggtagatgggtacacatggttttaaagaaaaaatgtgtgcatcttaactgtctatgtgacctctttcctaaaactggtctgcctgaggattgcccagctgctgggcatcacgttgtgacgattcttttccccacattctctttcacttactagcagtagtcataccacgtcaactttatatagaagggtgctgtacctcccatatattcagaatgttatattttactagcccagatataaaagcttctggagcactaaataaaagaacagagagatatttgggggccttgatttaaggtgagcatataggaacagtgacaacatctgggcctaaaaagaatgtaccactcagagtaatttgctcttcagcccacaggtgctgagaacaagagaaatcaagtgaaggaaggaggcggagtttccaagacttgggtgtcatcatttctggggacatccttgattggagattgaa

SEQ ID NO: 23434 - DNA, 1067 bp, Homo sapiens
gcatgatttataatcctttgggtatatacccagtaatgggatggctgggtcaagtggtatttctagttctagatccttgaggaatcgccacactgtcttccacaatggttgaactagtttacagtcccacaaacagtgtaaaagtgttcatatttctccacatcctctccagcacctgttgtttcctgactttttaatgatcaccattttaactggtgtgagatggtatctcgttgttattgggggaacctgcccccaatatttcaatgtagtttctttctattttccataagtgtcagccggctgagaaataaagacaatacaaagagaggaattttacagctgggcctccaggggtgacatcacatatcggtaggactgtgatgcccgcctgagtctcagaccagtaagttttttttttaagggtttcaaaaggggagggggtgtaagaacagagagtaggtacaaagatcacatgcttcaaagagcaaaaagcagaaccactgataagggtctaacaaagattacatctttctgagggaaaagggcaaagggcaaaagtagaaccactgatatgggtccaacaaagatcacagggcaaagggcaaaagcagaaccactgttaacacaattatcacagtggtcctgaggtgacgtacatcctcagcttatgaagataacaggattaagatattacagtaaagacaggcataagaaattataaaagtattatttgagaactgataaatgtccatattaaagtgaaatcttcacaatttatgttcctttgccgcagctccatctggtctctctgtttggggtccctgccttcctgtaacacattgtggttttgatttgcatttctctgatggccagtgatgatgagcattttttcatgtgtctgttggctgcataaatgtcttcttttgagaagggtctgttcatatccttcacccactttttgatagggttgtttgattttttcttgtaaatttgtttaagttctttgtagattctagatattagccctttgtcagatgggtaggttgtaaaaattttctcccatt

SEQ ID NO: 23435 - DNA, 1058 bp, Homo sapiens
atactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatc

SEQ ID NO: 23436 - DNA, 1034 bp, Homo sapiens
tgtgtcttctgtttctgagagctgagctcagcctgtgatccacagggaggtgagggggctgtgctctgtatggggtttgatcagggatgggtctgtgtcctgaagggaagcatagtccagcccagctccccactgttgcagggtgtgtgggggcttctctgggaggggaacaagttctgaagaaaagggtgaaaaacttacttggtctttgtgtaggagtttattatgcttgcatccccctggtgcactgggctgtctctccacatgctgaggccttccctgtgggcatggttgtggcacagaaaggaatgtgttgtttccaaggattaaacaacatatttttgactttcagatttgacttttaaagaattaattatattgactgagagagaggcccaggagagaaagaagaaagaaaaggagccagggatggctcttcctcaggtaaagtgataatcttggtggattgttctgtctcctccctttttgaaatgcagggcattggagctgcaaatcttctctgagtctgaagtatcctgcctgacacatttgctcgcactcacccatgccttccttcagtccctctcttctgcacttagattccagatctcacagtgactcagtgacatgagcttgggaagaggctccactgggcatggtcctgggaagggctcacacccagacatggatggagacagggtgtgagttctgtggtgtcagcttttgggcagcagagattgtttaggggcaacatctgaatgcactgtcagctctcagtagaccaggagtagagaagctgtatgtggaagtcacatgttaatatgcaaaaatacctcataaattcttgaaaagatgcctctaaggggagatcttttctgcctgattttataccacatttgaagctataatgaatcagtcactctttctaactccacaatcttaatgaccgggaatggaatggaaaactaggtacagacatcagtgatagaggttgttttattccatcattgattttaaaatatgaaatcaacctg

SEQ ID NO: 23437 - DNA, 1047 bp, Homo sapiens
agccacatattatttaaattccacatattggccgggtgtggtggctcacacctgtaatccaggcactttgggaggccaaggtgggtggatcacctgaggtcaggagttcaagaccagcctggccaacatggtgaaaccctgtctctactgaaaatacaaatattagccggacatgatggtgcacgtctttaatcttagctacctgggaggccgaggcaggagaatcccttgaacttgggaggtggaggttgcagtgagctgagatcgtgccactgcactcctgcctgggtgacagtgagactctgtcttctaaaaaaaaaaaaaattcccacatattttgtttgtgttttcatggctctgaattttttcagttgcaggcctttatgtcaccatgtcttccaaaaagaatcgagtttgtcagtctttgataatatctttattatgtctttcattaaagcttgtttgcttatgtaaagttcagtaatgttagatatattcacattatttgttggactcccagaatgcatatgttcttggtgcttgatggtttttcatgggcccattagactctcttcattttctttattttatttaattatttattatttattttttgagatggagtctcgctctgtcgcccaggctggagtgcagtggcatgatctcgactcactgcaacctctgcctcctgggttcgggcaattgtcctgcctcagtctccctgagtagctgggactacaggcacgtgccaccacacctggctaatttttgtatttttagtagagacggggtttcaccgtgttggccaggctggtcttaaactcctgacctcaggtgatctgcctaccttcgcattttctttatttttggagacagagtcacactctattgccgaggctggagtgcaggggtgggatctcagctcactgcaacctctgcctcctgttcaagcaattctcatgcctcagcctcagattacaggcatgtgccaccatgcctggctaatttttgtatttttagtagagatggggtttcataatgttggcc

SEQ ID NO: 23438 - DNA, 1075 bp, Homo sapiens
aggccaaagcttgtggatcacttcaggtcaggagttcgatactagcctcaccaacatggcgaaacgtcatctctactaaaaatacaaaaattggccaggcgcggtggctcacgcctgtaatcccagcactctgggaggctgatgagggcggatcacaaggtcaggagatcgagaccatcctggtgaacacagtgaaaccctgtctctactaaaaatacaaaaaaaaattagccgggtgtggtggtgggcacctgtagtcccagctacttgggaggctgaggcaggagaatggcatgaacccaggggacggagcttgcagtgagctgagatcgtgccactgcactctagcctgggagacagccaggctccatctcaaaaaaaaaaaaacacaaaaattatccaggcgtgatggcacatgtctgtaatcccaggtactagaaaggctaaggtaagattatcacctgaacctgggaggcaatggttgcagtgagccgagaatgcatgactgcactccagcccgggtaacagagcaagattctgtctcaaaaaacaaaaacaaaacaaaacctcatggcagactttaaagatatccagttccctatttgctactcctgtgcttttgattcagtagttctgggaagagagctcagtgtccacatattacagtgctctttaaagattcagaaggaggcagtcagtggaggaatttgtgagatattttcctaagtccatctgtaatgtcttctttcctacagaaacatagggctggggatctagaaaacttccaacatgtcatgtttcctactttttataagcaggagtctctttctaacctgttggagcaaggcaaagagccctggactgtgtagcatgaagtgaaaataagatgggtgggaattttttttttttttttttttttttttttgagacaatctcactctgttgcccaggctggagtgcagtgacacgatctcggttcactgtaacctccacctctggggttcaagcaattctcctgcctcagcctcccaagtagctgggactgcagtcacatgccaccatgcccagctaattt

SEQ ID NO: 23439 - DNA, 1096 bp, Homo sapiens
tcttagctgtttgcctcaatttcccatcacattctggtttaaggcttacttattaataatgtggtttttatttctttcactattatcatcgtgaagatgatttctcattggggggaagattttttttgttttccattatattttctcaaaatttaaagagtaaagaaatgaatattttttgggccaggaagtgtggcttatgactataatcccagcactttcagaggctgaggcagtcagatcacttgaagtcagaagttcgagaccagcctagccaatatagtgaaacctcgtttgtatcgaaaatacaaaaattagccgggcatggttgtgcgcgtctgtaatgtcaactactccggaggctgagacaggaaaatcggttcaacccaggaggcagaggctgcagtgagcccagatctcgccaccgcattccagcctggccaaaaaagaaaactctgcctcaaaaaaaaaaaaaaaaaaaaatagaaaaaactaaatatataaaagaaaataagccgggcgcggtggctcacacctgtaatcccagcactttgggaggccgaggcgggcggattacttgaggtcggaaatttgagaccaacctgaccaacatggagaaatcccatctctactaaaaatacaaaattagcagggcatggtggcacatccctgtgatcccagctacttgggagatagaggcatgagaatcgattgaacctgggagacagagatcgcgccattgcactccagcctggtcaactagagcaaaactccatctcaagaaacaaaaaaagaaactgatagatctcttacacaaatacgctgggacaactaactggatatccacgtggaaaagaataatgttggatccctatgtaacatcatcaaaaattttattataaaaaagaaaagagagagagagacgaggaagggagccctgcgggagggggtgttactttgtcgcccaggctggcctgaactcccaggctcggcgatcctcccgccgctgcttcctgaatagctgggacctcaggctcccactcccgcgcccatatcccagctgtgtttaagccgcaggtggtgacctcacccatcc

SEQ ID NO: 23440 - DNA, 1030 bp, Homo sapiens
gtggcagatatttcagacattgttcatagcttgcagttcatcagtgaactcatactggaaagaaacgttacaaatgtcatgattgcagcaaggtcttcagtcaagcttcatcttatgcaaaacacaggagaattcatatgggagagaacctcacaactgtgataattgtggcagtcatttttttttcttttttcagatgaagtcttactcttttgtccaggctggggtgcagtggcgtgatctcggctcacggcaacctccacctcccaggttcatacgattctccttcctagcctcctgagtagctgggactacaagcatgctccaccaagcctggctaatttttatgtttttagtagagacagggtttcaccatgttggcctggttgctctcaactcttgatcttgtgatccgcctgcctcggcctcccaaagtgctggtattacaggcatgagccaccacgcccagtgtggcaatgtctttactttacattcacaccgcattagacatcagggaatctatactggacagaaatcttacaaatggaataggtgtggcaatgtctttagtctgaggtcactccttgcagaacagtagaaaattcatttttgagataattgtcccaaatacaatgactatagaaaatgacaaactttaattgacattagagtcaattctgcattgactagagtttgagttgacttaacattgagttcaagcattaattgacataaaaagtgtttacgtcaagaagaatgggcagggtgcagttgctcacacctataatcccagcactttgggaggccaaggcaggcagatcacttgaggtcagcagtttgagaccagctgggccaacagacctgaaccagtttgcccagcctgttttttctttccttctttctttcttttcttttctttctttcttttttttttttttttttttgagacagagtctttctcttgtcgcccaagctggcgtgcaatggcacaatcttggttcactgcaacctccacctcctgcattcaagc

SEQ ID NO: 23441 - DNA, 1023 bp, Homo sapiens
tattgtagtaggcagacttccgtgagtctgaagcgtcctgcgtcacaagtttgctcgcactcacccaaggcttttctcagtccccgtcatcttaaattctatctccctttattgcccaggctggagttcactggagcaatctgggatcactgtaacctccacctcccagggtcaagagattctcatgcctcagcatcccaagcagctgtgattataggtgtccaccaccactctgggctaattttgtatttttaatagagacaggatttcaccatgttggccaggctggtctcaaatccctgacttcacttaatctccttgacagtttttcactgttgctaagaataacacactggctgcctgtgagcatggtgacttcactgcagatatctggaagtttcctgcaagttggggcattgaaaactgattgcttcttcttggatttgccatttcctcttttagatgtgggaagattccatccctacccccagctgcagaggtgccctctctgactaagactatgcaaaatttcccactcacttaagcaaagcttactactgtggtcttaccaccatgattcttaccaccatggtcttaccaccgcaattctcctgcctcagcctcctgagtagctgggattacagtcgcacaccaccacaccccgctaattttttgtatttttagtagagatgggtttcactatgttggccagactggtctcgaactcctgacctcatgatctgcccgcctcagcctcccaaggtcgtgggattacaggcgtgagttaccgcccacccagccgagaaatatcttgataatattacaggagctccctcttgggtgagagttagctcttcttttggctgttgttaggattctttctctatctctgaattttgacagttttattatgatgttgtttgttataggtctcttacttagatttatccatgttggatattcttaaggtgttgaatttgtttcttttgcatcctgaaattagaaatttttgccattatgcct

SEQ ID NO: 23442 - DNA, 1094 bp, Homo sapiens
aaaaattagctgggtgtggtggcacatgcctataatctcagctactcaaaaggctgagacaggagaatcacttgaacccggaaggtggaggttgcagtaatccgagatggtgccactgtactccagcctgggcaacagagagagactccatctagaaaaaaaaagagagacagagagagaaggtgtcgctctgtggcccaggtctggagtacaatggcaaaattctagtttacagcagccttgaactcctgggctcaagtgatccccattttagcctcccaaagagctagaaggataggcatgtgtcaccacacatagctacatcttttctttttctttttctttttctttttctttttctttttcttgttttttgagatggagtctcgctttgttgcctaggctggagagcagtggtgcaatctcagctcagtgcaacctctgactcctgggttcaagcaattctgcctcagcctcctgagtagctgggactacaggtatgcactgccatgcctgggtaatttttgtgtttttagtagagatggagtttcaccatgttggccaggctggtcttgaactcctgaccttgtgatctgcccacctcagcctcccaaagtgttgggatttcaggcatgagccaccacttccagaattattttttatattgtatttttattctgtccagggtgaagtgcagtggtgcaatcatagctcactatagccttgatctactgacctctagggatcctcccatcttgggagaatacatggatggataagtccatggttacgtagaaaacacatcatttgcaataagttttttttttataattttaataattttaagtatttttcattgttgtcaactatcacaataatgagttaatagtaaaaacaggccaggcacggtggctcatgcccgtaatcccagcactttgggaggctgaagagggtgaatcatgaggtcgggaattcaataccagcctggccaagatggtgaaacctcgtctctactaaaaatacaaaaattagctgggtgtggtggcaggtgcctgtaatcccagctacttgggaggctgaggcaggagaattgc

SEQ ID NO: 23443 - DNA, 1039 bp, Homo sapiens
gcagcgtgtgtgtgggcttctccaggaggagagtgggagttttcctgtaggaattttttgttcattgtgcagtgggcagcagaggggaccgtatttcccagggtgaggtctcctatgtttgtgtcattgtgttaagggagggggtgtgttgattctgagtgataaacaacatatttttaacattcaggattgacttctaaagactgttggtacgtgagaaagaaacccagaagaggaagaggaaagcaaaggagtcagggatggctcttcctcaggtgagatgatatcctcggtggattgttctgtctccttcctttcagataccctgggccttggagttgggaatgtctgggtctgaatgacctgcctgacatgtttgctcaccctcacttatgccttccttcagtccctctcatctcgcttaggttccgtctctcgtgacccagtgtcatgaacttgggaagaggctgcactgggcaggtcctgggaagggctcacaccccgacatggatggacacggggtgagggtcctgtggtgtcagtgctcttgggcagcagggattgttcaggggccacatctggatgcactgtcagctcactgtggaccaggattggagcagctgccaatgggagtcacgtattaatatgcacgaagtacgtggtaagttctagaaaaggagaccaataagggaaaatcttttctccctgattttataccacatttttaggtaatggagtgagttactgtgtttctgactccaaaaatcttactaattagaatggaaagttcatacatagacatgaataattcatgaatcattccttcattattattattttttgagatggagtttcgctctgttacccaggctggagtgcaatggcgcgatctcaactcaccgcaacctccgcctcctgggttcaagtgattctcctgcctcagcccacctagtagctggggttataggtgtgcaccaccacgcccagctaatttttttgtatttttagtagaaacagcgtttcagcatgctggccaggc

SEQ ID NO: 23444 - DNA, 1058 bp, Homo sapiens
gcagttgaaagggtgattgcttcctctaggatggggcatttcctgttttcttagatctgacaagattccccccagcccccagttgtcaatgtgtccttttccgccaaggtgagattcctcttcacttaaacaaaacttgctactttttatatatttaaaacctatatatatatatatatatatatatatgtatatgtatatgtatgtatataatacatatatatgtgtatgtatgtatataatatatatacacacatccccacacatatacacacacatatataggtacacacacacatgtacatacacatatatatgtacacacacatatatattttgaaaatcttttatattttgaaaatctgggacaaatgacaaccctttgtattaacatctagttttttgtgagtctgtgtaggttttattattttgtgaacatttaaaaaatggattttgtactttgagtaagtttgttttcatgtattttattttattttgagacggggtctcactttgttgcccaggctggagcaccctggcatgatcgtagctcactgcaacctctaccctcagggtcaagccatcctcccacctcagccttcaaagtaattggaaccacaggtgcctgccaccatgcccggctgattttttatttttaattttgagacctagtttccgttgcccaggctggagtgcagtgacgtgatctgggatcactgcaacctctgcctcctgggatcaagccattctcctgcctcagcctcccacatagctgggactacaggcatgtgtcactgcacctggctgatcttttactgtggacgttgtcatctgtgaagacatcactcatgctctgtctcttcgagatactgaatgtcacttggtgtgtccataaaagtttcaaacatttctatagcaggaaccctgcactgattttttatttatttcttatattttttacaaacataagaaattcatactgacagggtgtcttgacctcttcaaaaagtataataaagacgtcatgtgaggccgggtatggtggctcatgcctgtaa

SEQ ID NO: 23445 - DNA, 1058 bp, Homo sapiens; identical to SEQ ID NO: 23444

SEQ ID NO: 23446 - DNA, 1068 bp, Homo sapiens
ggaaagtttaaaataagaattgtttttttggttcatatttacacatttcagtattgtttatcatctgtacttaattagaaacctattggtgtttatattttgtagatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatcccaaagaatttcttgtagtcccaaaacccgtatttctaataactatgggaataattccctccattcttcattacccatacaaaaattgggaagtacacatgagagaaaaatctttccaatgtaatgagagtggcaaatcctttaattatagctaactcttaaggaaatatcagataatccatttaggatagaaacaatataaatgtgaggtatgtgacaaggtctttaatcagaattgattccttgtatgccataatagatgtcacactggtaagaaaccttacagttgttatgagtgtggcaagaccttcagtcagacgtcatcctttacatgctatcgtagacttcatactggagggaaaccttacaagtgtagtgagcataacaagacctttggttgaaattcagcccttgtaattcataaggcaattcatactggagagaatccttgcaagtgtaatgaatgtggcaaggtttttaatcagaaagcacaccttgcacgtcatcatagacttcatactagagagaagccttacaaatgtgaagaatgtgaaaaagttttcagtcgcaaatca

SEQ ID NO: 23447 - DNA, 1035 bp, Homo sapiens
gttcattagatatgattcgttgtgacatgctgacttctatgtatgtagtttaataacttaaaacttgtttaaattatacagatgagattgagaattttaaaattcctatctatgagacatgtacattctataaatcttggcatcagaggttagcttccagttggaatccctattcagccagagggttgtgtcttcattcacttgttagacactctcttcccttttcccaggatggaataggaagtggggcagtgaagtgggagaaaaaaatcactttctgttatcatataatagtataaatttaattaattaattaatattttgagacagggtctggctgtatcggccaggctggagtgcagtggcatgatctcctctaactgcagcctcgacctcctaggcttaagcgatcctcctaccttagccacccgagtagctgggaccacaggcatgagccatcaagcctggctagcttttgtatttttttttttttttgtagaaaaggggtttcactatgtttcccaggctggtctcaaaattctgggctcaaaggatccttctgctttgacctcccaaattactgggattacagttgggattacagagaggagccaccgcacctggcctacagagtcttttttttttttttttttttttttttttttttgaggtggaatcttgctctcgtctaggatggagtgcaatggcacagtctcggctcaccataatttccacttcccgagttcaaacgattctactgtctcagtctccctagtagctgggattacaggcatgagccaccacgttcagctaaatttgtttttagtagagatggggtttctccatgttgttcaggctgctctcgaactcccgacctcaggtgatcgctcacctcagtctcccaaatgctgggattacaggcgtgagccaccatgcccatcccatagtactttttaaaagggacatcagggtgcagtggctcacgcctgtaatcccagcactttgggaggctgaggcgggtggatcacaaagatc

SEQ ID NO: 23448 - DNA, 1080 bp, Homo sapiens
aaaaacatcactgtagaacacaccaactgaaagtaatttgaaaaaaaaaatccatgacactgactatgtagcagtcaccattaagtacttacatgttattaactcatttaatcttcataacaactgcattaggtaggtggtcttccccccatttttacagataagttaattgagacacagaggttcgagtgacttgcctagagtcgcccagctggactgggctgaaacccaggtaggttggttccagagtgtttgcaagcagcaggaatttcccagtattagaacttgagaagcccattcaaaaaaaatagtttcggcactgagcccctgccctgctgagtgctgggacctggaggtgaagtgggggccatcaaggtccctcggcagcagagcccacagcctggtgcagggacacatactgggaaaatcccacaccccaagcgagtgtgcccagcactgcaaaggggaggcactgggctgggtggctccaggaaggtttctttgaggaagggacatttgggctgagacctacaggaggcctaggagctggccaagtggaggatgagagggcggtgttccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggggcggggccctcacctgctcaaactcgtcagtgatggtcttgggctcctcgtgcctctggaaccacatcatgtacttggtgtggaatcgccatgactgcttctttagggccttggctgccagatactgtgccttagtgccctgggggaggaacagtggagagggggatcagggggcccccaaactgggtggggagccaggggaatggggcaggacatcagggctgaaccccggcccccgccacagaccacagttgggctggacaatcctcttggagatggggctgggggcacagaacataccaatgctgatcaggagaaggaaaatgagacaggaggtgaaaattgctttcagag

SEQ ID NO: 23449 - DNA, 1060 bp, Homo sapiens
caaacgtccaggacaccaatctgtacccactcaggccccaggaaacaagccctaaacctcagagctgtgatcgtgccccccaattcctttctctactaagccatgccatcccgagatccagaagttgaagtctccaggccccctgagtcccagagcccaatggcccggccctggcactcaccacggccgtggctgcctccaggcccatggagccccagctcaggacgagaaccaggagactcatgactgtcatcctagagtgggggagggaggatcagcccggggttcttaatctcctagcctagcctctttccacaccccaaatcccatcacagccgccccccacctccacccacctctggagcctggaggatcagaattagggaaacacaagttcagtggttgggggtaggccagtggctgctgatgtccagcaggacatctggctcctgcccagatgagcagggtgtggggtatgagcagggccctgggctgggtggtcgcagcttggatcccagctccaggaccctgggacggtgactgctcacctctgggctcacttcccccgaaggctcccccaagtccacccacagcctgatcagcctctggctctgccctgtctcctctgagaatgggagacagtgccagggctgaaatctgaaagtctctggactttccgggtggggaggggtgcagggggcgtgtcagcattggtagggtgaccagtaagcaagaagggcacccaggggtccccaaactgaaggcctggcttccagtcccagacctgccctgtgttggctaggtttatgggtctgcaagccttacgcggggtctctcccactctctcaggggcaatggaggtacaggttcaactccgcctcaccccactagggccagagagaatgcagggactcctccaatgagaatggcctgtctggttcaaatcccagctctagcacttctagctgtgtggccctgagcaagtggtccaacctctctgatcttcagtctctccctctgttaaacagggagaagggccaggcatggtagctcatgcctg

SEQ ID NO: 23450 - DNA, 1005 bp, Homo sapiens
gtgacaaccaacagcaactcggcacccggccaggtgtccctgggggcagaactcctcacccagccaggtgtccctgggggcagaatcactggcctagagcacgtggaacagcacgtcgaaaaaccaaccagtggctcaagatgacaccgcgcacacaatacacactcaacatgccaacaaatgctggctctgatgactgtcgtcccaagaaatcagcagaaacggccttcaccgagtgctaagcacctgcacagcgtatgtattcagtgggggttgacagagcctgctctgccccaggcgctgcccccagtaccaggaaacttcggtaaacaggaccgagaaggtcatctcagaggctggtgtgcaacgaggtaggagggcgggggtcagtgcagggcaggggtaggtcgggtaaccccactagcagggatgggtcctccaggaaggagccaggcagagggctgtgcagaggaagctgggaggggctgaggccagaggcagacagatccaggactgaccacccaggcccttgtaggtcagggcgaggaacagggattttaatccatgtctgaggggaatcactgagcgttttaagcagaggaagaacttgatcggattgtgttttaaaaggatcacctggctggctggctgctgcatggaggacagacgggggtaggcgaggggggacagggaagaggcccctgtggtcatggtggctaggatgcggggaccagggcacagcaatggtggtaggaacagcggtgggagtccatataggtttcagaggaagggccaacagaacttgttctgagaatggttgtgggagctaagagcctgagtttctggcaggagcacctggttgaggtggggtgtctgttactaagccagtgagggttggggtacggacctgtcggggcaatggaggctctgttttgagagtattggtacatgcacactgtccttcatcctcacaacagccctgccaggcagacactgaccctctca

SEQ ID NO: 23451 - DNA, 1076 bp, Homo sapiens
cggctcactgcaagctccgcatcccgggttcaggtgattctcctgcctcagcctcctgagtagctgggattgcaggcgcccgccaccatgcccagctaatttttgtgtttagtagagatggggtttcaccgtgttggccaggctggtctcaaactcctgacctcaggtgatcgcctgccccagcctcccacagtgctgggattacaggcgtgagccagggtgcccggccaacttcttgttgagagatcacccccaggctcattggcatgggagatcaagcagctgagtctcaaggtactttgcagccgcccaacagccagcggatgcctgtgcttgggaaatgggctcaggggcactagagggcagtgtttgagaggaaagaagtcagcatagcagcagggccgggcctggggcagacagcccacatggttaggaaaaagtgagtgaacgcatgtggcccccagaacccctccctgaaattgcagttgatttttattcccaccgtcaggcccacatatctaaagcttcctctgaacgctccttgcagtacacaaaatagaaatgattgacaggcacagagcagcagcaggccccacgctgtacaccagcatctggcactgtgggtcaccaagcaccaactcgatcccctcggagccaggtgtgtgttgagattcaggatttttcagttgcaaaggcaatatgatctctactccacagggcacacggcaccctcagtgctcagcacagcagtgtgcagcagcctggttaacttttctgcagggaagtatgtgaacgttcacaccaagcgtgtcagtcatgtctgtaagtcatctcccaccaacacaggtcaggttttcctgcccaatgagcttggggatggcttgactttggagctctttggatctgtggattttggaattttggatttctgatacccgtttgatcaaagaggcaaccgaggtctaacgggtcaagtgactttcccatatccgtgaaggtcatgaaaagcagggccaggatggtggcctggggtgccttgaatgataagctgggcccttcactgtgcaggcccctct

SEQ ID NO: 23452 - DNA, 1099 bp, Homo sapiens
tgccagtgcactccagcctgggcgacagagtgagactcttgtctcaaaaaaaaaaattcacaaaacccagtcatgtaggttttctcctatgttatcttctaggagttttatagatttgcatttaacattcagctctatgatccattttgagttaatttttgtgaagagactaaggtctgtgtatagatttgatttatttatttttggcatgttgatgtccagttgttctagcaccatttgtggagagaagtttggaagtttgagcattttttatgataccttttttttttttttagacggagtctcactgtcatgcaggctggagtgcagtggcacagtctcgactcactgcagcctactcctcccaggttcaagcagttctactgcctcagcctcccaagtagctgggattacaggcgtgcaccaccacacccagctcctttttgcatttttagtagagacagggtttcactatattggctaggctggtctcaaactcctgacctcgggatctgcctgccttggcctcccaaagtgctgggattacaggtgtgagccaccacgcccagccttatgatactgttctatctctgctctgtgcccaccaccacacccagctaatttttgtattttttggtagagacggggtttcaccatgttggccaggctggtctcgaactcctgacctcaggtgatacgcctgcctcagcctcccaaaatgctgggattacaggtgtgagccactgcgcctggccttgtcttcacttttgtttttttggttttttttttgagagggagtcttgctctgtcgcccagtctggagtgcagtggcgcgatctcggctcactgcaagctccgcctcccgggttcacgccattctcctgcctcagccgcccgagtagctgggaatacaggcgtccaccaccacgcccggctaattttttgtatttttagtagagacggggtttcactgtgttagccaggatggtctcgatctcctgaccttgtgatccgcccgcctctgcctcccaaagtgctgggattacaggtgtgagccaccgtgcccggcccacttttgaaaaacagtttcagtgagtat

SEQ ID NO: 23453 - DNA, 1642 bp, Homo sapiens
ggactacaggcgtgcgccaccacgcccagctaatttttgtatttttagtagaaacggggtttcaccatgttggccaggatgatctcgatctcttgacctcgtgatccacctgccttggccttccaaagtgctgggattacaggtgtgagcccccgcgcccggccagtggtgtcttgttttaatggacggttccctaatgacatacggtgaacatcttttcctgtgtttatttgccatctgtattagggttctccagagggccagaactaacaggatatatgtatatattgaaagggagtatattagggagaactggctgacaggatcatcaggcaaagtcccactatagtccatctgcaagctgaggaaggaagaagccagtcacgtctcaaagtccaaaagcctcaaaagtagggaagccaacggcgcagccttcagtctgtggcggaaggcctaagagtccccgacaaaccactggtggaagttcaagagtccaaaggccaaagaacctggagtctaatctccaaagacaggaagtatccagcacaggagaaagatgaaagccagaagactcagcaagccagcccctcccaccttctgcgctgactggatggtgcccacccacactgagagtgggtctccctctccccgtccactcactcaagtgtcagcctccctggcaacaccctcacagacacacccagaaacaatccttttttttttttttttttttttttttttttttttttttgagaccgagtctcactctgtcacccaggttggagtgcagtggcaccatctcggctcactccaacctccgcctcccgggttcaagcaattcttctgcctcagcctcccgagtagctgggactacaggcacgtgccatcatgctggctaatttttgtatttttagtacagggtttcaccatattggccaggctggtctcaaattcctgcccgtcttggcctcccaaagtgctgggattacaggtgtaagccaccatgcctggccccttttcctattttttaatcagattgttttcctgttaactgagttttaagagccctttgtaaatcttggatagcagtccttcatgagataggtctcttgcaaatagtttctcccaggctgcagcttttctcattatattaaaaatgtttttcaaagagcagagggttttgttttgttttgttttttgagatggagtctcgctctgtcgcccagtctggagtgcagtggcgtgatctcggctcactgcaagctccgcctcccgggttcacgccattctcctgcctcagcctcctgagtagctgggactacaggcacctgccaccacacctggctaattttttgtatttttagtagagatggggcttcaccgtgttagccaggatggtctcgatctcctgacctcgtgatccgcccgcttcggcctcccaaagagctgggattacaggcgtgagccaccacgcctggcctagcagaggggtttttttattattattttaataaagtcaagcttgtaagtttctttcatggatcatgcctttgatgttgtatcaaaaaaattatcacggctgggcgtggtggctcacagctgtcatcccagtattttgggaagccgaggtgagtggatcact

SEQ ID NO: 23454 - DNA, 1020 bp, Homo sapiens
cgaagtctcactctgtcacccaggctggagtgcagtggcgcgatctcagctcactgcaacctccgccttccgggttcaagcgattctgctgcctcagcctctcgagtagctggaattacaggtgcctgccaccatgcccggccaatttttgtatttttagtagagacggggtttcactatgttggtcaggctggtcttgaactgacctcatgatctgcccgcctcggcctcccaaagtgctgggattacaggcgtgagccaccgcgtcggacttgactaccattcttaaagggggtttctttcaaaaaagagcagcatacctcataatgtggttatatacatgcaatggaatattatgcagccttaaaaaagaaggaaattctgacacatactacaacatggatataccttgaggacattatgctaagtcagtcacaaaaggacaactactgtatgattctagtcaaaggaggtatctaatgtcaacactgtagaaacacaaagtacaatggtggttgttaagggccagaaagaggagagagaaggaattagtgtttaatgggcacagaatttcagttttgcaagaaaaataagttctagaggtcaacatattgtaccacaatgtgaacatacccaacgccactgatcagtacatttaacaatgtcatattaaatcaaacaaaatacatcatttagtttttggtagaaaaatctgttttgcccccagggtcacagtgaggggtaggacacaggaatccagaagaaatagaactgaggttgaaaaaggtggacgggagctgcatgcatttccttgttaatagcccagaatgtgccaggtgtgctttacaaatgctgctgcttttttttttttttttttttttggggggagtctcactttgtcacccaggctggagtgcagtggagtgatctcagttcactgcaacctccacctcctgggtttaagcgattctcctgcctcagcctcctgagtagatgggattacaggcacctgccatcatg

SEQ ID NO: 23455 - DNA, 1050 bp, Homo sapiens
accgaaggaggcaccgaaaagctcagtaatcgagatagaaaacatgttttcatatttgagatactggggaggccagggatgctactcaatatcccacagtacacagaacagccacctagtctcgctctgttgcccaggctggagtgcaatggcatgatctcagctcactgcaacctgtgtctcccatgttcaagcgattctcatgcctcagcctcccgagtagctgggattacaggcgcccaccaccacacctggctaattaaagacggtatcaccatgttggccaggcttatcttgaactcctgacctcaggtgatccacccgtcttggcctcccaaagtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacggtgcgaccacctccctttgagtgtgggggagatgtagcgactggcttctagcagtaggatagggcagaagtgacagtaggttagtcttgtggttaggttacaaaactgacctctgtgatggtagcgtccctcgtcagccctcttgtcttgccctctcgctggctggtggtgatggagccggctgccatggtgagcggccctgtggagaagccagggaggaatggagacaatctggagaaacagaatcacaccaacaaccacgtgcgtgagcttgctgtgtgctcttgcttgggagcaagttac

SEQ ID NO: 23456 - DNA, 1037 bp, Homo sapiens
aagcccttaactgctagttcctacaacaccacagacttctcactgttccgggaacggataatcattattcccagtttccctgcaaaaaagaacttgaggctcggagaaagtgacttgaagctgtgaacagggaccagggttgcgatatcaggcagctgggggcaggggtgggatttcagctctgacccccaataagagggacctcagcctggatcaggcctacctgtgcaggggagagggggggtcttcagggccgcggcaccccctgtgtggggccggcagctcccagcacgctgtccctgctgagaccctctgctcgggccctcacccagacccccctttgtctcctccagcctcactgctttgttttcgtctcctcccacgttgcttccctccagtctgccctctatttgctcaaggaccctagagttctagtccatctacctccttccctcccccaggacccagagtctgagcccccactgcttggtagaaccatgacttggaatgttctttcctcccccagggacctaggagtccaggtctcaagcttcaatcttatccttttaaccctcaaaccttttaacccagtccgacacccagcagcgacttagacaattgcattagagcctctggaaaaccaagagtttaatcgtccagcctttacccctctcgggggcccagagatactaccacttcctaactttcccagaaacttgcccccaagcccttgaagtcccaagcctgctcctctgggtctccaggatcccaagcaccagacttgggctcttcttcaaaacccaaaggtccaattccccagcctctcccctccaatatccagggctctgtcctcctagggagcccaggcatggtgcttcccaggccctgggaaaacaaactggcttcttccagccttttggggatccagggatccaacctctcagactttacccactcccagcccccttcctcccttaggcccaggaatccgggtctccattcccaactcccttagccccagaagtctgggtcccgcc

SEQ ID NO: 23457 - DNA, 1091 bp, Homo sapiens
tgggttggaatcccggctctgccatggatctgccgtgagtctcagccagccactttcctttccgggcctcagtttccttatctgtcaaatgggaatggtatggtgcgcaactgtatgaggggtcatgcgtgacacgtggattgtgctgtcaggagctcgggggagtacgtgcccctggaaagcactagagccatgccagcgttcagtgagctctgtgaggtgacaggaagctcccaaggccaggcctagggcttctggtgcgtgggcaggggagcggagacagcttcctcttttgaaaggttggcaggagcgaagtggaggctgatggatgtaggagaagatctcacacaggctggggggcaagtgtgggtgccctgaggtgcccagggaggggagcgtaaggcagggcagacccgggagggccacgagtgccaggcgaggagcatggtggcttccatcctgagggtgatacggccatgaggggtttaataggtggggcagggtcagctcagggggcccagatatggggggagaccagcctgggagcatctggggacactttctggaagacgtgagtactacagcactaagagtttgctagaagggcaggaatgaagggccctcccagtacaaaggtgtgaagacggtggtgaactgcgcggggaaggggcgaagacggtggtgaactgcggggaaggggtgaagacggtggtgaactgcgcggggaaggggcgaagacggtggtgaactgcgcggggaaggggtgaagacggtggtgaactgcgtggggaaggggcgaagacggtggtgaactgcgaactgtgcggggtaggggtgaagacggtggtgaactgcgcggggaaggtgtgaagacggtggtgaactgcgcggagaaggggcgaagacggtggtgaactgcggggaaggggtgaagacggtggtgaactgcagggaaggggtgaagacggtgaactgcggggaaggggcgaagacggtggtgaactgcagggaaggggtgaagacggtggtgaactgcgtggggaaggggtgaagacggtggtgaactgcgaactgcgcggggtaggggtgaa

SEQ ID NO: 23458 - DNA, 1071 bp, Homo sapiens
gtatcgttttaccttatataccccagtacatgtaagtcggaaaagaatggtgtcatcaggtacagtgttctctgtaggttattaggtcaaccttgtaatcatgctgttttatttgtagtgcttctttatctttagtgatatttcacccactgcttattctgtcagttactatgagaggtgcatttaaattcttgctgtgattatggactttgtttcttcttatagttctgtcagttacaatttgtatatattttaagactagattatttggtgcatatatagtttatttttgtttgtttttgagacggagtctcgctctgtcacctaggctggagtgcagtggtgtgatcatagctcactgcaacctccacctcctgggttcaaggaattctcctgcctcagcctccccaggagctgtgactatgagagtgtgccaccacacttggctaactcgtatttctagcagagatggggtttctccatgttggccaggttgctcttgaactcctgacctcaggtaatctccctgcctcagtcttccaaaatgctggggttacaggcgtgagccactgcacccaaccaaggtgcatatatagtttaaattgttctagtacacattccctttctgtcatcctcacctcagtcttagattttgttcctatttggctgcctttcccctttctattaaagttgttggttccagttctcatcctcaggctcctcattcttttttcagttccctcttctctcttttgtgatcatatactttattatttagtataaaaatgaagttaacatgaattcctccctgtctctgctcatctctatgttgacagtttttagtcaggttttctcggtgaggtacataagatgcctctaaccgctccaggccgctgtcccttcggcttagcacctgtaacagctccaggccgctgtcccttcggcctagcacccgtaacagctccagaccgctgtcccttctgcttagcacctgctgaagcagagcccctggacctcagtgtctggccaagtcccagctctgttgctgactgggcccatccctgagctgat

SEQ ID NO: 23459 - DNA, 1066 bp, Homo sapiens
ctcaggctgttctcaaactagtgggctcaagtgatctcccatcttggcctcccaaagtactgggattacaggcatgagccatggtgcctggctgggagtgacttcttcttggatacagtatccatttgggatcatgaaaaagctcaggaagtagatagtggtgatggttgcataatattggaggtatcctaaatgccactgaattgtgcactttaaaacagggaagttggtaaattttatgttgtttattttaccaccaccaccacaacaaaagataaagaaaacacaacaggtggtcaacacccacaagctatagctttctgacccctgggcaagggctctgtctacagatacagacagatctcagcaacatgttgaacacaagaagcaaattgcagaaggatgtgcagcagacatgcagagggcgctgactgtggttgaataaaaagccagtcaccctcccttcccctccctgaattgagacccattcggctataataggattgaacagttggtgactcctttaaagaaatgacacagccaggtgtggtggctcatgccggctttgggaggccaaggcaggaggatcccttgagcctgggaatttgaggcttcagtgagccataattgcaccactgtactccagcctgggtgacagtgtgaggtcctgtctcaaaaaaaaaaaaagggtcagatgcggtggctcctgcctgtaatttcagcactttgggaggccgaggcgggtggatcatgaggtcaggagttcaagaccagcctggccaacatgatgaaaccccatctctattaaaaatacaaaagttagctgggtgtggtggcgtgtgcctgtaatcccagctactcaagaagctgaggcaggagaaccgcttgaacctgggaggcagaagttgcagtgagccaagatcatgccactgcactccagcctgggtgacagagcgagaccatatatatatatatatggcctaaagtttactgagcaaatccagtgctcaattacatctaacttttcctgtcactaccaatataattttttttttttttggagacg

SEQ ID NO: 23460 - DNA, 1026 bp, Homo sapiens
tcagcccagcctgggcaacattgtgagaccatctctgcttttttaattaaaaaaaaaaagaagaaaaccccaccctggcaggagaatgaagggactgactggtagatggcattggggtcaccagctgcccctttcgggatgaaactgttagcttttcctctaccaagaaaattccagaggggttaagaagttaagtgaacaaaactaaacccagaaagatttccggaatggaaagtggatgactggtttgatcatctcaaggctgaagatgctgccccgcatagctcctgtagcagaagccaggtcagctgaggctgccagtgccacggggacatgggctgccctgccctagacccactgtgtgcccagcgtggtctctgctccgctgcttctcagtgtctaggagggactaaggacacttgccttggaaggtggttgtgagaatgaagtgcgtgagtaatgtctgtcacatacttagtgtcctttaagaattaactgtcctttatccattgatctttgtggcagaatttttcatgaatttgagacaaatgatcccttgaactgtccgtaacacgtgggacagaatgtggaccctgatcattagaccctcgtggtgagggaggtggggccctggcaggcacagtttaagttttgacgtgattctttttcccataatttagaatttcagccgcggaccgtagacatcttgaggttaggggatgtgctttattgggctgtagtctcacattctgcttgtgcctggctggtgtgagtgtcagcctcctacagatgccccaaggatggggacaagggcatggatctgaatccctctctggcacctgtccttggaagagcctgaggagagtcgcttaacatttccgagccccattttctcacttctagagccaagggaaacagcctacctcaatgagtggttttaaggatttaaagtgatcatatgtgagatgttgatattcatgtatgcgttgccccttaggaccagtggttcgggttgtgtgtgaattt

SEQ ID NO: 23461 - DNA, 1049 bp, Homo sapiens
cagctgcttccaccagctcctgctggagcctcccaaggtcaggggtgtgggttctggtcctcggggaggcgggggaagcaggaagggcagcccttgggaatcaggcctccctgtgtctgcagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggtgcggggactggaccgggctgggggttcaggggctggggcggggactggactgggctgagggttcgggggctggggtgggggctcggctgggggctcaggggttgggggctcggctggggcggggcctctctggtaccaatcctgtgtcctcccataggacctcttcttccattatgtcttcaacaacttcttgcatgcccaagtagagggatgcgtgagcaccatgctgagcttggggccacctcctgacagcagccctgagacgcccatccaaaaccctgttgtgaaacatgtgagctgggactccctggtccccctccttctgggcccatcccctgtgggcgcaccctctccagaggcctacccctcactccttcctcccacaagtgtttgttgggtagtgttaggtgccagcgcccagatggggtgtgggaggcatggccagggagaaacgcggatgaaacatgcaggtgcagggagcagtgggctcctgacttgagctgaagagctaggggtgggcgggagcagacctgcgagcagctgagtgtgcatgagtgcgcacacgtgcgtgtgtgagcatgtgtcagtgcaagcgtgtgtgagagcatgtatgtgtgtgagtgcacacgagtatgtgaacatgtatgtgtgagcatgtgtgtgtccgttagtgcatgcatgtgtgtgtgtgtgtgtgtgtgtgtgtgtgtgtgtgtgtgtgtatgcaccacatattcttttgtagaaagaccagagagacttgggtggatgc

SEQ ID NO: 23462 - DNA, 1098 bp, Homo sapiens
cctgtggccccctaggaacccagccattcttgctcttttttttttctctctctaaacggagtcttgctctgtcgcctaggctggagtgcaatagcacaatctctgctcactgcaacctctgcctcctgggttcaagcagttctcctgcctcagcctcccaagtagctgggattacagacgtgcaccaccatgcccagctaattttttgtatttttagtagagatggggtttcaccatgttggccaggctggtctcgaactcctgaccttgtgatccgcccgcctcagcctcccaaagtgctgggattacaggtgtgaggcaccgcgcttggctttttttttttttttttggaaacagagtttcgctcttgttgcccaggctggagtgcagtggcgcgatctccgcacactgcaacctccccatcccgggttcaagggattcttctgcctcagccttccgagtagctgggattacaggcatgcaccaccacgcctggctaatattgtatttttagtagagacggggtttctccatgttggtctggctggtcttgaactcctgacctcaggtgatccacccgccttagcctcccaaagtgctgggattacaggcgtgagccaccacacctggcctcttgctcttaagaattctacagcctgactgggcatggtggttcacgcctgtaatcccagcactttgggaggctgaggtgaacaaattgcttgagcctaggagtgcaagaccagcttgggcaacatagtgagaccctatctcttaaaataaaaaagtagccagacctggtggcatgcccgtaatcccagctacttggcaggctgagatgggatcacctgagcccaggaattgcaggcggcagtgaactgagattgtgccactgcactccagcctgggtgacacaagagaccttatttcaaaaaaagaaaaaaagaatcctccagtctgttggcagagttggcggggcacccacctgcatcacaatcagaccgtggagactggactttggggtgttgaggtgccttgggactcctgagtgccctgaccctgtacccctccctccactccagaggggaccccatatgc

SEQ ID NO: 23463 - DNA, 1103 bp, Homo sapiens
gcagaaaatcgaacggtttgcaaatacacagcttaaataaatatttataaagggagcaccctggtgtaaacaagtatccaaagaaaaaagtcaaacatgcgccacatcccaggatctcccgccgtcgtcgtttccatcactgtggtccaagggcagtcactgtcctggcttctgacgccatagatcagttttgccgggttttggctttatgccaaccctttattgtatatagtattgactagacaacttgttgcacattgtccagaattcagaagaaacagaataggacccagtgaaaaggctcctacagacttccccggtgcctggttcacccgcctgagtctcccgtttcttgcttgtttgccagagatagcagatatagatataggcaacacagacacattttcctctcccttttttctttggcacaaaaaggagcattccatacacactgttctgcttctttttcacttctctcaaacatgttttcgtattgttacttaaagagcttcctcgtaattttttctggctgcgaggaataacagagtatagttatggcatgacttacgtaaccagtaccctcattgtggacattgatacttaacttctgctcctttgctctggggaagagtcctgtaatgaataatcctgtgtcgtttcacatgaatgtctgtaggataaatgcttaggagcagcttttgaggtcagagggtttgtgtatccatcattttgagaaatgcagctgctcggctgtccctaggagttgttgtgacccacactcctaccaggccagaggggagttcctgggtgctccacatgcctgtcctaggcttttggacatgctggcccccagatctgcccctccatggctcctcactgccctcagcagagagactccagggcccttgtgacccacctgtcagctctccagctcctggttccctcagaaccatcccttggggcccgggtgtccaggtcccgcctcctgcacaggggaggaagagttagcacatgagtggccgtgagagggtcactccatggggaggaaaccgcaagggctgtttgagaggagggagtggctgggctgaggctggagggtcttc

SEQ ID NO: 23464 - DNA, 1048 bp, Homo sapiens
gatgctactggtcgcaggatcccactttgtggagcactcccttagcgtgtagggtgtgctgcctgtgggtgggggatttagcggtgggcggccgcagttagtggtagatggctgtttcttggacccagtctactaatgcgcttctgggcattgccactttgtagtcgtgtagctgtgggctgtgactcgactccctagtgcctcagtttctcccttgtaaaggctcagttttgtgctcccagcttatgaggacctgacgctgaagtgtgtagcgcaggggggcgtcatggcccttccttgcgtgtttgccagcgtggcatctgggagggtgtttgggctctgtgtgctgggcaccaccgtgccaggtgttgggatagagacttaggagcttacagtctagtaaggtcaggagtgagaacgttgtaattgtgattcatggctttgaaaaaaccctgtggggtgcacctggggtgtccacgggggtcagagatgcacttgctgaggccctcccacctgattctgttgctctggaccaggccccaagggagagcaaatgtagaagctgcacacggacccttctcaggagtgaatgagctggggaggaggcaagcccatccctcccgggagagcccccaggggcaggcctggtgcagaagtgtgaaaggcctcgttgactgctggaagggcgtcctcagtgtaaagatgtgcaggcaaagccctgtgtgcccgaattgtcctcactgagcagacaggagcccccacaccaggggctgaccatagcctctgtaatggaggtggcgttgagccaggttttactcccaggttcggaggtggggctttcatgctcatctccaatcccattacctgtctgcagccaggattgtcttcctggagcccgaatgtgacaccatcgctccctggcgggcacgtcttcagggtgccaaacccactccctggctcaggaccaggtgtccagggctgcattcaagccctgcggcccctctgcctagtggaacctttgcccgtgagccttcctcatcctctgccc

SEQ ID NO: 23465 - DNA, 1065 bp, Homo sapiens
gggaaggggccgcgcggttgggctggcctggccggataccgcggccccgagggcacggtctcagccctcggcccccccagcccttccttccccttttcgagtcagcccgggtcccgttgctgccccgggcgggctgcgcgtggcctttgatcaggcgggtaattacggggattctggccggcaggaggcccattcattcgtccttgctcggcaggcggggaggaagcgcgtccccagcgggggaagtgactgggccaaggtcagccaccgcgtggcccacggggcagggcgaaggcggggactggatcgggtggcgactcctgaggcctccctcccctgtgccgagtggatcagagtggagccccgccctcctgacaccccaccccgacccccagtccagggagctgaccccaattcatgtggatgagtgctctgggacctgcagagtcgcacagaaaagtgacccacagacacagaaggcaggagtgagtggaggcagaagtttttccagtgccaggccctgtgccgggcactagagacagggagcagggagatgaacaagggcttggagtctgggtggaaggcagagactgagacccgggcgacagagtcgccatccaaggtgaccagacccctgatggagaggtctgggggctgtgggagccagggaaggcattttgacccagcccagtccgggggatggtcagggctttagggaaggaatggcttggtctgctctttgcggtgtcctgctcccaggtcccatgttgcgcagtgcttagaacccatctggggatccgattgaccccagcgccgggaagcacagttgcgttgatcctggcttagctcctctgaagaccgtaagcctctttggctaaacgctgctgacattcacctgcctgcctctgcgcagtccctgtggtcctccggccacgcacggcctcagagaacatccagatcagattcctgcttgcttatctcatgtcttatccatccatccgggcacccggcctggcccctccctggtgcactgccagagtgtgtgcaggcactgggttgtattcc

SEQ ID NO: 23466 - DNA, 1050 bp, Homo sapiens
atccaaagggcccaatttaataaagtttggaatactactcagcagtaaaaagaaatcattgataacacccaagaacatggatgaatctcaaaatagttacgaaggtgaaaggggacagccagaaaaaaagtgcatctggtatgagtctatcaatataaaattctagaaaattctattactaggctgggcacagtggctgacacatgtaatctcagcactttgggaggcaaaagcaggtggattgcttgagcccaggagttcaagatcagcctaggcaatgtagtgagacccatctctacaaaaagtagaaaaaattagccggacatagtggtcccagccacctgggggggctgaggtaggaggttcacttaaggctgagaagttgaggctgcagtgagccgtgatcataccactgcactgcagcctgggcaacagagcaagacactgtctcaaaaaaaaagaaaagaaaaaaagaaagaaaaaagaaaattctgtccgtgatctgtaatgacacagagaacaccagtggttgtccagggatggagctgtgggagggacagatgatgaagagcctggggaagcgttggaggatggtggggatgttcagcttcttgatgacggcaatgacttcatgagtatgtacaaatgtcagaacttggactctggacatgcaggcacaggaaccagctagaggagctgctgcacagcagtgtaaatgcaccaaatgctgctaaactgtacagataaaacagttaattttatgtcacgtgaaattcatgtcaataaacacattaattaaggtataggatttgttgagagactgagtgtgtcatgtgagggaaatgcaggaatcaaggataaccccacaaatcttgtggattgcacatcaagggggctggagccacctttacgtgaggtggggaaagatgtggtaggtctgggatgtgtggtgattgacaggtctgttaggcatccaagacaagggaaactccacattcccatgagggaaggatggtggttggtcacgcattcttagagaaggcattattt

SEQ ID NO: 23467 - DNA, 1047 bp, Homo sapiens
aagttgagtttctggggaagccacagactgtggcggctctgactcagggctgttgcagggtcctccctgaccccatgaggagttgcaatttgcagccatatctggtggagaatatttcagtcagtctctgagaaagttcttccagtagctggtgtctaattgagacctatctagacaggcctcctttggttttcctcaataatagattcactgttcagaagtctgcaaaaaaaaacatgagcccgatcaaagtttctagtctatccacccatcccttccaaaaccctcatccaaatcctggacgccacttcttcagcagcatcgaattcagcacagtggaaatcaacccaccctgttactcttccgctgtctacacctgactatatgttctgatttaaaatcctaatgctcccctggattctgatctccaggaaatcattgtgcagaagtgaaatcagtttttttttcaattggaacaacatggttcccaactgtaaattaaataggatacttatgtgaagctcctaaaatctgatgcaacaataacttatttatgttttcctgtccagacaagatccaaggtaaagcccttcatcataattacgcacaaagatagagaaaaatagttacaacctacagttgtcccccaacaccttttcttgttaaccccaggacatttgtttgctccagggaagggagagcattaagtaatcatgagaattcaactcctacacagatattgctattttggtaaaatgcacattcataaatttcatcatttttaccatcttgaagtgcacaatttcatggcactaagacatgcatgcaccatgctgtgcaaccatcaccactgtctagctccagaattgtctcatcagcccaaaaggaaccccatccccatcaatgatcaccctctgcccacccaccccagcccctgccaatcactgatctaccttctgtctctaagggtttctctattcctaatctcatctcagaaaatggatttaaagtctagtgctctatgaaattttcaggaagtgaaataat

SEQ ID NO: 23468 - DNA, 1036 bp, Homo sapiens
ggcaagacacattgtttaaacacacagaaacacacatacatgcacacacacgctcctaaatatgacactcctttgctgaaaaccctttcacagcttccttttccctgaggataacatccaacatttttcctgtgactcacatgcccccgtctgttctgtttcctgcctcctgtctcttcttacttgtaacagtctcaccaccatgcccctccttctgcctaccacgttcctgacacaccggcctctctctgatggagggactcagtgccttctgccccaggacctttgcatattcaagtctctgcctggaatagtctctcctaactcttcagctggccagctcctattccttacctcaaatgtgacttttctagagaggccatctccgaatccccacactagaatgtgtgtgtttagcatgagaattccatgaagacagaactattttcatcactatattcccagcatcaagcccgtggaaagaaccaggaataaacatttgtggatcgaatgaggaaatgggaactcagagttatggcaagacccaagtcctcttcccaatatactctttggtgtctttacgtcgcaaaagtctggagtctcactagaattatctaactatggtaatgttgacttccaggcactgcacaacgtaagctcgtcaatgacatgcaacagtcccatgaactggggattcttgtgagccccgttggtcagatgaggacagcaaggtttgcagacgcagtgtctccccaaagtcacagaatcagtgatagaaaccaggatgcagacacaagtgtatctccaagggcaggggctagcaacctagactcattcaccccactgtgtccatcaagggaaatgtgaatgtctaaatgggaagcaagaagaagtctgttagacttcaggagcttctctctgaatccagcccacaagagcctcccaagttgtaagaaaatacatagaggacacaaggcatggctggaagcattaccttcacgaggagtacaggcttctgccaatcccaggaaaagca

SEQ ID NO: 23469 - DNA, 1065 bp, Homo sapiens
aaccgttcaacaccattcatttccttcagcatcctccccagtggaatctgaaggattgctgttggttcctgaaccaaagcattgcttaggtgaatcttgaggactgaggaggacttttctaggtagacagagatcaaggaatcaatgtgtgcaatggcataatggagcgggaaaaaaaatgtgatgttttggggggaatcagaaatgatttaatatgggggggcgtggtggctcatgcctgtaatcccagcactttgggaggccgaggtgggtgggtcacctgaggtcaggagttcgagaccagcctggacaacatggtgaaacttcatctctactaaaaatacaaaaattagccaggtgtggtggtgcatgcctgtaatcccagctacttgggagtctgaggcaggagaatcgtttgaacctgggaggcagaggttgcagtgagctgagattgggccactgttctccagcctgggtgacagagtgagcctccatctcaaaaaaaaaagactgggagccaccgctcacgcctgtaatcccagcactttgggaggccgaggcgggcggatcacaaggtcaagagatcgagaccatcctggccaacatggtgaaaccccgtctctactaaaagtacaaaacttagctgggcgtggtggcactcgcctgtagtcccagctacttgggaggctgaggcaggagaattgcttgaacccgggaggcggaggttgcagtgagccaagattgcgccactgcgctccagcctggcgacagagcgagaccctgtctcaaaaaaaaaggtttaatatggacaggggatggaatgtgggtggggggatcaagagaagtggagaaaagtttagagaagcaggaggagcttggagcctgagaacccttgggtaccatgccagagacctgaacttgatcaatggggcagaggcttcctgccaggttccctgaaaacttgggatcttttaggaattccacaaaggtttgctttgattttcatttcaaaaattaaactattttttaaaataggtgtgtacccaaaatatagcacatggactg

SEQ ID NO: 23470 - DNA, 1026 bp, Homo sapiens
cttcttttttccttaaaaaaaaagcaaacacttgtcactgtggtaattgaagtgtatattcaggacaacttgaatctatggtcccagatggctatcatcaacatgtgaacttgaataaactctctttaaactagattctgacttgcttggttatttaagattgatatagttccttactgtttaagtcaattacctgtttttacatccctaagttaatgagttgtaggatggggctgagcagtcaatcagttactggtccgttcagcaaacaggtcagcctgccatataatgcagtaaagggagcttgctggaggcccttaactgtggtggaggatgtgagaaagccctgcccagttttggacccagttgctgcatggccttatcttgttccctaaagagtggccctcagggccagctgagttagaagggtggagtgactacaattatctcatgcctcagtctctgtattccagggcaactccttatccatccaggcctctttttcaacagaaacagaccagactcttagcccatatctgctcccttctgcagggagtatcagagatgccctccctaccatggtctttcctccaaatctgagccctcccctacctcagcccatatgaaaaaacgatgtaggattcttccttctcaatctgatccacaggccaacttctcaagtgcacaacttctaactcatttaaagctccaggccagctaccttccctcacctttggaaattacgtccacctacccatgtgatgtcgcccaaaatccaacccaggatcttctgtctgaaacccgctccttaagctgatatctctaattccattctttcagatttttcaggccaaaacaaaacctatggaagacaccattcactaccgactttccctcacagctatgtttgatgcagcaggaaatcctgttgaccctatctctgagatccatccagagtctcatcacatctcccctctactgcaacccctctggcccagccctaccataactcaaggggtctcctca

SEQ ID NO: 23471 - DNA, 1031 bp, Homo sapiens
ctgactgggtggacatgaccctagctgttgccacagagactccaggtgggagtgaccctggtgagtaggagctggggaaaggtgtgatgtcagggctgggttcatatcattccatagcctctttgtgcctacagttgtattagtgctaaggccactggcctttcatactctggcctttggcctctggatgttccatacctctgccttcatgtctcacctgttcctctccatggcttgttctacagtgccttccagcattggcctgtacttagtgtttcatgagatgtgtagcccaaatagtccttaaacaccaactactgagtagcaatttgattttctttggtatggaccataaccttctgcacaactctcacctgtccccagcagccaagaaaatctgattgtgaatgactttgagacctgcctcttttttgtgctgtaccccacatctttgtcctctcccagttgaggccttctccattctatgacatttagatgccaactaccgtatagtacacatttgctgaacttgagtttggacccttgtcctaacaacagtcctatgaccttggtcttagttgtgttagacacatatttgtagtgaggcttcccctcttccacctgtgtcaatttgtacttcaccagcatttctctgctttcaggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggact

SEQ ID NO: 23472 - DNA, 1026 bp, Homo sapiens
gggcgggaatcatcctgaaatggcttaaagatgattatgtagattgggagttaaaagagaatattcatttcacagtggtagtgcatttagtgagccaggaaagtgatggtggagagccagagttgtgagataactgtgatccaaagagtgatgtacatatggaaagaagtgtagactgatgacgtctgggcttaaaggagaaaggcaagcccatctttggttgtctggtaagcatgatgttagtgaccccagaggaatttgcttacagaagggtgaggccctgtatgctaagcacagagcttagagggtgacaacttcttcacctgcctgtggttgctatgggtagacacagtgatccattgggaccatgaggcgagagaagacaccaatgacatctggtcctgatatttcctgagttgaggagttaggtaggagggtgtacaggagggagatgtgtgggggcacggatgggggttcttgggagagatgctgctcatggacttggctctcctgattgtggcaggggcaggtgaactttgaggacgtgttcgtgtacttctcccaggaggagtgggtgctccttgatgaggctcagaggctcctgtaccgtgatgtgatgctggagaactttgcacttatggcctctctgggtaaggccgtcacatccaccccagtgacttggactgggtcctgcccttcccctttttttcagggcatctttgtccttcctacatcagagccgtggacactgtctcatttcttagtgcctggagtaggttctgtgagtgctgggcttgggctgtttgcactcctactttctccttttgagcattcccagcgcttgctgtctcagagccttgcaggcatggattcaggagttatgcattgtattgtcagcccagtgggtcatatccatcttgtcctttccctgtctgaattcctctgtctgtatccatgacacctctgtgcctgggattctgcgctcttcctttagctgacatttcctgtggcctgcctatgtcagga

SEQ ID NO: 23473 - DNA, 1023 bp, Homo sapiens
cacatggtagtgtctgttgtaacactgggcagattagaaagtacaagtaatctctagaaagcttcccaagtacttggaccttgtagtgaatctttcaactagtgatatgcagatgtatgagggtgaatttctgtctgttggatcccttgaaaaatcagctctctggtgtcctacagtgaataagacaattacacatcccaacaattgctagggctcttctgttatatgtaccttctggtgcctgacaagggaatatcttttgttgaaggctttcccacatttaccacattcatacggcttttctccggtgtggattcgctgatgctcaacaagtttgtttttatagataaaggccttctcacatgcagtgcagttataaggcctctctccactgtgaactttctggtgttgaatgaggctggtgcggtgtctaaagcatttcccacattcactgcactcacagggcttttcgccagtgtgaactttctggtgctcaagaagtcttttttggtggctgaagacttttccacattcattgcactcacaaagttgttctctagtatggattctttggtgctgaagaagtttaacctcaaggtagaagccttttccacattcactgcattcataaggcctttctctagtgtggattttgtgatgcttaagaagtgtttgtttggagatgaaggctttcccacagtcactgcattcataagccctttctccagtgtgaattctctggtgtcgcatgtagtcagacgagcggataaatgatttcccacatatgatgcacacataaggcttttctccagtatgaattctctggtgctcaagaagtctttttttgtgaatgaaggccttcccacattctttgcactcataaggcctttctcccgtgtggattctatggtgatcaagaagtgactgtttgtatatgaaggatttcccacattcactgcactgataagccccttctccagtgtgaactctctggtgtcgaatgcggtcataggaatgaataaa

SEQ ID NO: 23474 - DNA, 1020 bp, Homo sapiens
caaatccactcttgttcgacaccagagaactcacacaggagaaaagccatatgagtgtggtgaatgtgggaaattattcagacaaagcttcagccttgttgtacaccagagaattcacactacagcaaggccttatgagtgtggccagtgtgggaaatcatttagcctaaagtgtggcctcattcagcaccagttaattcacagtggagctaggccctttgagtgtgatgagtgcggaaaatcctttagccaaagaaccaccctcaataaacaccacaaagttcacactgcagaaaggccttatgtatgtggggaatgtgggaaagcttttatgttcaaatctaaacttgttaggcaccagagaactcacactggagaaaggccttttgagtgcagtgaatgtgggaaattttttagacaaagctataccctcgttgaacaccagaaaattcacactggattaaggccttacgactgtggacagtgcgggaaatcctttatccaaaagtctagcctcattcaacaccaagtggttcacacaggagaaaggccatatgagtgtggcaaatgtgggaagtcctttacacaacactctggcctcattctccaccgaaaatctcacactgtggagaggcctcgtgacagcagcaaatgtggaaaaccctacagcccaagatctaacattgtttaactcttgaaactccaaacctgagaaaagccttagacctgcagggaatgtgccatgtctttcttcagtgttatggctatagagagcctttgtgaaggagccgtctgcctaaagttaaacctcatacttctagacctcccgatgggtcagactcccattagttccaggcatatgtgtcttgcaggagctcctttgcatgttctaaactgctggaggcctttgccagagttaaatcattagtcacccttgcatactaaggcgaggcagatacacctgtgttctcccaacccttggaggaaattccttgagcagtctgagcctttaaggggaat

SEQ ID NO: 23475 - DNA, 1052 bp, Homo sapiens
tttggcacagagtttggtgttccaaaggtcatgaggggttttagaccctggacccaggacatgttccaagactcttttacattatgtcagaaaaacgagccctgcctcagctcttctgccaacatgtctcccttttttgtcctgcaaaaccgccacagctatcattgcttgttcttggcagcggctttctctccagaagcggcttccgcatctgtagattaaaaggagacagcacaagcacataattattagaacaaaatttacaagtgtagagtttccagtggtcttaatccatttaagagaattgattgcagacaacccattggctgcctcgctgaaaatatcagttccagggagcagggttaagtgagcctgagaggcttcaaaaacctgctcttttacttttacaatatcaagggtgagattttcctctctgcccactagatggcatttaatttcccattggtgttctgtttcattctaactatgaggagtaacgcaaaaatcggatgtattccagtcacattgcatttgaattctagtttctaaacttatgatgcaatcccccatccaaattactgtctgagggagatcattaatttgactaactatattttgatctgtttgggcctgagagctccataatttcatagaattctttttccatttatcaacaaatttgacagtttgcacagatgagtgtaaagccacactagctactgcagcagtggtggtaactgcagtgaggccaattatagcaaatataagagcaactataaatctttttgaacgggataagagttttgtaaggatctcagttataatgtgaatggacggtgatgcctcccatggtctatttagagacacagggatccaaactccttctctggctctaattaacaagatagtttgatttttatcaagatgtcgttaatgcaagtaaacaagtgacattcctggcaggtgataaaacgggtatttatgtaaagagtaatatttccggcctggcggggtggctcacacctgtaatcccagcactttgggaggctgcg

SEQ ID NO: 23476 - DNA, 1039 bp, Homo sapiens
agggttatgaaatctacgccaggaaggggagggtttcccagtctctcactagccctaactcccacccacaggttctctgggttgtggagtgccattcccccagcccttagttctgaagaccttgggtgaaccccaagcccagggtcctatgtccatgttagccggtatatagagttgttccaatttctggcagccatgtgaacgggtgtggaaagtttttccagaaaggtacaagatgtgcaaatgcttaggtgcagtacggagctgggtgcatttatgaagccacaagtctccttgctttctggtgggaagcaaagaacaggaggataggcgtcaggactgcagtggctgcctgagaagttgagtgtgttttcaggaggtaatagcaagtttgaatcagaaaaaagaggtaatttaccaaggtcttcacaggcttcatctgtgtgcacagtggggcacaaactggggggttgagggaggaggaaggaaaatcagggtagactagtccaagtgagggttactggcccaggatcgtgatttaggagatgtggttagattccggatgtgtggtttcaaaagggacaactaaattacataatgtaggtggtgagggagtgaaacagagggttcagagaagactccagggtttttggtattagcagctgtagggaaagaagtttcatcaactaagatgaacaaattggcaataggagtaatattcactagggatatcaggtttgtttatgccatgctaagagtcagatctttcagagcctactaaatggaggcgttaagtgggcagatgaacgtgccggtcttgaaatctagggagtggttcagggtgcagatattcaagatgtggctgttgtgcgcaccaaggttagtgagctgtgggtcacagttaggcggggcaagctccaggttttggttgtaaagctgttagtgggccaagactgggaggatgatgatagagtaagtggtcatgaaggcaaggtatgtaaaagacagtgtagtttggcagtggccacggctcccaaga

SEQ ID NO: 23477 - DNA, 1102 bp, Homo sapiens
gtggcatgatctcagctcactgcaacctccacctcctgggttcaagtgattctcatgcctcagcctcccaagtagcttgaactacaggtgtgcaccaccacgcccagcaaatttttgtatttttagtagagatgggctttcactgtgttggccaggctggtcttgaactcctggcctcaagcgatctgcccaccttgacctcctaaagtgttgggatcataggcgtgagccaccgtgcccattccttttttcctgaacattttccaagtgaggttgttggaaatcacggatggggaactatgcatgcggagggctgactgtaattgatttctttctgcctcctcactaatctgcacactgcaggcagggacctggtctcatcatgcctgcacctccaagcactgccctcttacactgtagtctccccattggtcagcatggttccatgaaggaactccattatcacagcaaggactgacctcacactggtggctccaagtcactgcccaaacattctgaagggagtagaacttcttgattcctcagataaatagaggacagatgctggactgtagctaagtatttcctttcatctacgggataaaatactgataatttgagagtgatggacaaggttcagagtggtttcctcattttgtttttgtttttaatggaatgccaacttcatttatgcttgccgtatgcagatggactccatcccactggaaacataacaggcttaccaggtagcttcaaccactggttttatgtgactcagggagaattgaaaagctgtttcaggggagataaaaagaaggtaattacatttcaccgcaaaaagttttcttttcaaggcagtaaacggtcacaaccacccagaaacatcaccaaagagcccaaagtgttctttcataaaacccagttgcctgggattcaaggggctgcctcgagatccacgggtgagtcattgaattcctcattcagtggagtgagaatcgtagcctggagtcctcttatctgccatgtgaatgtgtactgtgtgcttgctggtagaaaggtccataaaatagagtataattagataaacatttgcttggaaatt

SEQ ID NO: 23478 - DNA, 1035 bp, Homo sapiens
ggaaagtgaatcacagggagcaccgcggggtttcaggattttggctgtccgctgcccaagccttggcatcacgggcgtctttccctctcacgttggggtcccttcaaggtcggcgccaggtatcctcccagaaaacctgcacaccgcaacgcccagcacccccacagcctccctgctgccactggggggcgccatcgtcgcggctaacgcaacccgagggcggaagcggtggagcgccgcgccgcggggttttctgggagatgtaggcggtggaagcacactcatgcgcagcaacggcgccgcagtgggcgctcatgcgcaatggagggtccggcgtccgccttggcgggtgggagtgatgacctgcactccccaaaccactgcgggatagaacggggccgagtgctctcaggggtggccgctaccggggcggcccgagacacggctgcgggttccagccaacaggcccggagtcgcggcctcggctccgccgtgggtgcacgggctagggctgcggggactcctgtgggctccgcgtctgcggctgggaggaatggggatcgtccccagatcccgccttccgggcagggcctccgctgcctgcgatcctgcccacagtccaaggatcctcctcgcctctcgcggactgcggtgtcagccgcccgagccgttccccggacacctggccaggtgacggcccccgacctccgcctggggcgggggggggggtggtctgcgagtccccctcacccccagcagacgttcccgagctcagaaggaaaaaaaggacgaggaaggggctgcttatgagtgtgtcggtgttgatttagtagttgtggaatgtgagccctggggaaataagtggaagaggcatggaccgtgtggctccactggggcgttcgcgaatgcctcctggaggaggagaccaaccagaaagaagaggcagcgtccagcaactggacaaaggccagagggcctttctggcaagaggactggggtgagcagaagctgatccggctctttatccctgggcgc

SEQ ID NO: 23479 - DNA, 1050 bp, Homo sapiens
actttgaggctttttttcagtgagcaaatgatattcattggtaataaaaaaatggctaacaaggaaataactttagaggatggtgtctactatcttagttttcagaagtaatctagataaaatgttaaaatgaaagaattgagtaaatgaaattgggataaatgttttaggtaaactctttgtgtaacttaaaatcttaaaattgtttttgatgttcattggatatctgggtcatttccaattaagaaaggattatgggttgggtgcggtggctcacgcctataatcccagcactttgggaggccaaggtgggtggatcacaaggtcaggaaatcgagcccatcctggccaacatggtgaaaccctgtctctactaaaaatataaaagtgagctgggtgtggcggcacgtgcctgtaatcccagctactcgggaggttgaggctggagaattgcttgaaccagggagtcagaggttgcagtgagccgagattgtgccactgcactctagcctggtgacagagcaagactccgtctcaaaaacataatgataataagtaaataaaaaggaaggattatgatacggggaaatatgtttctaaaagttgtggaattcttctcatctataaaatgctcatatctaatagttcaggatttcttgctttttagggtttcactaaaatttaaggttactaaggataagaattctagttaacaaatgattctgtatacaaaaggtgccaaaaaagatgtgctattggtaagaaagaaatgattttgtgtagttcagaggttgtctaaaggttgattcaggttgttgacttaaaaaaaagggttatttatgaaacaaggtagtaagaaaccagtaagtacgggagagagaggtgaagaaagttatgtatatgaagatgtattcttggtagggaaggatgtagcaataataattttgtatgagacaggatcctgtatggtaaattcttgccctaaagttaaatgaatggttgtttaaagagggatgtttaggacaagtcagaaagtccaggcatgtcata

SEQ ID NO: 23480 - DNA, 1026 bp, Homo sapiens
tcagttgatccaggctgaggctgcagtgagccatgactgcgccactgcactccagcctgggtgacagagcaacagcctgtgtcaaaaaataaaaataaatgcggccgggtgtggcggctcatgcctgtaatcccagcactttgggaggccgaggtgggcggatcatgaggtcaggagatcaagaccatcctggctaacatggtgaaaccttgtctctactaaaagtacaaaaaattagacagacgtggtgacgggtgcctgtagtcccagctactcagcaggttgaggcaggagagtggcgtgaacccaggaggtggagcttgcagtgagcagagatcataccactgcactccagcctgggcaacagagtgagactgtcttaaataaataaataaataaataaataaataaatatgcagacatggcctcttctagtctccccactactgtcaatttacatttttttcttttaggaaacatgttgctgagtggaccaatttaaattatgtgcttgtaaccttctgtgaacatactacttgggctcctgttttcacatcccctgataagtattttccatattaacatgctgccagttctgattacaatcaaaccaactgagcaacaaagttaaagcacaaccgaatccctgaaatattcagagtccaatattttgttgtttttggagacacagtgttgctctggtgcctaggctggagtgcagtggtgtgatctcagctcactgcaggtgagaccatcccccccacccccaggctcaagtaatactcctgcctcagcctcctgagtagctgggactacaggtgtgcagctccatgcccagctaattctattttttgtagagatggggtctcaacatgttgcccagactggtctcaatctactgggctcaagtgatctgcctggccgctcggtctcccaaagtgctgggattacaggcatgagccattacagccagctcagggttttttgtttgtttgtttgtttttttgagacacagtcttgccctgt

SEQ ID NO: 23481 - DNA, 1049 bp, Homo sapiens
tgatgcaggagaatcacttgaacccatgagtcggaggttgcagtgagccgagatcacaccactgcattccagcctgggtgacagagtaagactccatctcaaaaaaaaaaaaaaaaaaaaaaagaaagttagctgagtgtggtggcatgtgcctgtggtcccagctactcaggaggctgaggtgagaggactgcttgtgcccaggaggtcaaggctgcagtgagccatgttcacactacacttcaccccgggtgacagagcgagactctgtctcaaaacaaacaaaaacaaaacaaagttttacattttcctgatatttaaaaataaatatcaggctgggtgtggtggctcagcctgtaatcccagcaatttgagaagtagagaagggaggattgcttgaggctaggagtttgacactaggctgagcaacatattgagaccctgtctctaccaaaaaaaaatttaataaatcattaaaaatatcctagtatttaatctggaatttaattttgagtgtgtgtaaagtggaaatctgttttcttttgtatgggggagttcagttttctccaatattcagtgaacatccaccctgtcttcactgattggttgagtcatttcatgtatatcaagttccaaaaggtctgttcctagattgacctagttgtccactcctgtgccaataccacaatattttatttttttgagatggagtctcactctgtcacccaggctggagtgcagtggcatgatctcagctcactgcaatctctgccttctgggttcaagtgattctcttgtctcagcctcccgagtagctgggattacaggcgtgtgccactatacccggctaatttttttttttttttgtatttttagtagagacgggctttcaccatgttggccaggctagtcttgaactccaacctcaggtgatccacccgcctcggcctcccaaagtgctgggattatacacatgagccaccgtgcccagccaccacactattttaatattatataacttaacagtgtttttatttacaatatgacaa

SEQ ID NO: 23482 - DNA, 1067 bp, Homo sapiens
ccgcttgaacccaggagatggaggtttgcagtgagcagagaacacgccattgcactccaacctgggcaacaagagcaaaactacgtctcaaaaaaaaaaaaaatacaaacaattagccaggcatggtggtgcacgcctataatcccagctactcaggaagatgaagcagcagaatcgcttgaacccgggaggcagaggttgcggtgagccgagatcacaccactgcactccagcctgggcgacacagcaagactcagtctcaaaaaaaaaaaaaaaaaaaaaaaaaaaaaaaaaaaacacacacatggatgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatctttcttactgatttattgtagctctttacttaggaggttaattagccttttgcctgtggagagttttttggtttgccatttgtccttttttaattttttttgttttttggccatttgtcttttgactctgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctg

SEQ ID NO: 23483 - DNA, 1084 bp, Homo sapiens
tcaaattaggtcattctgtcttgattttgatatggatgtttcagaacaccctagcagatgtccctgtttaacttgaaaccatagatcagaaaactaagttcatatttcaattttacagagatttgaatagaaaaagtaatcaagttaaaacctgcaaagctaaaattgaactacttgggagctatgatccacaaaaacaacttattattgaagatccctattatgtaagtacagttcacgttttagggctaatatgaagacccaacacatttgtatcctgccatattaaataacagatgagattgtgttaaggatgtttttgttatgcaggttttgccattttcttctttttcctgtccatttaggggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattg

SEQ ID NO: 23484 - DNA, 1017 bp, Homo sapiens
tgggtttctgaaagaagcagcgtggacaggactcccgtgggcagggcccctgtcactgtgcctgggcagctatctcttctcttgtgctcactcagcacctcgggttagtattgaccgtggccctcattcaacactgattgtggacttggtcactttgtaactgagcctcgcctagaatggaagtcccaaggtgcagagactgtgcctggaggaaactgtgagacactaaaaccccatcccaaggagggggaatctgtgcaacaaatggtcaggatgaagcagaggctctcttccatagaagctgcggaggtagtggtcaggatgaagcagaagctgcaggggtggtggtcaggatgaagaagctgcagaggtgatgtcaggatgaagaagctgcagaggtggtgtcaggatgaagaagttgcagaggtggaggttgggatgaagcagaggctctcttctgtagaagttgtggaagtggtggtcaggatgaagaagctgcggaggtggaggtcgtgatgaagcagaggctttttagcagaagctgcagaggtggtggtcaggatgcagaagctgcagaggtggaggttgggatgaagaagttgcagaggtggaggttgggatgaagcagaggctctcttccatagaagctgcggaggtggtggtcaggatgaagaagctgcagaggtggaagtcgggatgaagaagttgcagaggtggaggtcgggatgaagcagaggctctttagcagaagctgcagaggtggtggtcaggctgccccatctatcatcacgctctgatttaatcaggtgctgcctcccacccttcctgcccaacttggtgcctcctgcatgactttcaggggggctgcgaagcaggtgtcccagatctaaccctccgaaatagtcactctccgccctggggccagaatcgtgtttgcagcctccagcccacctgcccttctcctgttctgcactcagtggctcccgttgccccaggatgaactctgagctcctaagt

SEQ ID NO: 23485 - DNA, 1065 bp, Homo sapiens
cggtcctctcttgagagtcggcttttactgcttttgtggttctgtaaagtccgtagcttacggttggcaggaaacattgacgggcggctctttgagccagcgcttctgtcattcctgtgcacactcagtcctgtgacctcccagtgtgggacaaagctccactcacgtctgcattttggggtggaatttaagcaccgtctggactaagaaatcattgcagagacgttcgttcccagggatctgaatgaagtagaaaagtgcagatgctcagggatgattcgtcctgctcttgagtgacaccaggtctttctcatctttgactcaggaggtgcagcccacggtgtgtgcagcttagcacacctgggcagggcacaatctgagggcacacggaggcccattaacaccagccgtgtattcagtgatcagattttatgtgggaaacatttcttgaccaccatttaataccattcactacactggaaaaaagaaaaaaaaaaaccttgctgtggattatgtgattaaatgataactttcaaaaacatattaaaactttcaaaaatgcattaaagttggaatgtaaggcattctattgaccaataccaaattctactggtttataaccattgattttgattccatgggctttgagatagcctgttaggttattgtcaatttagaggaaacctacatggttatgtcattagaaaggtggatttggattttaaaatgaaggttgatccctggaagaggacctggaggactgttgaacacaatgtgtgtttctcaaaaacgggatgattgctcagaatgttctccatgtacatggcgcccattctgccagtcacccagcttcatagaggttaaatcggaagcataggcagcagtgggtggggccgtgccacgctccatccccagcaccaactgggaatacaggcggcatttccgttggaatcaccccatcagtatggaaagacacaggaaaccaaagctctgctaaatggaggtgcaaggcctcgaggccatgacagtgacctcctggacacggaagcctgtgatacaccaagg

SEQ ID NO: 23486 - DNA, 1033 bp, Homo sapiens
gcccctaccccatgctgccctgaggtccctgcaggccccaccaggcacaccctattcatgagaggggggcccctgccccacgctgccctgaggtccctgcaggccccaccaggcacccccgattcatgagaggggggacccctgccccacgctgccctgaggtccctgcaggccccacgaggcacccccgattcatgagaggaggcacccttacccccacgctgccccaggatccctgcaggccccctagtctagctggatccaggaaaagctgcccctggcccacactggcaccaccccctgttcctccccaggcctttggagaagaacaggctcttctgaaagaataaaagcgtagagctctgagatggggaaaattggaggatgggacacagggaacttttgaggattcttctaaagtctgtttttggtctgagagttggttggccaagagtatggaatacatgactgtttatcgaggtgttcactggtgagttgtgtgcgtgtgtgtgtgtcctgtagctcaatgtaaaatatgcctaaaaataatagtctctgacctcttcatgtggggagccagggaacttggctgtcgtccgcaataatctacttgacccagctgtttattaaccactagattaaggtcagccttgctttgtatatgtcgcaccagttaacatgaacaaatgagaaatgatggcaatgaacccatttttagttagcacttactttaataagaattaatggatacttggacaaaagtgtagatataagtctgtcaatatttaataagcacctaattcatgtggaatattacacaatctgcctaaaatagtctcccagcattttgaagtgtaaaaattaatttattatagcagacatccaggaccaaaggccccacgggaagcgatggatcctgagggacaggtgctccccaggaggaccaggaaaggtgatcagaaagggctgtgcgaaggtggaggcagagctgcctgccctccccatgcaggggacctgcttcctctggcttctt

SEQ ID NO: 23487 - DNA, 1084 bp, Homo sapiens
ctttaaacaaccccatctcgtgagaactctatcatgagaacagcactagggggatggtgctgaaccacgagaacccaccccatgatccaggcacctcccaccaggccccacctccagcactgggaatgacaattccatgtgagatttgggtggggacacagatccaaaccatgtcaggtaccatgtaggtaatatacaaacatgtggatagacacgtacatgcatgcagatacaacatatgacatacgtgtacctgtgtatgtatctaaatgtttaaaaattaaggaatttaataaaaaagaatagagctttacacctgagaagaagctgtccacccacaactctggggctccgtgaggaaaaagagttcctctccaaaaaagagttttgtggcaccaattctggtttcctcaagaggtcttagggctgttagaagatttttttaggtcctctcttgtggtattgaacgggacaggagaaagaaggaacagaaagaagtaaatgaaggacagatcttagaggagacagatggaggagctcttgttttccaaaaagctaataaagtttcacattatccttggcaaaaattctatcaactagtggagaaacacacaaaatgagtgcattggttagcaggggtttaagaaaagagggactctgtcaccaagatgctttcatagaaagaacagaagcctcaaaacgtgtgtatccacacacacacatacacacacatgcacgcacatatacacacatacacatacacacacagatgcatacacacacatacacatgcacacgcatacacacatgcatgcacacacacatgcacacatacacacgcacagattcacacatgcacatatacacatacgcacatacacagacacatttacacacccacacacttaatactagctttaattaaggttacttttgactacagactcttaaaaaatccttttataaggtattagctgggcaattagcaaacattcctggtttttttttcttttttctttttggaatttacagaaagagttttagaagtgggacatatttgtttattagagatctagggtaatca

SEQ ID NO: 23488 - DNA, 1031 bp, Homo sapiens
tgtgtgatatgtaatgaatgcactatatgtagtactaattacctgttataatgaaggcactgtatagtaccgattacctgttttaatttgatcctaaggaaggtcaatgtgcattttgaggcattataaaaatatagttgatattacctgataacctttgagttagcgaattttaatttcacatcagtaaggtactgttttagagcagtgcttctccatctcagcatgcacaggagtcacccagcctcttgtggagggcaggccctgatgcagcaggtctgggcagggcctgagactctgaagttctaacaagggcacaggtgataagactgcagctggtcagaatgtacctttaatcaagtattaatattactctttcagctacagctggccactatatttaatagtatttctgagaaaaaaaatacatattttaagtctcaatttgagatcccaagaacacagtccttcaccccaaagaaatggatctgattttatcttttttcatgtggcaatccccatatctgaaccatgctcattaaaaactccattttccatctaataccttggagacaccatctttattgtatactaaagaatatatgtattccctttttgtaatttacagaaaaatcgagtagagagttctatataccctcttttcttctgcacagtttttaataacatcttgcatttttattattaataagtataaaaattttgcattagcgtagaacttttattataattgataaaccaatagcggtacattgttgttaaagtacatagtttaccttagggctcactcttggtgttgtcccttctgtgggtttcaacaaattaatggcgttgcgtgttcattgtactgtcatgccgaatagtttcactgccctgtgtattaatccccccaccacccctggattaatacccccatcacccctggattaatctccccactacccctggattaataccccatcacccctgaattaatccccccatcaccccaggattaataccccatcacccca

SEQ ID NO: 23489 - DNA, 1033 bp, Homo sapiens
ctcctcccacgcgccctgcaggctgtctccctctggggtcgagagagcttcacagaccatttgggaaagagccaagcaaacacacttctgcaagccatttgcataagtagacataatccatacggaatgatgcactgttcggttgtagtttcattcgtcagtgacctgcatctgcccgcccagtcttgagttcagctccatccctccctgcagttccgcagcctccggcttccccacctcagcttggctgagagtttcacgttcatccaagtgcttctttacagactcactcccagctggaggaggcagagggtaaggtacattttcgtgcactccggaaaagaaacgtattcaacaatgtccatgtagcttttgcttctctattgataattgctaatgtggtagtgagagctttgtttgtaggaagagttaatatcttttctaaaagggttttttgacagatggacattcttcagttttgctgtcttatttgttaagcaaagttagaaacataagtgagaacaggcgtggctggcctctaacactgtcagggccaggactcagggcctggccacccgcacaccgacagtggccagttattgccatcaccgtgcctgacccagagggtttggttgcccttcttttctgctgcttccacagaaaacaaattgattgtggcttaatcagatgagatgggaatgactggcaggtggggagaagaaaggaaaggccgagtgaggatggccatccatcgaggccacttccctgctctttgccattgaagcccatgctcctggaaccccgtgtgtgttcagaatgtgcaagcagaagaagaagagggagcggaaagcactgggcatcagggctttccaggggaatgtcttgacctggctggcagtggaaattcacaccttcagaaacctctagagttcatcgtggccaatcctgggacatggacttaggaatgcccaaccccgccacccagccgtggcaacccgattcaaaaccaaatgcaccaaatgtgaactcgaag

SEQ ID NO: 23490 - DNA, 1033 bp, Homo sapiens
taggaatgatgagaaggaaatcattactttaattctgtgatatagcatgctagacacagttgacatgggcttggatttatctttgatttttatttttgctgtggattggaggtaaaaaaatgtaggtggattttggtgataacatcacaggttaaaatatcactgcagttgaagatgctgatggaaaatgatttatgaacttgattgacttacaggttatctggcataaactcaaatattggtagttgtcttcttgaactagatcttttggtattttgttagtctctgattagtatgttgttttacaaatgtgaactattaaatccctgtggactcttccctaaggatgagttgaagaaaaaaaaaatcctagtgttgcctgtgccctctaacatgtttaatttgtattgttactctcagtggatgaggaaactgatccaaggctgggataatttgctgattgcagctagtactagtagtgctaagaatgttttttttttaactcggtcttgttctgaaaaccactagaacacagtgttgggagtctggtaatgtgttattgtgtcgagctgtggtatgtggaaaggtaggtgccagcttttctagaacttgaattctatggcttagtactttgaaaaacttttaaaggcagagtggcataagaatttaggatttttttcccctaaatcatgacacttaaagagggttttggaaactcagttctgagaacctcagttaggaaatgagtataagaacagtcccagaggactgtccctcaaatccatagctttagtttccctcagtacaaacctctgttttccaaattttctcagacaatggcttcagtgtttctagtgggacctagtctgtacattgaaagccttcacactaagcctagctggtaggtcatagtgattctaccacttttccaatccggcttcctgctttcagatttattttccctattcagtagagctatctttatctaactcaggttaaatgctgaaattgatagtttttgggtatagcaggg

SEQ ID NO: 23491 - DNA, 1033 bp, Homo sapiens
ctgcctcagcctctggagtagctgggactacaggcatgcgccaccacaactggctaattttttatttttagtagcgatggggcttcaccatgttggccaggatggcctcgatctcttgacctcgtgatccgcccgcctcagcctcccagagtgctgggaccacgggcctgagccaccacacccagctggctgcaccatttcacattgccccctgtttcccctcatgccagcatttggtgttgggattttgttttagccaccttgatagacaagtcgtgatagttcactgtgggttttgtttgcatttctctaatggctaatggcgttgaacatcttttcatgtgcttatttgccgactgtatatcctctttagtgaaatgtctcttcatgtttttgcccatttgctacttgggcagtttgttattttcctgttaagttcggagagttctttctatattcccgacactctcctttgctggatttgtggctgacagatgcttcctcccatcctgtagcttgtctttgcattttcttcacggggtcttctgcagagcaaaaggttttaattttggtgaagttccattgatcagttattgctcttatagattgtactttgatgttagaatatcaaagaatgatttgcctagccttagatcctgaagatttttcttccattttttctaaaagttttgtaagtttacattttacattgaagcccatgatctattttgagatagtttttgtatgaggtgtggggcttatattggggttcatcttttttgcctatggacgtcctgttgctccacaccgttcatggcacatgctgtcttccctccactgaatcgcttttgtacttttgtgagaaagcagttgagtgtatcggtgtagatctagtttcgggttctctgttctgttccattgtataatgtcttagaattgggtagattgattcctcctattttattcttttttttttttctttttttttttttttcttttttttttttattttttattttttatttttattttt

SEQ ID NO: 23492 - DNA, 1080 bp, Homo sapiens
ggcctcccaaagtgccaggatcacaggcatgagccactgcacctggccaaccagtttttaaaaatcagattagagacaggcagatggatgcaggtggaggttggtcagaagctatcatgacaaacttgtccttactgctttatctttaggaggagaggagacgagggtgagtagtcatgctggttagtgagtctcgctctggggttttgaagcctgagcaaggtgtggtaaagacacactggcgtgccagcacatcccagcttggacatgtcacttgattctcgtagctgtgtcttcacctctagagtggacatagtgcccgccccatgtagggggagaggtgaaattattatgcaaataagtgaatgccgtgtacaaactccaggagctttcttaagcagtatgagaagagctggcagacctgcttagtgttaattctttacgagtactgatggagcacccgccttcttcctggtgctctgggggaccgagggttgggtgagatggagctgtgtcttctcagagttttcagccagtgggagaaagagcagactgctgtcatgtaggcggtgtgaaatgctttatgaaggaaacattcttccgccctcatctcagccacaatcactattggcctggaccgtggcatgggtggtcaggttatccccatgagctccaggcatgaagtccctgggctgcctactgcctcgggctcgtggctcgctctgcccaaccacctggcttcccgtcatcccctccagcccttcccccttgtctgtgcacctgctgaccctgtcctcagaacacttcttactctgtgcctggctacccctgctcagcagcttagcctgagaaccacccctcagaggggcttttcggatcttgccgtctaaattatggctcctttgttgaggttattgcctcattttattcttgcgtccggtgttgctaatgagaattcttatgtccatctgattctcattcacaggtatgcagtctttaaacctgtttttccctcctgggtagctgacagcattttctctttattcttggtgttctgtgatgttgctctgacatgtctga

SEQ ID NO: 23493 - DNA, 1035 bp, Homo sapiens
cccgctccccgtggtgccgcgcgccgcttccgagcatcccgggaacaggcgcatctgtgcacacacgcggattttttaaaaataacatatttctagacatgcctcctctccccccacccccatctttgcaaagcagcccggagggcggggtggaggggcggggcctccgagttaataaaggaagatgggcggagccggcccccagccattggctagctgggggagtgatgtcacccatatgacaccctgataactagttgagagagagacctcaactttttgcagaaggagcgcgcgcgcctgggagagctcggggtccggcgcttgcggtaggagccacgagccggagagaggggtcccgggctgcctcgaccgccgtcgccaccgcctctcctgtcgcgaccgcagctcccaccgcgccggcggccgtcgtcgccgaagccaccacagccgctgtgtgcagcctggaagggggggcgggggggagggggggagccgcgaaagcggggtgccgaggactttgcaacttgcccaggaaggtggaggggtgggagggggagggggacctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccaga

SEQ ID NO: 23494 - DNA, 1930 bp, Homo sapiens
aaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaatttaattttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtgg

SEQ ID NO: 23495 - DNA, 1031 bp, Homo sapiens
ggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagcta

SEQ ID NO: 23496 - DNA, 1051 bp, Homo sapiens
tgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttcacttgtggtttttatgtgacttttttctagttttgcatttgataactgctgtttaattctgaaaatgttgtctcaaaccagatgtcagggacaggcttgaagattcctgatgtctcagcacccagcacggctgtcagcctcggcaggaggaagaccacggaaagtgagttttctgggcaggttggagagctgctgacagtgagaatgagcatggtgattacatctcaatatattaaactggctgatagagggaataaaaccacagacaaagtgtagaggggtagattaacatgttttgtcagaaatgtctgaagta

SEQ ID NO: 23497 - DNA, 1093 bp, Homo sapiens
gggacagaaagcaaagtggagtgattgaaggacacagtccagtaactcagcagcctgccgtgccagagacagaacagacacacggacaagggcaagccttccttgctttcctccccgacacccaggtgaccacccagtttgggaggaaaacagaatattgcattttaggtagagcagctgattaaagttctcgggccagatgtcttagtgattcatggtgctctcagcatagaccttgagcaataacccatgtggcccactttttcgttcttggtggagcgctggctccttctgggagttacaaatgttgggctgtgactagcaccttgagctaactcagtagcctctctcctatgtcacggtgggagtgtgtgggacgttgaggtacaaagctgaagaaggttcagtgttcatgattctgggggactgtccacgtgaccgtaatctatttcccagagggtcccaggctggctgccttcccaatcagacagttgcttctgtgcatcccgcaggaggaggcagaggaggacatgggcctggtgtctcacctgcaaggtggcagtggggtaggctgtgcagagatcaaggttgggagtgggccctgctgaaaggagcttggacactattccaaagcttctcttttacccaatggctccctaaaagcttctcttttacccagtgactccctaaatggtgcattagatcatcttgcaggtgcagcgtgggcgtccagttactgctctccggggcttgctcccctgatcactctcttactgccctcagagcacagaacacgtgatgctcctggcgaagcacctcattgactcattccaaataaactccctcagtgagaggacagggcctctgcatccctgtggccaagtcacagcactgggggtgaggctggtgatctgatacatcagaagcgccctggcttgtctgcaactccagggagttctgatctcagggtctcatgaagccttgtaactttcacaacttgttctctcagtgggacattggggtatggccaggagtcagagactttaaaaaggaagcagagggattgaaaggcgggatggaagtgaaagtggag

SEQ ID NO: 23498 - DNA, 1051 bp, Homo sapiens
tgatcgttgaagggagatgacaagatcattttgataattttaaaagatggatgaataaggggactgtcctcagcactgagaagcagaggtcaaggatgaagtcgtacttggactagaattaggctaagttataagtggtgatttgatgcatgagatccacctttctatgtttgagatattggaggacatcttttctgaatcgtgccttgttccacagagagagactgagacctgaacagacaggaacataggtaacatcaggagtcctcaggtaacatgaacactaaatacctgaaaatgtatgtttgatttttacccttacgggccaagcaaggagtctctgggttgaaatgtttgtgtccgtttggaggtaggtgaatctccaatgatttggggggcatgaaagttaatatgcaacacattctgatccgatttaccttctgtgttggctccatcctgttccttaatggactgatgaacctctctcagtatcatgtcactttctgagctcgtagacattccttgtcacacaattaaattcctcgtgacttggttttctaagttaaaccaccttttcttgcctccttcttcttctcagaatgaatctgtgtaattggatgtgtgaggtatgcttagttgccatttacctaagtctgtttccaaaaatgaccgaacaaaagactattacaagagaagaggcccaaacaaaccctgtagttttaacaaatttccttttctcctcccttcttatctctctcactctcttttccactttcttctctcctctgtctttagctagttaattacatatctagagttaaaactcagggtttccgagtcatgtgtccttggtgtgcagtcattgggtgaggagctggggacgtcaaaaatgaatttaacgtagtccctcctctcaggcagctgcaaactagaagcaggcgtgggacacactgtatgcccaggagtggctttgcatttgagagccatccttctggcagctgtgcagggaatgggtcgacctggccttgcattttcctcactcccctcctgg

SEQ ID NO: 23499 - DNA, 1049 bp, Homo sapiens
atattacgcattgcctctcaaaagtgttagttcattgtatgttaccattagccatgtttattgctttctctaagactataaccaagttattacaattttttaaatgttcagttgattttataggtggaaaataagccctgtcgttctccacatgagtaaagcaggatgcagagagcttaggagatgtgccaagatcccagggctggcaggaggcaggcccagggctggaagccaggcctccttgttcccaggaagggaaagttgcgtatgccttttgagttaatgacacgaaagcacagacaactggacatggttcttttgaacatcgtaacatcaattcattgggatcaaatcaacactgagcatcagtattcagtgtttaatgcacattttaatttcactgcagagaggatcgcacctcattactagcggttattgagtcactactcagtaaatatttactttctacgtgtagtacattataccaaatagttgatattatatgggcataaaatgatctctgttactgggaaacttctggtgcaggagaagcggtaaaccttttattgctgttacaggagctttctcccaggcagcgagctttagagtgtccattaaactttactgaccaattttttatggagcacttcctctatgcttgcactgttataaattcttgggatagaatagtgaacccagcaaataaaaactactgccctcattggggtgtctattctggagagacaaaaagaacataaaggagagaaataagttacacagtagacagtattaagcctattgttttaaggagaaaatgaaagcatagatggtagtgagtgtcggggggagctgttggggagtttgcctttaagatacatcaccctggagtcactggaagtttccatctgggagacgtcttgtgaaatagtgtccttggtgggtatgtggtcagcttggggaacccatagaactgcatcacagcctcactcctcatcctcaacaggggctagtagaccaggagaggagaggaggtgtgggcaccctcgtga

SEQ ID NO: 23500 - DNA, 1073 bp, Homo sapiens
tcatcaggcctagttctttctcattttgcttctaagtttgggtttagaactgcaggaataaaaacagagtttgggcagctctccctaaatgtcttctgaagaacacttatctcaagagatggactcagaaatgatttgtgtggttcagtgggtttgctaatgacggacaccgcatccttgtccacatcccccactaccaaggcatcccaggtgcccaagagcaggaggaatgtaccaagacatccacagccagagacatactgtcacttacctgtgttccttcaatgtatttcagtgtgaaagggactggcctagcaattgctaatatggcactcccctgaagcaggttctccggggctttccttgcttgcagggtgcctggtggattcttcgtgattctctggaggtcacaagagcctgtgcacatgttccaggtgctgtgctaggccttgggagcttggggatgatgagagctaccagatatcttaaattgttccatttggattagtgtgaagtctaactttagaaggtcaaatgtaaagctgaacatttgtgtgcaaaatagtgacatgtaagtctaaccaacaagttctgtgctggagcactggccagagagaaaggattgtggacacgtattttgaaatcaggctgccgttacccaccatgagggccaatcccgtgttcgttttgtcaatcagagatgcaacctgtgtgtagagtgacctgggaaattccttatgggctgaaatctaaaatgtagaagatgttttaacttaaaatgggacatattagagctatttaggtctgtcttatacttgtggcatttgacagttacactgagaatgttaatatggtgttactgctggcagagttgtttccattcagacagctgctagaagtagagatgatactcttatcccaaaggtgggaacatgtgaagctcaaagggaggtgctgtggtcccatcccaagacacaggtccctagttatctgggaaggtagaaatgtctacatttctattagttcttaaaaaaaacagtctaatgaaagttattttttaatgatgacaagat

SEQ ID NO: 23501 - DNA, 1102 bp, Homo sapiens
gtattttcttttgtttgtatacatatatctctaaatttagatatgtgttgatgttgctgtaattttttaaaaatttttcctaactcaaagtggctgattcacagtgttctggttaattttttttttctggagtttctgtttctttgttttttggtttttgttttgttttttcatttaataccaagaaaactcagtctgtgaagtggagccgatgcttccagcatagccagtgctcctgggtctcccgtgggatccgtttgtgcagagtcctcacggcgtttctcccacagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgtgagtacggccttcagcttcaccttgcggcatttagctttgaggtttagatttggaatgagaaaaatagaccagctgtttcctaaagagcttggtgcctactcctgtgtaacagtgaagcaacaccgtttggtgtttctcctgggtttgtgaaaacattaactcatgagcgccatggggacagaagcctttgtgactcgtatagtcctggggtctaaacacttcatgcaggttcaggatccagcctgggatttaaaggggttttagcatcttaggttttgtctaagcggggactgtcattgtcagtttgggctgctgtgacataatatcatagatgaggcaggttaaatgacagacatttattcctcatggttctgggggctggaaatccaaaatcagggtacaccagatttggctccggggttcctgatcaggactccttcctggtgttcaggatagtgaggacagacagaagtgggggctggggggctgttgggcttggggccagtcttaagacttcattgacactcacatcatctacagggcgggaaaacgtgcaagccctttgctctctggcagaatggaagttctggtctcatacggcagccttctcctaagtatgctctgcttcagtgtttctcaaacacaccctaccgtgtgtgcc

SEQ ID NO: 23502 - DNA, 1060 bp, Homo sapiens
aaaaaaaaaaaaagttcacaaaagtgcggtgagacttggagcgatagtgtttggggaaacagagcagccaggagtgtcaagctgtagcaagcgacagcgtgcagccgtttgagtggacgcccaccctccttaggagccccagctttgctcggactcatctctgtctgccttttggaaatgagtccgtgtaaagagctcgcttctgccacctcctgcctagttttcaggcttccggcatctcccctgccctgtccttcctccgggctgctacggcactgagcgtgctcccaagtgcagtgctgtgaaggacacctggtagcaccaggtgcctttgtggcacgtgcacctgccaggctgtgggaaactcataagatcgcaaggcagggtgagacattagaagccaagaattatttcttgataattcaacaagctggaatattcaagaaaaatagtatgaaatgagtggcacctgaatcagaccataaaagtcctaaatactggatgttgcagaaagtgctttgaaggaggagaggacagtgtgagcggaggcacagaatgggacactctggggccggctggggagccttcgggagtgcagctgatgggaagttaggggcagagtcgtgattggccttggagagggtgtggtgtcttgctgtagacttaagtctgtatggcactagggagccagagaaggttttagagcagcagaataaaatgctcagacggggcataacctgaagacttctgctgagcctcttggtcctccacatttggcctcccttgtcatcttcatctctgcaaagcagaatctgccagccttgtggcctcagaggagcccgctcaggatggcctgctgttctgccttctccactcctgtgtctctctcttgccctgttttgttccttctccctgtcaagctatatccctcccatccatttttaaggctttgctccagctcctgcttctcccgttacgtgtctctaaagagcccaggccacagcacgtgctgagcagcgtctttggaatcttacttgactgcagcccacagggagacatg

SEQ ID NO: 23503 - DNA, 1169 bp, Homo sapiens
atggctctcttggatggtataagaataatagatgaggaagctactattcacctttcatgcaggagagaggttccattcatcatgtggagattggagttaagatcttacaatgcctaacaatcctggaattatcaaattctagttgctgtgcatcaaattgaatacattttagatagccataccatcatcataattgcttggagtgaatagataaaaattgaaaaaaatcttggtatattttctcatagaaatctgcccagggatcaaatgttaagcagagatttattagtggacacaatgtagtcagcaaagaggcagtagtattttgagaagcttcctggaggaagaggaactggaactaggtgttgaagggatgttcaggtttaaacgatggagtagaagtgaagaagttaatgaatatagcacttctgacatgtgccaggtgcttaatgtcatttaatcctcacaacatgaaagaggcaaagataactatcttctttttaatgtaagtactgacagtgtgccaggcaacagataagtcaatatgatacctgagatagctgccagggtaacacagagctcactctgaggacctagggacagctccaagagctgagacatgaacaaaaagtaggaattagatcagaaatgaagaaagagaaggaaagtaatgatcgagaaaagggtgccccaagccacgagggtaacatgagctatggcagtcggttgtgaaaccacaggaagtgtatgggggaactgaaaaaaaaaaaaaaaaaagtaattatcagaatgtttttagcttcttattctggaaaaaaaattgtttaaacatagaaatatctagaatagtatagaaaacttctacaaattgaacatcataactatcatcaaattgtggccatcaactctccatctatatccattcattttctagtccttatattctaaggcaaatatcagatatctatgattaatttctaaatatttctctaggtgtttctaaaggataaaaactttttattaaacatagctctaataatatcccatctaaaagagttaacaattttttatatcacatgtctctggttagtgtctaaatctcctctattatgtcagagatttttatattggttggttttcatcagaatccaataaaggtgaatatattg

SEQ ID NO: 23504 - DNA, 1035 bp, Homo sapiens
attcccgacgtccaggcaaaagaggaacatggcactctgacaactcaccccaaactcatttgtgtaaatatttttactgcacagttttatgtctccgagttggtttctgacttccaatgtcagcacagagctctcatgggagcctagcattcccaccaggcttcagctgaatatttatgaatgttccatagtagatattttctattgttcctggaagacttttattatttagagagcaattaatcatattctgagggaaaatggaggagccaagtcacatggcaagggtgatgatgttttttttaattccaagatgagcaaaataatctcagctaaggctttctcaaagatttgcttatttcccgtgtctatctgcacacatttctacgggccatgtttccatcacaagcagccagcttaaaaatagggcttaggcaagtcttctgctgtcagaattgcacaccactctttagggcctatgatttaggctgaatgctgaggcctagaactacatcttacatttactttggtaacgatggcattgctttttaaattactcaacacaagaatgagaaatagtttttagaggataatataaggagggatgaatactttgttgagtgcttattatgttctttagatatattatatgatagacattacctataatatattgtatgtattgtaaataatatatgagagcatttttcccattttactctgatacacagaaaagaggtaagagatgatgtgtgagtttgttattgataagtaactcatcattccaaaatccagttgcttaaaacactgagcatttgttattgtccctgagttgagtggtgacctgggcagttctaatctcagcagagataactcagccacctgtgaccagctcggggtgggctgggaacctggttctgctgattgaggctgggcgctcactgtgtcttgagctttggctggaacaattggactaatttggctctgtttcatgcagtttctaattaggtttggcaggaattgtcttcagtgcag

SEQ ID NO: 23505 - DNA, 1043 bp, Homo sapiens
ttcatttgatgggataagctgccttgaaactcctttacatgtggtaatctgcccctacatcctaataaaaagttcactgtataatcgttttaaaaaggcaaacgtgtggggacaatttacctcccagaaggctgtcaccctgtgacttgccatatggacctaggctttatacatcaagatccactgctatttaatgagttactgcctgatcagtattccagaatgttcaatacagtaattccaagaaaaataaagcttatttttttcctgcatttctatttttaaaatctcattgtttttattcttctacccatccatgtttgtattttttctcatttcattattatttttttccttttctgatggaactcatgacatctatgtgccatatttacaatgccaaaaacattacctcctttatttatcaagtgatacctatcgcatgaccagcatctgttttggctctgtagagagtagacttgaatgtaaagcattttccctgtgtgagatgttctgaaggtggcagagcaagactgctgcccttgcccgctacttgcaatgctgaagaaccttaagcatacttaagcagcacgtgctcttcatttcaagttcagatgtgtcacctcccaactaacaatatgtaaaactacattacaaggtatgaaatactttattttccttagaagttctaatgtgataacaatagcaagcatttatcatgagcttaatttataacaggtactatgtgataagagctttttatcttatctgaactttttatagataggaaatcttatccccttttacagaacaggaaacaggaccacaaataatttgtgtgacttacccaaagtcatactactcatgaatgaaacaactaaaatttgaattccaaaactgcttcataagaattatgcttcaattgtggcaaaatgaaacaaaatgagaaactcaaatgaacaagccacatgtggggttgaagttcagttccatccttaggtcagtgaccctgaaccagtgtacatttctaagttgactgtcag

SEQ ID NO: 23506 - DNA, 1035 bp, Homo sapiens
ggctgaggcaggagaatggcgtgaacctgggaggcggagcttgcagtgagctgagattgtgccactgcactccagcctgggcgacagagcgagactccgtctcggaaaaaaaaaaaaaaagaaagaaaaaagaaagaaataataataataataataataataataataataaggcatttcccccaaattctctgccaaccaaataaaaaaatggttggagttcagggagaattcaataaatcaaatgctagttcccctgtggctctttcctctttctgtcaaagaataacaatacagatgttgcttttgatagctctgaaataaattttcttgtttgtggtaaataagctcatctcaagaataggtcaaactccttgtgttaggttaggcaggagcattggtccaaaaaaaaaaaggaaagaagctgaattactatttttataattttgtctacagtgagtcccttcctacaaaagtggaactaaaatgttaccatgtgacaacttctggaattctccccacaggcaacaaagctgtcttttgatctttccttcttttctgccaagtttttgcagagtcatggtttgcattacctttgtctcagccttagtcattcttggtgtaaatgttattatacaatcccagcagattattgtcctgccagggccctcattccagagcactggctcgtatgctgatggtgttcaagtgcacctggagcttttttgtgcaaggtgctgagctcctcggcctctgattcttcagtttcctccagctgtagatagcgggctggggagcagtgccgactagaacaagtatcccacaccctcccttgatgcgatctccatcacctgcctatggggatgcacattcctcccactccctggttaaaaactagcactttgctttgcacacaggtcactgtgggctgccccgagctttcagagaacacaccccgttctggcaagtgtggtgcatcaggaatgtgcgtaggggttgctgctgacttctgctgcctttcagcctgcttgaata

SEQ ID NO: 23507 - DNA, 1031 bp, Homo sapiens
cttaccttttccctggttctaaggcaccagagaaacaaaagttgaaggtgagcaaggagcataaagtagaatttttaaaaagtatattctagagcaaagaaatccagggagagaccccagttcttgattctactcttcatcctgaggccatagcctccatttgtggttttcttctgttaccctttccaggttccccttgcatttaggcaacactttagccatcattttctgggtagggatcccaatcctcctccctgtcccgaatatggcagctcttttcctcccatatttagttgtgtaggttgtgcactgcaaaaatcttgagggcacctccactgtctgtggagctgcagtaactgctcatgccccttctccactgagtagccctccattccccaaattgtctgcatgtttgctgagtttcctgttgttcaacagcaaccttctttcccccggattaggggatcaattagtgcagccaatagcatgaactctattcacatcagcctaacctccaggggcttaaagagccccagttggccttgtggctgtctcagggttcaatttgatgacacagttcttgtgtcccctgccagagaggttcctcccttggttgaaaactcttcaacatggaccagaatcctggagatgagaaacaaacatgtagagatgggtcattcgacataatgaggggtgctacaaccctgagccctgcatattgtgccaatgaggagaaatcccataaaattcagaggaaaaatccggttacttgtagaaaactggccacaatagccaatacacagagttataacacagagtgatcagggccatggaagaatctagagcgggggttctatgtaatcagacatgagattttacaaatagatctgtgggcatgagagactggcaggtccaatgggcagaggaagcgaggtcttgaaggtagagtgagaaggggtcaggcagggagcagctttctcagcagggaagagcctgtgctggggcatgaggaactacgtgtggccaccggg

SEQ ID NO: 23508 - DNA, 1032 bp, Homo sapiens
tatataccacattttctctatctactcattgactggacatttggtatggttctatattttcgtgattgcaaactgtgctgctatcaacttgcatgtgcaagtatctttttcttttatatatatatatttattatactttaagttctagggtacctttgcacaacatgcaggtttgttacatatgtatacatgtgccatgctggtgtgctgcacccattaactcatcatttacattaggtatatctcctaatgctatccctcccccctccccccaccccacaacaggccccggtgtgtgatgttccccttcctgtgtccaagcattctcattgttcaattcccacctatgagtgagaacatgcggtgtttggttttttgtccttgtgatagtttgctgagaatgatggtttccagcttcacccatgtcccttgcgtcttcctttggccctatgattctgtgtacagtagaatctttattacttactgaaaacaagtaaatttttgagctggctcatattctgtgaacttttgttatttttttcctcttaaaattagttcccttttaatctgtaatcttgttttgaagaatttttttttctagtattagtaggtactcttaacatttttaacacatgtacttgatgttttctaataaaatttagagccaacaaatctctttttcatttttatatacagtgttaatatctttgcatgttttaacttccctcccaattctatctcccatcctctataatattgttgcctagaattttagttatatcttatttaaataagaaataaacttatagtatttactataaactctttggcttcttggttttttttctctactttatggaaaacatacgttaatagttcttgtttttcataaagatttgcagattatgaatacttccagtatgtgtgtgtttaaaaatgctaccgttctaatctttacctgaaataagaggtaagctggatataaaatcctaagttgaaaattgtttcccttctgtactttaagtataatag

SEQ ID NO: 23509 - DNA, 1050 bp, Homo sapiens
tcattagcaatgccattaactgtcctttttttcccccagcagagaggaaaagaacacctttataaaacaaaacattcataactaatgaaatcacaactgaaggacatacaccattaattacttagtgatcccagatgaatgaaggaaagcatttgctcttcagttgtgtgtaaaattaaagggagaatataccaggtgcttggggatgtgcagataaccttaaataaatacatccttaataaatctcatgatcaacttcacaggcaccttcccaggatctgagccgagcctctctcagggcttttggagtgaaactagaacatgagctcctctaccaggtgtggcttcgtcagagattattattgatcattcatttttatctcttggcataaaatacacatgaagaatggggacttgaatgtatgagtgaatgctctgtaacaggatgtgtttattcatttctttttcaatttacatgcaacaaaattcactctctgtgctgttccactttataagttttgacaaatgaatgaatgaccacgatcaaaatacagaaacgttccatcatggccccaaattcctttgggctggctctttgtcattaactccttctcccattcccaaactgattttcaccactctgcatttgtgccttttgtagattcttacgtaagtggaataatatagtctatagcctctttacttttttcacttagcaaaatgcatttgacaatcagccctttttattgctgagtaataatctatgaatgtactatagctttttattcatttacccatagaaagatatttggttttctcccgattttttttttccaattagagataaggctgctgtcaacattcacttcccggtttttgtgtgaacataagatttcatttctcttgggtaaatgcctgggagtgggattgatgggctatatagcaagcctgtgtctatgttttaaaaaattgccaaacaatttttaaagtggctctacaattttgcatttaccccagcaggcacagtgtataaaaatttcagttttttca

SEQ ID NO: 23510 - DNA, 1061 bp, Homo sapiens
ggaggaagtcacttttcagcaaaatcctgaatgtaaatacaatttccatggctgaaagttgggtagaagaaaaataaaaataagacacttgatcttagctaaaagtctgagaataaatgaaaaataaaaataataaaaggaaacttttattgatgctttattatgtcccagactgtgcaaagcacttaacaagcattattttacttaattgtcctcatagtcgtaggaggtacatactattccaatggatgaaaaaagagagtcagaagacagtgagagattcctaattagaatcactcaacaacaaaatgagcagcttttagaaatagtgagtttccactttttgtaagtagtcagactgtggttaaataactcagaaccaaaatagattgaaacgctgagtaggggatcgcacttcatcggatgtttctaagggctcttccaaccctgaaatattctgatattgaaaatgtatcctagaagatttatatagcaggacatttattatgataatatacttggatgatgactaatattgttataatgtgctaagatctgattaatctgagtaataataacatgttttggcaacaaaataagaatgcagaatgtctaaacatttgttatatcaaccaataaatttctatctcctgaggacagaggattgtaatgattttgacccagggagcccatatggttataatgagctcctattcattatgtatatattcagaaaaaatatttattgatcgatagcacaatcatttggattttaatagtagcaataataatagcaataatgtcctatattcagttgtccaaacttgtcacagcagtaagattttcatgtttctttttctcttatcatatactcactaaacattaaactaaattcaagggtcaagtctaaattctccatattaaaaatccaagtgtattaatcagggttctctagagggacaagactaataggatagatgtatatatgaaggggagtttactaggagacttgactcacacaatcatgaggtttacacccacaataggccgtctgcaagctg

SEQ ID NO: 23511 - DNA, 1051 bp, Homo sapiens
gagtagtagattgatttcatcttgatattgcaggtcaatcaccccagccaacattgtaactcccttcttcgcctgttttcttagaggcaggaggagcccaaagtgtccaggtggcaatcttaacttccagtttaatagaattgttgtgtcccgggtggcagcattcctccgcctggaactaagacctctaggccagcaggacgtaatttcatgggaacaggaagcaaaaatcttgctagtggatcactaggggtgatggtgagtggtgacacttccacttccaccccttgattcctggacctgtgaatcctggctatgggagaaatagtaccatatattggacacagattcagagcatacacagccttctgaagaagtttgcctcagccctgcaaagtatcatcacctggttggcgttgtaattatgacttcaaaaggctattctgccattctatcaatccagctgcttcaggataatggggaacatggtaagaccagtgaattccataagcacgagcccactgctacacttctttagccataaagtgagtgccttggacagagacaatgctttgtggaataccatgatggtggataaagcattctgtcagtccacggatggtagtcttggcagaagcattgcgtgcaggataggcaaacccatatgcggagtaagtgtctattccagtgagaacaaacctctgcccgttccatgttggaagagatccaatataatcaaccctccaccaagtagctggctgatcaccccaagaaatgatgcagtatcgagggctgggtgttgaactctgctgctggcaaactggggactcggcagtggcatagccaggtcagccttggtgagtgggagtctgtgttgctgagaccatgaataactttcatcactgccacaatggccactttgttcatgggcccattgagcagtgacaggggtggcttgggaaggatcctgagtggtgtccatagaatgagtctttctgtccagttgattattaaaatcctcctctgctgaggccatgtgttggtgaggact

SEQ ID NO: 23512 - DNA, 1096 bp, Homo sapiens
tgtgggatcccagacttccctatctgttaactaaagggctgttttcaatcaaataattgttacgagaagcagactggcgcctgtagcactgctgttggagatccaaataggagattgggttgggaagtttttcccttgagtctctgctattttaatgtttaatttgcgctgtcgaggcgagtgtgtgtgttgcatctggacgccagggtttgcccaatctttgagtgtttggttaaatgttcaaactgtggcttcctcccggcgccagtcgcccgcctctgcccttaggttacattctcttaaacatgcctttctcccccactctttcgcaggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaa

SEQ ID NO: 23513 - DNA, 1041 bp, Homo sapiens
tcatattttttttttttttttttttctgagacagggtctggctctgttgcccaggcttgagtgcagtggtgtgatcttggctcaccacagccttgacctcctgggctcaagcgatcctcctgcctcagcctcctgtgtagctgggactacaggtgtgccccaccatgcctgtttaatttttttttttttttttttttttttgagacggtgtctcactctgtcacccaggctggactgcagtggtgccatctcagctcactgcaatctctgcctcccaggttcaagtgattcttgtgcctcagcctcctgagtagctgggattacaggtgccaaccaccacacccagctaatttttgtatttttagtagagacggggttttgccatgttgggcaggctggtctcgaactcctgacctcaagtgatccacccaccttggcctcccaaagtgctgggattgcaagtgtgagccaccatgcccggtccctgattaatttttgtatttttttgtagagaaggtttcaccatgtcatggctggtcttgaactcctggactcaagtgatcctcctgccttgccctcccaaagtgctggtattataggcgtgaaccaccgtgcccagcctcccccttgtcttttctaacatttatggggcacttattatgtgccagatatgctttaaattctttacatatatcaattattaactcatttagttattatcaaaatgctataggggccagcaaaattaggccacggtaccaagttcatggagcttggaggtgatgaagccaggattcattcaaatcaagcattttgacaccagagtctgctatttcttttagcagccaacagcctctgtagagcccgtgcccaccaaggcccttggtgttgcagcctctgtggccagcatgccctcccttgctgttagtgttagaaagttgcagctattgcattgctcgagtgggtgcttctggcaaatccttgttgcttctcgtttcctgtttgcctcatctgtcctccttgctgcagaaattgttcttc

SEQ ID NO: 23514 - DNA, 1035 bp, Homo sapiens
aggagtaaacccatttgggagctgatagttgatgtatttttgttatgcttggcagagtgagcggcccccatcttcctgagcagagttcatgtgtgatatacaaatgaatggtctctttccatctggccgtcacagaggcaagaaactgtggtgcctctggatcattgaatttctcagactctcaagggacagcagaatgcgtatgtgaactggcatacccaaatgcaaattatttctggtgatacctaatatatgtaaatgtatgctgctcagttggccaagaaattatgaacggcactcttcctaaataatgctatataactgaaattttagttttattgtcacaatagtgaagtgtgttgatagtcctatttcctgtcaaatttctgtgacatttccagcagcttcaagcacccctcacgggccaactccccagaggtggaagatccggtatctcaggagggagtgctgccgggctccattccgaaagccacacctgccttgttaccacgtagggatctggcagttgaaggctaggggcggaaagtggacaatcaggatagagacaggactcggcagagaagcggagttttagtacagatgtactaaacatctgtacagatgtggagccccccccgcatcatcacacttaacttcaggaacaaagaaacccaacagatttaaagatagtagggcatacctgcagggctggtggcggggcaggtggccggtgctgcttccatggtggacttcgcagttgccctggggatgctgacccctggactggactttgctcagtggtgcccgccacagtgagcctcagccccacctctgttgtcttcaccctttgacctcacttgagcctggactgagggatttcccctgtcgatgaaccaacctgagtactgtgcatccagcctctcactgagctgggaaccaggggcagctacaaaggagacaggagaaatagccgtcccccttgggcactgctggcctggcaggagaggcccagcatgtgtctagggaggagcggag

SEQ ID NO: 23515 - DNA, 1049 bp, Homo sapiens
aaactgacaggcaactacagcttagattgcagggagtgagacatgctgttgccggagctctggtgtcattggttcatagaaagcttgtttctctggccatggggacttgattcttagagggtaatggttcgaaagttgaattagtgagtgtaaatccttaaaaaagtaaaaatatgtttgtgcccttgtacagaggggctgccttgcccttctggaagaaggaattccacgttagacgtgttcccagctgcagttttgttctgtatctattgccagcaggaatccaaggatttcctttattatttccaaattgctgcctcttaggaatggagaatgctgccagtctgtgctctgtgttttttttgctcagtgggaccaaagtagttttgtggtagagagatacagagatacggctttgagacagtttgagtcatctaattactgtccaggagggctgggaggttaaccctggtggttgctttggtgatagtgatcgatgtctgtgtgacaattataatgaaggctggtattatgccgggactttgaagagtctatcagatagtgaaggaattgcgaagccgtactatgttgaggtctccagaataaacatcctcagaatggaaggtccagatgagaaggttaccttgatgagaggcctttatgctttttgtgctattttcctttatgggctctggtagttctttagtgttttataatctcttttcagagaaagctttttgtaaattcttcagattttactttttaagtaacacttacaaaagttgtatggtggcttgggaccaatacactttgcaggaaatgcagagatggataagaaatggttcattcccttcaggacctctcgttatagcttagcctatgtagtgattagagcatctgctttgaagccagctggacctggactcagatataggttttgctaattgatacctgtgtggccatgggcaaatatgctcatttactcatttgtgtttaacaaacacttatattgcacttactgtgtgccaggcagtaagtgcttaacacat

SEQ ID NO: 23516 - DNA, 1109 bp, Homo sapiens
tctctgtcccaattcagaagagccctgaggtgaggtaaagatgttagaggtgagtggcattctgtgtctgacctgtggctccagtgtgtggatccgtgggctggcgtgtctcacatgtgtggactggggtttccctcttccacagggaggtggtcagtgtgtgggaggagccatggctctggcctccgactgctggggtttgaatttagggtgagcacttactaacactgttagctgacccgctacctactgatcttcacacggatgagcttattgatggtgcacacagatgacaggtttagattgtatgctggttccttgtatttgttctgtttttaaaacctcagctcctctagtctttggtagacactcttatgttatatcttgggcaacttagttcctctttctggagcctcagtttccccatctgtaacaccagagagctggacttaggggaaccgcttgatatttgacaatactccaggcttttgtaaacaaattgtccacagctttgctgagctacagccacatccgcttgaaaaagcattgtcttaccagcctgtgcagaatccagatcactttcatccaccttcccatgggggctgctccatcccttgtcttactggaaatgtctttctcaagggtcttttctggtgtacaggtctccctggagatggaaaaccatagcactggtttaagtacagtgttttgtttgcatggggaggagaggctgaggcaacagcctgtgagttcaggagtaataaggtgtttgtttccctttttggccagtttttttttggtggcataatttacatacaatgaaatttaccctaagagtacactttgatgaatcttacaaatgtacagttgtgtaatccccaccattatgacctaaaacaccccgaaagcttccctcttgctaacctgactgacttggtggttctggtggcttttttgtagattgcctggcatttctacatagatgattttgtcttctgtgaacgctgtttgcctccttccttcctgatctgtttgcctgctcctgctttctcttgctgtactgtgttccctgggcctcccgcagcctggaggggtagagaaagagtggc

SEQ ID NO: 23517 - DNA, 1808 bp, Homo sapiens
tgcaaatgatgaccctgcccctactctatctgcttctccgccaccctggcccttcagaagattctgaaacaaggaattggttacccagggtggttaggggggttgtgcctgtgtccctggtgaactttagattcttgtgcccctggtgaacttcaaatgctagtgtgctgggagccgtatgacagccccttggggtggcaggagctggcttgtgtggaggagagccactggcagctttcttggtgaaggggtggacagcactcttggtgtggaagtagcagcccccttgcctgtagctgggctggggttagtggaacagggtttagagaaagcaggggtaatgccgggtggttattttccccaaatgttagagaaagccagcgcttctggctctggaagtgaggctgttgggaagtgggagggggagcacagctctggaagctgccttccgtcctccctccattggctggagctctcccagcatttcatcggttcaaagccaaacacatgattttggacaagtcacttaaactctttgagtcagtttcttctcctttaagctggggaaagaggtggtgatttcacaagtggttgtaaatattgcagtaaagataatggaagtaaaagtgctctgtggagtgtaaattgctgtatggtagttggagttgggccctaggtgtgattttagagtacacacctactgctgccttggtaacttaaaagtatttatctcaaatgctagtgagctgagctgagtggcacagtaggcctttctttccctgggagcactttgggagctttggaggttgcccagtgctgcccccaacctttaacagtgtggccgagtgtaggagggagggggcagagttccttctggctggactgccacatgcaggggagaggccccgctggtggtgtcccaggtgggagaggggcagacctggggttacctcagtcagggtaggtgaggaggggatgggtggacaccccggtggccactcctactcacccctgcacttaagacctggggtttcatgccctgctcctttaaccctcagtgttcaagagagaggccagttggaccagagcgcctcaccccaccatttgccatgtgcccctccccgtggggagtcagaaacacctgagcacaccaggaaaagttttgaaaaacaatgtttttagagacagggtgttgctacgttgcccaggctggactcaaactcctgggctcaagcgatcctcctgcctcagcctcctcagtagctgggaatgataggcgcgtgccatcatgcctgtatgaagttttgaaaaatttaaatgttgatggaaaaaaaaatgtattagtggaaatgaaaggctggtataagctgtaaagtctttttgttcttagagatttttttctcattctaaacattatcagacctgaaaagtatttgtcgtaatgactgagacggtcctggggtaacagcgtcttcttaacggccactttaattggcgtagtttacacctagcctctccgagaactggaggacactggtaatcactattagatattgagtgctgactgtatggcagacacataagcattggtgatctcctgtgaggcaggtattgttattcccaatttatagatgaagaaacagaagtcagtgaggtggagtccgtttttgaggtcacgcggctagtaattggagcctggtttagaaccaagtcagtctcattccagaatccagaaccagtgatttgtaactgatgcacttgtctccaaagggatccagcactgggttttctcatttttaatgcatcca

SEQ ID NO: 23518 - DNA, 1049 bp, Homo sapiens
ttggtttgagggacaccacgaggctgcatagagtcttcagcttctctcctgctgggctttgcattcattgcccagcaccgtgaaggaggacaccacggcccagctcccctcctttgtcatctcttgaaagacccatggctcagaaagcagcgagcgagggagtaagcaggaccatggaggttgcgttcctgtttctgtcatgcagtagacagtgtgtagtgacagatgcctgcctgtggccaccagcccccttcctgaacccaatgaaactaaactgcccatgtcttgaccgctaattttgagatagtttaaaaatagtatgtggtttgaaaggacctatccttcactgttaaccacactctagaattataaatagagtaaaacagaaggaattattgatccatctgtgaaactggattttaaaaatctaaaaattagatacttttgtttgacaaggtaaactttttaacgatgaaaacaaacatcgtgtagtagagtaggagagtggactttggaatcagaaaatttgggtttgaatcccagctctgccactttctgtgtttccttggatgaattatttgatctctttgagccctaattgcctaatagtgttatgagaaataatacatgtcttacgaagtttagaaaaaatatatgtgaagtttgtgctttgaataagtgacgcctgttgctgctgttacttttgttagtgttattggttatgcgccaagtgtggtaaactgagtctctttacctgattctttcattcttcctctgaccttgagagcatctcccagcaggtttttatcctttatgtagctgacgccgcaggcccagcgtcactgtgacttaccaaggtcatacagatatttacaggtggacataggactggaacctagatcttctgagggctcctgaggagctgcgtttgcgggtgtgtgtgtgtgcacatgtatgtttctgtcagaatttgtttgctgaatctggtctcagaaattcatttaatttatctagaactctcaggctctttactggaatgttaaaaaaga

SEQ ID NO: 23519 - DNA, 2042 bp, Homo sapiens
ggctcccagaaccggccttcagctggtgtcagtgtggttgttggtggctgactgacatgtccaagcttatcctttattctagtggagaagggggcagagggcccagttttctctccacttagagcctgaaagatcagagctgttgactgccagagaagcagcattaagagcagaaaccaggtcagcgattttcctccttgttctggtgtgaaagttgccaatgtgtttttggcagctggctggttttgatctttcagtttgtgttaaacacttaggatcagcatgggctcccccttctcctttttaattaaacagcgactgtgctgccagggacgggctgggcgcatctgttcaggagggccctgtgtgagagtgcatagacgggagtgtgtgcatacgtgtgcttgtctgtgtgcatgcatatgtgtacgtgtgcatgcatgtgtgtatgatagacctcaaggcaattctgtggcccaggggatctgttcactgacaccaaaaacaaaagtggcctagatgattgtattagtctgttcttgcactgctataaagacatatctgagactgggtaacatatatataacacatatataacacacacatatataacatatgtttaattggcttacggttccacaggctgtagaggaagcatggcagcatctgctctgctcggcttctggggaggcctcaggaaacttacaatcatggcagaaggtgaagggggagccagcacttcgcatggccgtgggcaggggcaagaatgaggcgggaggtgccacacacttttaaactcacttgctacacagtaccaaggggcatgatgccaaaccagtcgtgagaacttcacccccgtgattgagtcatctcccaccaggccccagctccaacactggggactgcaattggacatgaggtttgagcggggacacagacccaaaccacatcagtgattttcctgtttagagtttccttgtatgtacctgacgggctgctctgtgtaaaagggaacaggagggcttttcgatggagacagcatctaggatggcagcatgtgcccagcctcagcttagcttagcctggcctggcaggtgtaaaccatcttgccctgtgccagcaggagtttcagtccagccgtctttaatagtgagctgagaggaagagctctggcttcactgttctagccaactccgctgctaatagttgtgtgatttggaggcaacgtggatgactcaagcctctgttgccatacctgcaaaatgggggtcacggcacatacttctcagagtaattgcaagggttgaatgggattaaagggccctgtgtcatctggtggtttattcaggccattttagtcagtaccttgtgcttctcaaaaatactttctgcctggatacccgttctttcagataagcggcctttagaaagaacagagagctgtcctttgaacctgccagtcatactcctgccccaggacctttgtgttagagtcccgttggcccagagcgcacttcccccaggtcctcatgtggctctctgccccgcctcctttgcgctctgctccaagaccaccttataaaaaggcctttctgacactatttgaaagagtctccatcccacaaatgatcatggcatctttatttgtggtatccgtagtatcccccaaactggaaacaactcaaatgtccatcagcaggtgtctggctagacggcagtgtagccatatgatggaacagtgctggccaagaaaaagaagtgaactactggtacacgcaactacatgaatgaatcgcacagtcatgcgcagtcccaaaatcatgatgcaagaagccagatgaaaaggcgtacatgcgggatgattccagataccgtatataaaattccggaaagtgcagtgttctctggcaaagaagcagatcaggggttgccagagacttgggggtaaggagctggggttgcaaaaggggcacaagaaaacatcctcttggggtgagagggtactttcccagtctggattttggtgatagcttcataggaat

SEQ ID NO: 23520 - DNA, 1056 bp, Homo sapiens
gcgtggatgtgagggtatgagttctgtagaccaagggaagcaaatttatccagctatcactgtctttaatattaggaatgttagattagatgagactaggcacccttctaaataccttccagatctcaacacctgtggttctgtggtttgctttcgaattggtgtccactcgctgtttgtttgaactccgattgactgcctcagtgcagaaactgtcatacaactaagttctagttcatgcttttacagctctgaagtcaaggggcatatttgcttcattgagagttcccctagatccaggcctcagcttaagccagtgagtggctctttccatggcagctggaaaacaggtctggtaatcctttgctgacagcataaacttcacttcgagtcacttccatagcttgagcttcctctcaaaagatgtggaggcttagttgtctttaaatttggatgggttgccccagtttttggcagatagtacggttataaccggcattactgggatgctgagaactcagcttgtcacacagcgtgtgcatatttaataggtgctttgtgtttggaggggaaaaccctctccagggaatctccacttccagaggtctcctcctgcctttagcagccatcgccgcctacatcctgcaggggtggtaggtggggctgtcttgattcacttcctcgctgccatgcagaaaaataaagtagttttccagccctccgttcagtggctgagtgttccttttctcaccttttccctatttccctgcgtgctctggaagtcagaatccagaggacccctctgtatgactgcgtctacagagaggttgcatgtggggaagtgagttcacccataccaagaaagagaattgagagatgcccttttggtttggtttggttttgacttgatttcttgtgcagctcacctgtttggccagcagctcctgagtgtgctcgtttacagtcaggaaaaaagggcacatttccaaagacttgattaagtggaagtctaagagcagagcctggcacatagctgcgaagcaggtctttaagaaa

SEQ ID NO: 23521 - DNA, 1086 bp, Homo sapiens
gcttttctaggaggatggttctgtggcaaggccggcccttctgggagctcatctaatccattgcctgcagaccgaccccactcatagcaaattcaagtcctgagccattatccgcgaaccccataggcaccctgggagggatggaaggaacagtagaattgtgaggtgacccaagtgagtcccctgagtaggatggagccagagggagtcaatgaccttccaggtccacatggcaggttagcggccagtagagccagagccctggccacaagctgcccttcactggccaccagcacctgagtgctccgatcgccccctctgtctcctcctgctcttctccctcacggctgaagctctggaagccgtccgcttatttgtagcatctttaaagagagtgtagtggaggggattcttgcttgaagtttttcctcagaggtttgcctcctgcttgtgcagtttttacacgtcagaatgcagaaattggccaggtgcggtggcccacgcctgtcatctcagtactttgggaggctgaggtgggaagatcgcttgagcctgggagattgaggctgcagcgagctgtgcactgcacgtttgcaccactccactccaacctgggcagcagagtgagactccgtctcaaaaaaaaaaaaaaaagaaaaagaaaaagatgccatggtgttgtagaaagtggtcgggccagaagtccaggaaccaagttctgctgctggctatgcttgttttttgcagcttagcctctctaggcttcagccctcacccagtcacttaccaagagttgttctaagaaccaacgtgctttcaggagtaaacaccactacagagaggtggcgtgtccactcacttttaggagcacagatgttcgttgtgtttccctaagaagagaattggtacttgtcatcattctgccatctgcaaaagctggattcccctgcccctgcttttctttattaaatataattttattttttgctttggttttagactgcttttagacagagaatatccatatatccctcccctagctttcccttctgttaacatcttaatacagttatccagtagtccgtg

SEQ ID NO: 23522 - DNA, 1035 bp, Homo sapiens
cttcagtgtaaacttatactgagtcatgtttaaaagcctccacatctttggactatgatcatagcattctttttaggtcatgcactatttagaaataagttttggttttgtaaatttaagttagttacaaccaggataattttgcttaaactctttaaaatatagttgtgtgctttatttcttggttgtatgtgtatcatttcttgttctgtgtgtatcatttgttatttgaactgtttaccccatctaacaaagtgatgtttgtttcttgcaaaatctctctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaaggtgagtgcttgtggaagaaagacaaggatggataaaaccaaatcagtcattagtagtaggaggtacgaggccgtgagtgatggctcacagctgtaatttagcactttgggagtctaaggcaggaggatcactagaactcaggagtttgagaccggcctgggcaagatagtgagaccctgtctctatcaaaataaaataaaaatcgtaggcagtgcttgtcagtgactctggctgaattcctcttgctggagtcttaccgcttctcaacaggtgtcgtttttctgcagaaaatcaaaacttcagcagctgacattctttttctgcttcaacagattttgccacttgccccaagtagccatgtgttctcagtatttataatactcatctcttttgccgtaggcataaaaagttctgaggagaaaaatattttgtattatgtatttaagtttctcttctcactcaaaccaaatcatctttttgattagtgctgcaaattctatatatgaaaatttttatatacttttctggaagcattcaataaaatctgattttatttaatttaaaaaatactgtt

SEQ ID NO: 23523 - DNA, 1051 bp, Homo sapiens
aaccttggaaccttgcactaggataatctgtcataacatagaaggttaataaaatatgtctgaactgtccttgattaagaggatgctagaaagaccagaaaagtctcttcaacaatagaattccgctgtagaatgttgacgcttacgaagacagaaggtagatgaaactagctggcaacaattgacaaattttatgttatatgttaagatgctagtggaaggctaaatctcttgtatacaaaagatagatgtttgagcatcacttaagtttgccactgataaaatgtttgatgtccagggtaaatgctatctagttgaatgtttgcaatacatgttcagacctttccgttgctgtactttgctgtttaaaaattgactatacaaatgagttactaactttttaattgtgtagctgctttattttagctgtctctataaacaaacgaatggtctctggaagattatcagaaaagtatatacatcttatagttatgtctttctttcaggtgatgtggaagaattagaaattcaagaaaaacctgctctgaaagtgttcaaaaatattactgtaatacaagaaccaggcatggtggtattagaagtaagaaaagatcatttacctaaacaatgaggggaaaaaagttttaaaaagagttcatgaacaattgtagagaaaattagtttcttcccaattagaaaaagaatattgttggaaagtatatgtgtgtgtgtgtgtgtgtgtgtgtgtgtgtgtgtgtgtgtgtggttttaaggatcagcattaagtataattaagtagctgagcattttctatgtagtcacaaaaaaacctaataataaattaagggttcttatttagtatgtgtgataaatatagtcctttcctataagtcttacctgattttgtggtactccaggatgtctttagttatatcagaaggttttacaattcttaaggtaaaaatttaattctgttaaattaaaacaaacttaggtaccactcgttaaaagagcagaattttgaagattcaaataaacaacaataaagtga

SEQ ID NO: 23524 - DNA, 1006 bp, Homo sapiens
gttgcagtgaacagagatcacaccactgcatttcagcctgggtgacagagcaatactccatctcaaaaaaaaaaattgtttttgtcttacttatcttaggtggtaaaaataaaggtgtgcagggtgggaaggaggatcttttttttttttttttttttttttaaatttatctagagatggagtctctgctctgtcgcccaggctggagtacagtggcaccatctcggctcactgcaacctctgcctcccgggttcaagcgattctcctgcctcagcctcctgagtagctgggattagaggcgtgtgccaccatgcccggctaatttttgtatttttagtagggacggggtttctccatgttggtcgggctggtctcaaactcctgacctcgtgatccgcctgtgttgacctcccaaggtgctgggattacaggcttcagccaccgtgccgggcctaggaggatcttttaaaagatcatgagtaagtagtggtacagaagttaggaacggtgacgtggggaagagggttaggtgcggagagcagaatcacgcccagggctttgggccacgcagctttcagctgtaaggcccccatccttctaagagcacagctggccttcacttcctatcttagtctgttcagttcaaatcaaatgccaccagggttgctttctcttcactatatttctgatagcccttttataaaatgaagtcttttttgtaatatagtcaactaattagaaattgatatacttttctgaaaaatgaagtttctatgcaaaaatggcacttttttaggccggttaggatgttgtgtgactacaaggtctttggtgatgtttagtgtctgagctctgccagcctgttttccatgtggcagaggagggatcacagagatgttgtcaggatgtcatctgctgttctgatgagggctctgcctagcggtgatgctgaaaaacaagaggtgctgtggtatgacagataatctccacatagctcgtgtgtgt

SEQ ID NO: 23525 - DNA, 1047 bp, Homo sapiens
acacagccgtgcgcactggttcatcatctctgatgcctctttcctgctacagcagcagaactgagtcattgcaacagcgaccctgtggtttacaaagcctagaatgccatctggccatttacagaaaaagttgccctcttctcaaggcacctctgtgaaacaatccgattcttccttgatggcatttttctcccttttcatttcttagcctcctgacacttcagtccagattctggaaacacaacttgtatttgtatctgtggtgtatgtgtgtgtgtgtgtgtgtgtgtctaaccaaccacaatttatgtgtccccattcttaaccaaaggggaaatcttatatattttcaaaatacattattttgtttttatattccataacattcttctattttacatggcacctgttttcagcatgtgtgtgtcctgttttgacacacagacctactaaggacaggtatacctgtctgattgtatagttctgtgtttaatatgatctcgtgtctgatgagtttgtctaaatattaatgcaggaatttgcaaatatatatatacatatatatacacacgtaaactttggaaagtttcttttgatagtttcatagcctagatatttattttgtaatatattttgtgagattgtttttacatgtcaattaagtgcttattttagtaattaatgaaactaatgattataattaaagtataaaattctgttatatagttttcttggctagcacctggttagttttttgtttttgtgtttttttaatatttttatttttattttactttattttattttttgagacagggtctcactgtgtcgcagacttgagtacagtggtgcaatctcagctcactgcagcctcgacctcctgggctcaagtggtcctcccacctcagcccccacaagtagctgggactatagacgcacatcaccacgcctggctaatttttctatttttatagagacagggtttcaccatgtggcctaggctagtctcaaatgcctgagctcaagagatctgcccaccttggcctc

SEQ ID NO: 23526 - DNA, 1047 bp, Homo sapiens
taatcaggaaaggaaacagtttggacatcccagtagcagttacaattttctttggggccaatgacagtgcactaaaaggtaaaagcatttttgatgttcttctagctcacttttaatcatttttatgttacagcaaacttgcatttaatatacttttttcaactgtttactttctcccaatagatacagttttgccaaacttatgttgtttatatgtattcctggctttaacactggtggattttattcttgactcagtttctacataccttggttgctggcagtcctaatcttgcaaacagttaaatattttctagagtctgttagtgctatgctaagtttgtaatgtgttctctttagttgatgcatttggcagcagaaagcttaaggataccttgtggcttgcatcacactgatggcagctggtggcgtgtcttagggagggatatgtcagggcagcagccaccctgacctcagttaggcttgaatcctgggcaatggtgaacgtgggtttggaaaaggagatggtctctccttgactgctgaagaattgctgctgtgactagaggaaagctagccatgtaagaggcctttcttccccttctactcttgaaaaaagccttctgcgtgctatcgacgagaaaaatcagcctttgttttgggaagttaggtagtcaccttccagagatttcttttgttaccctacttgtgtcacagaagtgctgtggtctgctattcacgggcacaccgtaggagacctctgagttgaggctggacatgaaggaacaccaactgcagtaagaggaattcttgctctctaggagaaagattacgtagatgacaggtatcggtggagactgcacactaaccattatatttgggaagaaattaatcttcactttctatcttgtaccaaaaaccataagaaaactcaaaacagaattttttaaaaagataaatttttatcaaatttagcataaggaaaaaacacttcctaagtataagagcagtggaggaagccacagaggaaaaacaggtttatgaaat

SEQ ID NO: 23527 - DNA, 1108 bp, Homo sapiens
tgaaggccactgagatctgtgtagagctgtggtgctcggcctgcgggggctgatgctgatgtgccttgacttggaagtccacacctggggctttttactggtccacagaagctgggggtaggaatgatcagataggagtcgccagcactccatatacttgggtttcacatccctcaagtgctgtgttttcaatccacctttgactgaaaaacctctgcacataagtggaccttcacggttcaaacctgtgttgttcaagggtcagctgtatgttaatgttgaaaatgtgcattatggaagttctcttttttttttttttttggagatagagtctggctctgtcagccaggctggagtgcagtggcacgatctcggctcactgcaacctttgcctcctgggctcaagcaattctgcctcagcctcctgagtagctgggattatgggtgtgcaccaccacgcccggctaatttttgcatttttagtagagacgggtttcaccatgttggccaggctggtctcgaactcctgacctcaggtaatctgcccgactcagcctcccaaagtgctgggattacaggcgtgagccaccgttcctggactggaagttttctaagctgcccagaactcaacattctaggacaaatgactggctttgcaacacagaacagctatttctcaaagtgtggtctgactctgagttaactgggatttttaggtagatttctggacccattttcagcactccagatgtttcttacacacaccacagcacacataccacaacttcatggaaggctgttattgtccctactttaccagtggagaaatggagtcttagagaggctaagtaaccggcccaagatcacacagccagcaacacaaccaggaatcaaatccagcaagtgtgacttcacagctcaagtccttactgttgtatgagtttactgttgagtggggttgtagctatgtcccttgctctcaaagggcctgtcatccttagagaaggatccaatgcgttctcaagtcacaaacagcatatgccaaggggtgccacacaccggaggcacagacaaacggggagaaaccccagcctgcgggacgtggtga

SEQ ID NO: 23528 - DNA, 1074 bp, Homo sapiens
gaaaacaggagtcatgggaaatgggtagtggagactcagccaaagccatgcccagtggtctggaaggacatcaccaccagcactgctaccgtgaaatacagccttctagacaccactggactgtccatatcaccaagagtatatcctcaaacattcctgccttttttatcccttccctcaggattctgagtcctgggtgggagcatccagtcagctgaacttagttcacaagcctgcattccaatggccaggtgatgggactctggctctgtctcctgctaagactcatacaacagcacgggggaacaaagttttcagatgttcagtaggcaaatatcagcagtgtccactagagttccttctaactttaagtcctacagccaattgatctgaaaacaggaaaaggatgagaaataacttgaatagcactacagggaccaagctgtaaagaatcagatcctatctctggtgaagccctccaatcatctcctaaagatctttaattttgcaaaaccatcactagtaagggagactaatatcaaagtgaacttcatgagaatccatttctcaggcatttctttttgaggcagggaaatgtaccaatctagcttttttttttttttttgagatggagtctcactctgttgcccaggctggagtgcagtggcacgatctcagctcactgtaacctccgcatcctgggttccaacaattctcctgcctcagcctcctgagtagctgggattacaggcacacgcctaatttttgtatttttagtagagacggggtttcaccatgttggtcaggctcatctcgaactcctgacctcgtgatccacccacctcggtctcccaatttattttaagatggagtcttgctctgttgcccaggctagagtgcagtggcacgatctcggctcattgtaacctccgtctcccggatttgaatcttgactcttcatagttgagtaactttggacaagtcccctaatctgtaaaataggcataatgcttcaaaggattgttataggactatatgagatcatttacgcattttgcatgcaacaaatatttg

SEQ ID NO: 23529 - DNA, 1030 bp, Homo sapiens
agatgttagctttacatatttttgtttaaagaacagtaagacttatagtggaactaaggagaaatcagtagtaacactagggctactggaagaataatttttctgatgtttttgctttaatccttttagtaggttagcagttctggaagtgtgttctacaggatgtaaataagcaatacatccaaaagaaaaatttaaaggttttagtcttcagatacttaggaaacaacaggttaaacaaagtaaaactcaaataactttgggggtttattagtaccttttgtgtgttaatgtgcttgtttaatttccagggaatgtcctgtgtgttattcacaatttgagaacaaaatcgtttggtgtatgtacataacgtccatcaggacttgagttccacagaatgcactttggacagcgatatgctaaaccagtcgttcacctgagtgcatcagaatcacctggagtgcttgaaaaaacaccaatcactggaccttaatccccgaatttctgagttagtatgtctggagtagagcccaagaatgtgcatttctaacaagttcttatgggacacccatgcttctggtctggggaccactctttgactttgctgccttcctggagcaacacagtatttctgcaattatttgaatttcatattccttcatctagtaaaagtcatttaaggaatgctttaaaaagccagttatttagcaacaagttgttcacttgcttcatatgcttcattggaaaccaagtgttgagaggtccagcctagttggggagagggatttatgcatatgtgaaatgaatagacatgaatttatatggtgatatgctaagtgatttttttttttaagagacggagtctcgctctgttgcccaggctggagtgcactggcatgatcttcgctcactgcaacctccacctcccgtgttcaagcaattctcctgtctcagcctcccgagtagctgggactacaggcacacactgctatacccagctaattttttctattttagtatagatggggtt

SEQ ID NO: 23530 - DNA, 1033 bp, Homo sapiens
tgccaagccctaaagcaagagctgtgtgatgaaggagcagaggagagttcgtgtgactggagtcagagaattctagggcggagtaggaggatgagagtgaacagatcatcagaggcagatatctgtctttgtaaaccaagttaggaatttggatttttaaaaattgaggtataatttatatataataaaatgcaccctttaaaaatatacaattcagtggttttcaatatgttttcaaagtttgcaaagctgtgcagtctctattttcaggacatatcactctggaaggaaacctcatacccaggggaactgcgggtttccagtgtgagagtaagcccctggaagattgcagcaggagagatacgatctgattgatgtttttaaaagatcattcaggcagctgtggaaaatgagttctgggaagggtggaagcacggagaccaggtggtcttttgctatcctccaggcaagagatggtggcttggattatggcagtggtaatggtgactgggttcaggatctgtttttacaggtagacacgacttaattctaatgcagtggtttttttcagtgatctgagacaaaggatgagtttactaaatttctaacccatcatagattgaaactttggaaaattacataattataagtagagacagtgtttccaggggacatggctaaactctgttggtcaggagaggcatatgagatgcttttagtctacaccagtttttctgtcaacttcctggattgatctagagaactagctgataatacctaggaagggaaatagattgttcagaactttgagtaagcagctttttttttttttttttttttttttggaaaaacaaatacttttctaaaaggagattcaaagaactatttataaatggtgaaaaactgttagaactccagatgccgaagacctgctctttgcggacatttctgcttcccctagtcaggtctctcatttcttcctctgctcctacagaactgactgtgcctctgttgtgctgcttgagacagtgtc

SEQ ID NO: 23531 - DNA, 1045 bp, Homo sapiens
taatagagacggggtttcaccatattggccaggctggtctcggactcctgacctcgtgatccgcttgccttggcctcccaaagtgctgggattacagttctgaaactccagggctcaagcagtcttactgctgctgcctcccaaatagctaggggtacaagcatgtgccactgtgtgcagtccttcttagacatatttatttagacaggaacttaagagaatcattcagtaattggctaaataggccaacatatgggtaaagagaataatagatatgattagatttattatccttaaaatcgtgggaaatagaatatgcttaactaattcttaccttgtctttgaattaagagatttttcttaaagcatttactctgctatatcagtatataactctcattaaacctttttctttttaaaaatacaggtttgttgaagaggaccatattccttacataaatgcttttcagcattttccagaacagatgaaattatatggacgtgacagaggaatctttggtatagaggtaagttattttcttttttactttctagtctctgataaggcacaagagtggtatgataatttctatttcttgcttgacttattatttggtgttttgtgttttatcccaatatggaacatcagtcataatttaacgaagagtagaattttattattttttattttccttatgtggattcctctaatcctttaggttatcctcaaaatatagctgtagtgtgatgtgtgtgcattgcagataggtatgttgttgagactaaacttgagaacttttatctagagacctttaggtaatttcaattttttaaaaataaaatatgtgttttgttgttgttatttgcacactatattgctatggaagaaagagaagaaagttattaccgtgtttctaaaggtactattttaagttcttcacttatgttagtttgtctttttctagatctgttttcagatgtctccaatggaagggtttctgtcctttgattatgagtttgtgtcactattggtggtactcaaagg

SEQ ID NO: 23532 - DNA, 1049 bp, Homo sapiens
caccacctgtggcccttgtgtggtggccatggacagtgtgaacatgttttcctttgtgcagttaaggagttaacaaattcttctaagtttccttccagctcagggtcctgttttaagcctaaccatatatatttgctaagttatttggggggatgttcaggggttagtgtgtgcatttcttggttaccatctaaagataaattcttttttctttttcccttctagctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcgtattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatgatcttggaatggcaaagtcaatttttgcagcatatggtggacaaagaaataatttctttaatgtatcaatagctcttgcaaagcaaaaggaaaaaagcaaactgagtaagggatatgaaaaattagttttctgaggccgggcgcggtggctcacacctgtaatcccagcactttgggaggccgaggtgggcggatcacg

SEQ ID NO: 23533 - DNA, 1028 bp, Homo sapiens
tctcctcctccaaagggatagttttagtaataacttcagtatttgcttatttgtttttgaggttttctttagaaggatgtgtggcagtggtctattaaaaaaattaagcaccagtgactcttgaacaactgcctgagtaaaattgaataaagcaagttaaattgtattcaaattcctgttgaaattatttgtgaaatattttagattaaaactttcagaaaatttaattaacgtttggctagccatgaaaaactttaaaaagacaccttttaaattgtcttgtgttttattatcaatcaaggaatgaaacatatttaaaggaagaatgatcatcacccagtatcccattatcgtgatgattgctttattcattgttttgatgtgtatgcaaattttatgtagcgtagttgtgttcacagataggatttggtagtgtactttcttctacttagtttgtttcataaacattttctctgtattttaatcttcataattatcctttggaagaggacttgtggcttttatcttttacttttcattatgggcattttcaaacataataaaaatagaaaaacagtataagcccacatgtatccatgaccagcctcaacagttatcaacacaattcctcttgtttgatttgttcttccctcttcttcaactttgagattaattcatgtttttattttatttatttttgctggaacattctgaagcaaactgtaaatatccttacaattgctgctatatctagttttcactattaagaagtcttaaggaacaactttctagactttttccgttttaggataaattcctgggagtgaatttatggttcagggttcaaacagttttattgatcttgaaatgtacagaattctcaatttgcctgtttcttgaagcttcagcctatatgatttctgggggctttgaaaattcattcattttacccactggaaatcatcttgtattgctcaaattatttatcaaaccaaaatttaattttataaaaagcagatgtgtctact

SEQ ID NO: 23534 - DNA, 1054 bp, Homo sapiens
gtgatgactctttgtggccaccacatctgccccctctttttttttttttttttgagacagagtctcactctggcccaggctggagtgcagtggtgtgatcttggctcactgcaacctccgcctcctgggttcaagcgattccccaacctcagcctcatgagtacctgggattacagacgtgcgccaccatgcctagctaatatctgtatttttagtagagacagggttttaccatgttggccaggctggtctcgaactgctgacctcaggtgatccacccaccttggcctcccaaagtgttgggattacaggcgtgagccaccacgcccggctctgctccctcctttttgtggctttgctgttttaataataatttggttgtatctcttattgcgaatggatctttcttgacataaattaattaggaaatcgagcgctcacaaatcctattttatatgtatctatttcctgatatgtaagttgagcatatgacataaaatatcaaagaattgtgacaaattggatgaaatatatatagaaataaaccttataatggtacaaagagtgcgatgctgccagtatccgttgacagttgctgctgttggttttttctcaagcttaactttgatgtgttttgccactaggtggagcgatttagccaagaagttcagattacagaagcccgctgtttctatggcttccaaattgccatggaaaacatacattctgaaatgtatagtcttcttattgacacttacataaaagatcccaaagaaaggtgagtattcaagtggtatgccaagatttttaggactcactaattgttgatttattacacatttttagttcacctagggataaaaatgactccagaatgactaagacagtcataggcattcccagcacccgtggtcatgtctgctcttagcaaggggcctaaatgcactttattattcacttagagttgtgaaggtactccttttaaagttggatgtctaccaatgtaaaaccttcttttgaaaaaattcctagatgttgggtaagacaaactaaa

SEQ ID NO: 23535 - DNA, 1030 bp, Homo sapiens
gcttcaggccttgagggccaggaaatgaatgtggaagactgaatcctcaggggaccccaactctgggccgggtctggggctctgttttgaggacggggagtgggaggaggtggcagcaggagccggcgtctgaggcatctcctcacactcttccaaggtcagagacgaggtctcagatacgcttgctaatgcacgatttatttctttttcaatttcctttggaacctgtgctgtgcagatgttcacatgatgtggtggggaagtgagttttataaaactcttggcagagtaccattcggcatccctgtggttctagagatttctggggcctcggggctgtagcaccagctgcagacagctgcctgccttcttacagtgctcagcttttgggtccagcagctttctcagtcccaaacacatgtgacctcacgattctggcccttccatgatccgcaacaaactgttctggtgtgtaggtggaattcctatttttaatagccaagttgttgagaaattgtagggcttctacttccttttgaacggaagggctccggagatatttatatctttgcttctatagaatctaggaggttgtctttacccagggagggtcagcatgtggagagggtcacctgggagaggccccggtgtcagcctgcacttgccgtcagtaaatggtacgacattgagcaccaaggagctcagccagcccctcgagggaagtcctagctgcccactgggggaagggcggggaggcatgaaaacaatgaccccactggctggtgggggtgaccgtgttatgcaaagtgtacaccatgtagcatgagcaccgggccgggagcccccaaggctgctggggaatcagggagacaccaaagaggaggtggcctttcccttgaagggtaagggatctgtaggagtctgtgggagagtggaagctgcgggagggaaaggagggagggaaggaggcctggagagaggagggaggctcttgcattccaggcaggtatgggagctcctggcagagttt

SEQ ID NO: 23536 - DNA, 1033 bp, Homo sapiens
tctgtccccacctgccacctgctggtccatccattcagccgttgcacggacaggttgccttctgggggctgctagcccccttgcactgggcaacgctgtgtcccctctgtccctccccccagcgcatgctcctcgctctgcccctgctgcaggtgggccatgcttggagggcgcaggagagctgagatggggtggggatggatcaggccttgagagggtgcctggtaagccccgggaagggtagggaggaggaggagggagaggagagggcagtgcaagggcagcgacccccagccttgcccccgttttgagcacggggaaagtgtacacaggtagtgaggaaatgcctgcgtttgggtgcgtgttcatttctaatccattttcactttttgtgtattctttctatctactttttaaaggtttgtttcttttctaacttcctgttttagatgtatactttagtttctttatttatttttatttatttttttgagatggagtctctgttgacaggctggagcgcagtggcgtgatcttggctcactgcaacctctgcctcccgggttcaagcgattctcctgcctcagcctcctgagtaactgggattacaggcgcgcactaccacgcccagctaatttttgcatttttagtagacatggggtttcaccttgttggccaggatggacttgatctctcgaccgcgtgatctgcccacctcggcctcccaaagtgctgggattacacgtgtgagccactgggcccggcttagtttctttatttaaagataagggtttttttttgttttgttttgtttttgagacagaatctcactctgttgcccaggcaggagtgcagtggcacagttgtagctcactgcaacctcaacctcctgggctcaagtgatcctcccacctcatctgagtatcagggactacaggcatgcactaccacacccagctaatttttgtattttttttgtagagacagggtttcgccctgttgcccaggcaacaagcaaatctgcccacctcag

SEQ ID NO: 23537 - DNA, 1047 bp, Homo sapiens
tgcccggctaattttggtatttttagtagagatggtgttttgccgtgttggctaggctggtctcgaactcctggcctcaggtgatctgcccgcctcagcctcccaaagtgctgggattgcaggtgtgagtcactgcgcccagccctgctttattaatttttgttgttgtttaattttcagcgaaaagtttgctggcaattttcatctgttctatgacaacatttttactagtgagttttcacttgccacttgtttttcctgttccttttctcgtttttattttttaattcttgcagtgtcttcctgtagatgctgcgctgtttgcttttttatttctcatctttgggcaaggtaagtttttcttcaaccatctatttgccagaggtttgtgtgggagaagaagcgaggactacacccagtgccatgtgcagttgtagggctgctcatgtgcagtctggtgattcctctttttgcctgcaagtgtggcttgtctgtgtgattgtctgtgtctgatctgctgcttctgcttcttggttccaagcttacctgtatctcacatgccactgtcatgagatcacaggccccactcctgctcatgcagataagggacgttggttggtgggcagtgtgatcccttctcactgcttcttcccaaacatctgtgtggtatttcctgcctgggcaaccctctgactcgtttctagtttgggtttcatctctcatctgtttccattggaaatggagtgtagctgggcgcagtggctcatgcctgtaatcccagcacttttggaggacgaggcgggtggattgcttgagcccaggagttcgagagcagtctggccaagaaggtgaaaccccatctctactaaaaacacaaaattagccgggcgtggtggtgcaagcctgtaatcccagcactttgggaggtcgaggcgggtggatcacgaggtcaggagatcgagaccatcctggctaacacggtgaaaccccatctctactaaaaatacaaaaaattagtcaggcacggtggcaggtgcttataatccc

SEQ ID NO: 23538 - DNA, 1036 bp, Homo sapiens
ggcttgtgtcacacataaaatacactaacactaacgatagctgatgagctaaaaacaattaaaaatcacaaactcataatgttttaagaaagtttataaatttgtgttgggccacattcaaagccgttctgggctacgggttggacaagcttgctataatggatcagagatatgtacagtcttaaagaagaaacagctcccaggcctgtaagacctatcagggcactcactgaatgctgtgagcaggggaaggggcagtcctgggcagtggggtcctctctgggggtccagctgtgtctccagtcgtctggggagctgggaacagcacaccagggttcttgcctcctgggaaagttctcacagaaagagagaacagaggtgcaaaagctaggccatgttcattattctttcattccctacttattgagctttgacaatgtgtgagggactgcttgattgattgactgattgattgggacagggtctctgtcacctaggctggagtgcagtggtgcaacctcagctccctgtaacttccgcctcctgggctcaagccatcctcctacctcagcctcctgagtagctgggattacaggcccacgccaccacacccggctactttttgtattttttggtagagacagggtttcgctatgctgccaggctggtcttgaacaaccaggctcgagtgatccttctgcctccccttgggctcccaaagtgatgggattataggcttcagccacagtgcccagccagaggaacgtttcagatgctggaatcaatggtagtgtgttggaggaagggagtttctgagctcagcccatttctttttttttttttttttttttttgagatggagtctcgctctgtcgcccaggccggactgcggactgcagtggcgcaatctcggctcactgcaagctccgcttcccaggttcacgccattctcctgcctcggcctcccgagtagctgggactacaggcgcccgccaccgcgcccggctaattttttgtatttttagtagagacgggg

SEQ ID NO: 23539 - DNA, 1136 bp, Homo sapiens
gtcacatggccctctcggcctcagtttccccgggtctgcaaaatgagtgctgtgcagaatgagcagatggagcccactcatcccgggcagtggcgggtgggaactatggggtccacagcagatggtgccagaaaggcctgaagagggaagtctgcagccaggcgcgagcctcggttccccggctgcccagtggccgcgctctgtccctgccctagtggctgttctctcccctctcctggttttctgcctggacaacaggaaaaggtttctaattttaatttgagcacctcattgggcttccaagtcagagtagtggaagtgcaaacctcagccttgcctcttggctgtgtgacgttggggatgccccttagcctctctgaatcagcttcccatgaaaaagatgacaggaatgcccgttgttcttcctatggcatcaggaaattagagtcctgtgagttcatttccctcgagctaaagcatgcatgtgaatgtgtgcgtgtgtgtgtgtgtgtgcatgagtgtgagtgtgaatatgtgtgtgtgcatgagtgaacgtgtgtgtgagtgtgcatatgagtgtgtgtgtgtggctgtgttggatagaagtgtttttaaatagtgtatgtatttttcaaccttttttgaatggagcccagggtgtatttcccaaattctttttacattattttaaagagaggcagcagagtgttatgacagagaaccagctatggagctggcctgagtctgcatctgggctccacctcaccagctgtgtgtgaaaccactttgttcctgttttcttatttgtaagtagagatcatatcatctatccacatctctgcctaggtgtgtggacggcttaatacacttggaagcctcagaacaaggactggcagtaagtgctcaatacattttatcatcattgttatttttgacgctgagggtcactgtaacgaccaatgaaccagccagtgaagtgggatgaatccattcaggagcacacagggctcgggtgcactcagtgctcacgggcgaagtgagcaggctggcatctgtttggattggtctctgcttgaaccctgttagttgttaaacagtttgaatgccatcccagggtagaagagacagaaacttaa

SEQ ID NO: 23540 - DNA, 1036 bp, Homo sapiens
ttatgatactcttttctgacattgagcaaatcattttcatgtctgtccctcccccaggatcagtttgagaccagcctggccgacatggtgaaacactgtctctactaaaaatacagagactggctgggtgtggtggtacatgtctgtaatcccagctacttgggaggctgaggcaggagaattgcttaaacccgggaggcggaggttgcagtgagctgagatagttccactgcactccagcctagcagcctggacgacagaggaagactctgtctcaaaacaaacaaacaaacaaacaaaaaaaaacccaaaaaaaatcccacaaaaaacaaaactatgaactaggtggtctagaaacaattatttctcacaggtcgttttaagccactgagtttgtggtaatttgtcacagcagccctaaaaaataaatatacacagttttaattgaagttgggctaagaagctggacgctagtcccagctactcaggaagtggaggtgaggggatcgcttcagcccaaggagttcgaggctagcctgagcaacatagcaaggcctcatctctaaaaaataaaaattaaaaattgggttaagaatttagcagctagtccttaataggatgagccatgaggaccggcagctacatatcagtggtttgaagcaaatggttgccaagtcgctcctctccctcccaggtcatcaccgtgacatccttttgtccagtgtccttccctccagggtagctcaggttaggggaaacagccaacacatccatgcaaggaaataaatggccactcaaacgcagactcttttaaaagtgggagagtggctgggtgtaatggttcatacctgtgatcccaacactttgagaggccgaggtgggaggactgcttgagcccaggagttggagaccagtctgagcaacattaggaagaccctgtctctacaaaaattacaaaaatgagccaggtatggtggcgcgtacccagctacttgggaggctaaggcgggaggatggcttgagccctggaattcga

SEQ ID NO: 23541 - DNA, 1078 bp, Homo sapiens
gccctttgaggcctggggcaggcgggacagaggcagcacccgcctggcatggggctgaggcctccttgcagctgcctcccggccccttgttctccttcatggctccatgcacagctgaggggagacatgaggtctctcggtctccatgggtttggggcaggcccagaatggccctgaatccagtaacaccaactgtccctggaagtgtcaccaccctggtctgggaggagctccatgaacatctcaaccatccacttcttgtgcagatggggaaactgagtcagaaagggaggagactgccttaagaaagattcttgcaacttgactttgatcctgtagagtgtttgtgggtttagaagagcacaggtctgaagatggaagacttgggtttcagacccgtctctgccctgtgcaccagcatgcccagagcagcactaacccaaagccaatctgacaaatgaacaagtcattctatttactggtttctttgatctatttataaaaatgaatatttatagcaaatcctgtaggatgcggtagatttggaagatttctgtgatgttttgtttgactaatgcttattttcccttttgtatcagtattttaacaaatgctttggatttcctccacgcagaggagaatcagtatgcagctgttaattttggctgctgactccaggacaagagacagagagagagcgtgaaagcgagacagagcgtgagagtgagagagagagagagaggcaggagaggctgagcgtgggagggagacagacggcatcgattcattaatatattcaaaactatattcaaaaactattcatttaaaaattctggaatatattgactacatactttaaaagacttttttataatgggaaactttgaacataggcaaaaatagaataatagaaaagcccagcgtgcgacatcagtgtcaacagaggtccatatgtggccagtcttgtctcagccttttccccacccattcactcctctcccaaatccggatggttttaaggtgattttagccatcgaattccatatgactctgttctcaagtgtactggatacattct

SEQ ID NO: 23542 - DNA, 2025 bp, Homo sapiens
cctgcacagggactgcgcgcacaaaatatgaggcccacagggaccgcgcgcgcaaaatatgaggcccacagggaccgcgcgcgcaaaatatgaggcccacaggcaccgcgcacacaaaatatgaggcccacagggactgcgcgcacaaattatgagtcccacagggaccgcgcgcgcaaaatatgaggcccacagggaccgcgcgcgcaaaatatgaggcccacagggaccgcgcgcgcaaaatatgaggcccacaggcaccgcgcacacaaaatatgaggcccacagggactgcgcgcacaaattatgagtcccacggggaccgcgcacacaaaatatgaggcccgccatctaagggctctactggcttcacaagtcaagtttgattccttaaaggagagcacaccattccagtcaaagccttgctaaaacaaccagttcttccaattgtgtcctgccataaaagaaaacagacttttggtcgggtgccatggctcacacctgtaatcccagcactttgggagcccgaggcgggcagatcacctgatgtcaggagttcaagaccagcctagccaatgtggcgaaaccctgtctgtactaaaaaacacaaaagttagctgggcatggtggtgcatgcctgtaatcccagctactcgggaggctgaggcagggagaattgcttgaacctgggaggtggaggttgcagtgagccgagattgcaccactgctctccagcctggggaacagagcaagattccatctcaaaaaaaaaaaaaagaaagaaagaaagaaagaaaacagacttgtattgcacctttgcaaataaccatactgccataatttaaggatactcacaggtagtttccagactcgggagaaaaccaggcagagagaaataagcatgcctcaaattttgttcatgggagcacaccaaactgtcaaaagctgttgatagctcaaaagaaaagcctctttgactctgaaaagcaaacaaaggaccaacaatattccgagcaaaacatcaaaaagatcactccagtctgttagttcagttcacgcagtcagttcctgtcctgcctgatatcaatgaacattccagctcttcaagagtcctgaacgtccttcctctattctgatgtcacaatctgcaaagttatcagaaacctgcattcaagagcacctgtcagaactttatagctgatcataaaaccaccttctaaagaggaccaaaacaagacaacaattgttcatggatgacaaaaagttttagggtggccgcagttaaagacacaattgatgaggaaatctgttacctacgtggcacacaacaattttaacataacaattataattattactgataatgtacactaaaacatatcaggattgtaggagtctcccacaaccttggaacacataccaaaaacatatctacacaaatatagcccaaagaaagccaagcaccatttcgtatttgacaatattttctgtataatttttataccaaataagccaaatttcacctttacattagtgtactatgaatgttaaaccgaattaataaatccttatagacatatttactcaattttaatatttgaccacaaggtaagatttttatagactttttatagccctttacaatttttgttaaagagcaggttagtgctctaagagaaacccactgtgcttttattttaataaaatttaatttacagaaaaactggaggataccccttttagccaatatgtttacacacagaactgcctctaaaatcagcctttcacaactagcccaaaccttcatttttattttatccaactgaaaaaaaaatcctttaacctttcaaacttggcaaaaatccacattctcatgcctccctgcaatctttctaccaaaactatattttacttttcctacataccttgcatgtaaggacagtggcttggaatgttggaacctttccttggaatgttctgggtttcagcaccaaatgtaagacttgaagaaggaagaaagaaaca

SEQ ID NO: 23543 - DNA, 1051 bp, Homo sapiens
ggaaggtctgtgtgcagagggaatggctgtctcagaggcgactcaaactcagtatgtccagaaaggactcacaatctgctctcccagcccagcgcctcctgggactttggcctctgtggatgatgaccacagtcacttgggccagaaacatagacatcatcttgataccccttctccctcacctcccccatatccagtcacctccagtcctgtcatctttgcctcctaatctctttcatctctgcccttttctctccatctccatggccacccagctgccactgcattttgctcaccacctgcaattggccttccagcccctgaacccctctgatctgctcagcccgctctccacaccgaacccgaggctctctctttgaatggcaatctgatagtctcccccctgtttaaaacatgaaatggtatcctactaccctggggataaaaacaagacaaaaacgtttaagaggttagagaggtcttcatgattcagtccccacccacctctcagactcacctcccgccccagcctctctggactcttttggcccctcatgggtgccatcattttgcccacataggctcttgtctgtgctgttttcactatagagtgggtccttcccttctttctttgtctaattcatgacactcatcgtttagtgcatttggcacttcctccaggaagcctgccttgacctccctgactatatcagctctcccccattaaatgttcccctcgtgccatggtcccctcatctgtgacattgatcacatgagcaatttcacatttattcatgtagttagttatagtctggatcctcctttggattttaagttcctataggtaaaagccttcctctcctttggccaccgagatatctccaggactaccatggacatgcagtaaacattcaccagttgttgaatttatgagtgggtgagtggtgcctgccaccctagaatttcccttatttgaaattctagaataagcagattcacttctttttcacatccatgtgaatttttgttcttgtataaatgaatagtaagt

SEQ ID NO: 23544 - DNA, 1001 bp, Homo sapiens
cagccatggcccctcctgatgtgagcctatctcaggttctggtaccacaatccacccagtgccaagccagacactcacgtatcaccctggatgccctccgcagcccctcacccatccaacagatgccccgtccctgtgcctgctaactccctcccacctctccagctcaaggcctccctcccacgtgctggatcctgcctgttcagacctgtcctgtctcctggtggccaaactggcctccccagtcagtccctgctgcagaaagtggtttctttctttctttctttctttctttcttttttttttttttttgagatgaagtcttattccatcgaccagggcctggagtgcaatggtgcaatcttggctcactgcaacctctgcctcctgggttcaagcaattcttttgcctcattcccctgagtagctgggattatagacatgcaccaccacgcatggctaatttttgtatttttagtaggggtggggtttcaccatgttggccaggctggtcttgaactcctgacctcaagtgatccactgatcttggcctcccaaagtgctgggattacccctgtgagccaccgcacccagcctggaaagtagtttctatagtacaaagccgggggtgctgctcccctgccccacacacctcagcacctccatgttgcttcctgtggagtagacactattgttttgtctgcccagtctcttcttttcttgtgggaatatgcttctggaatatttgtctggaaaaccctctccttttgataactgtctttgcctccctgggactgcagctgacgtgcttgcatgtgtgtgtgtgtgtgcgcgcgcgtgtgtgtgcgtgcatgcgtgtgtgtgtgtgtgtgtgtgttgggatcggcttccaaatcttcctactgggggaatgcccattatccattagatgccactcagtgggaagtggtgccccacccgtccgtggagacctaaggggcttaatagatcctccctgcata

SEQ ID NO: 23545 - DNA, 1086 bp, Homo sapiens
ggtgcccttatggttctcccatgtgaggacacagagggcagccatctacaagccaagaagagaggcctcaccagacaccaaacctgccggcaccttgctgtgagatttccagcccccagagctgtgagaaataaatttctgttgtttaaggcactcaatattttgttacagtagcccaagctgactgagcagatattcatatggaaagtgaattttgatctctacttcatgccgtacataaaagccaattccagattgactgtagatacagattggcaaagcaaaacagtacagtttctagaaagaaacaggaaaatatctgcatgaggtggtcaaatatttcctagagaggacacaaaaagcactaactacaaaataaacaatgataaattggactgcattaaaattaagaacatctgtttaacaaaagaccccacgaagagcgtgagaagccagagtgcagagtgggaggagaaatctgacctgagatgggaaattagaatatgaagaactccttcaagtcagcaagaagacaggcaagccgagaggaggacgggcaaacgacctcaacagacactttacagaagagatatccaggccaggtgcagtggctcatgcctgtaatcccagcactttgggaggctgaggccggtggatcacctgggatcaggagtccaagatcagcctggccaacatgtcgaagtgccatctctactaaaaatacaaaaatttgctgggcttggtggtgtgcacttgtaatcccagctacatgggaagcggaggtgggagaatttcttgaacccgggaggcagactttgcagtgagctgagatcgtgccactgcactccagcctgcgggacagagtgagactccatatcaaaaaaaaaaaaaaagatatacacataagagaatattcaactttattaatcattggggaaatacaaattaaagccaaagggagacaacactccttacccctaggaatggctaaagttaaaaagatgggaatacccatgtcaggaaggatttgaaacaactgcaactctcatatgctgcaggtgggaagtaggaggcaggcctccactc

SEQ ID NO: 23546 - DNA, 1993 bp, Homo sapiens
tacctcgagggtggggcctgccaaaaggagggattaggatgaggaggcaatgcctcccttaaggaattctgactgtgactcggtcgttgtagggagggggctgtgcatttccatgcaggcaagtcaggccctgggcacatcctggctcctgtcttggaagctggtgaacacccctagccagtgtggccgaaggcagcattctggaccagtccaggccttctgcacgggtatagcacagccctttgcctctcactatatgggctgtgccaggacatagtaccttgaccttcaagttcttttttttttttttttaaattgagacagggttttgctctgtcgtccaggctggagtgcagtggcacgatctcagctcactgaaacctccgcctcctgggctcaacggatcctcctgcctcagcctcctgagtagctgggactacaggcacctgccaccatgcctggccagttttaaaaaatattttgtagagagttgcccaggctggtctcaaattcctgggcccaggcagtcctcccacctttgcctcccaaagtgctgggattacagttgtgagctgccacacagccccccaggttgttatcactcatcacagaatgttctcagcttgttcttctgcgtgtggccaacctggaggcgcagggctgggttcccatgcggcctccttgccacagggtccaggaaggctgtttccaaaccctcttggcaggaagatacacttctggtgggattcaggtggaaagagactccctcactactggagagcaggctggggtctgtgtgcttggatagttatcccacagagagggacttcacaagcccgagagagaacagtcccaccaggaacagaggaggagtgaacaggacagagacacagacaggcaggacttttctgaacagtcatttgaaccagagaacaatttttcaatggacaataaatgttgcatataattgaaatctcggttacattccctgaaaagtgctttctgtgcaacctgagataagagactctcctggagctgcggtttcctcatctgttacacagtggttataacgccttgccgtttctatccgggatgactgggaaattcctctggaaaacaactacaaatgcaaaggtgaagtatttgatgatgtgtatatgagcacttcccagtgggttttgtggtctgtgggcatctccataggtcaataggtcttaatagtttaaaaaaagattccttggttaattaatttgatgaaacactgggttaaacacagtcaagcagatttccttactgcaggacttctcaaggcctttagtatgttaatacgcattgaaaatcgccaggagaggggtgttctatgtggcatatctcagacatatttacctagagaagggggtgtggtatgtgtgcgtgtgtgtgtgtgtgtgtgagagagagagagagagagaaagaagaaggaaggaaggaaagaaggaaggaaggaaaaggaaggaaggaagaggaaaggaaggaaggagggagggagagagggagggaaggaaggaaaaggaaagggaaggaaggaaggaaggaaggaaggaaaaaaattcacggggttagtgcagggaaattctgtggtaaattttaacagcaagtgaagaatgctgttccacatggatgcaggtattttttccaccatgccaattttacagtgcaaactgaatctaacaggttggattaatttggggatatgcattgctccactcagacagtctctgcatagattgccagggcgatgggaactaattcagaaaagcggaggaagactgtggcttgcaaagcccgcagatacatggctgctttgaggattttcttttgctcaaaggatttagggtgggggtggggagtggggaggacgggaggtgcttcttttgcttagaataaaattgcaaccttgaggccaaatgacagaggcttctcagcgtatggctggagaagtgcaaatgagaaa

SEQ ID NO: 23547 - DNA, 1057 bp, Homo sapiens
aatgagaattagcccacatccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggg

SEQ ID NO: 23548 - DNA, 1034 bp, Homo sapiens
tctgacccgtggatcccagccctgcccaggcccagatcctgggctccaggtgggcctgggttggggctcccagctgcaggaatgcaaagttcatggttctacaaagtgctttgaggtgacgttggtcacatcagctcggcctcagatttgctgctttttttctaaagaagagacagctccaggccctgcctgactgacctagttggggatgcaggccgaggccatatcgagcagggtaagtttccaagaatctggctttaggattagtcgggccacacggaaggagttcctggtctcgtgacacctgcacaaatggtcttcaaccctcaaaacacttcctgttatttaaatcttggtcctttgattttttttttttttccttttagagactatgcacaatttatgtggcaagctagagatgctttctttttcagagcggcctttatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccac

SEQ ID NO: 23549 - DNA, 1050 bp, Homo sapiens
tgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcag

SEQ ID NO: 23550 - DNA, 1025 bp, Homo sapiens
tatatgttttgtccattttttcttttgagctgttccaaggccattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctccaaggccattttaaactgaccttaatcttctagaggtggctggtgttggcaaaaattgtggggttaggaaagctgtggcaggggttttgaattttggcagttccaagaaagcagcgtttcttggcaatttgtgaagcctggagatggattctgccaattttggaataaatgtggaattttctaatttaatcgtgaggcaagaaaccatgtgacctctgtcacctcatcctgacagtgtccgcagtgctgtcctttctggaactgtatgaaattgcggtcgtgaatgctttggagcgtctgctgtgtgctggagttctacagatgagcttaattatgggaacgccctcctgtccctgggcaaggagggggatgagcagggtgggggtgtgctggaggaggagacgcctgccactttgccaccctggaagctcactgcaagagctgcaaaatttcccacctgcctaacacaggcagggctttggtggcgggaccccagggctggctgtttttgctctttcatcacttttgtcaggaagtattgaaagacctttaaaaggcctctgacttgcagggcctctgacctgcaggccttttaaagcatctccagcttttctagtgagtttttgtattttggacgggaatgtctcacgaaccctggcatgccaagaaagtccccaatttcc

SEQ ID NO: 23551 - DNA, 1042 bp, Homo sapiens
ttggatgaaaatcctcatttgtcttgtaaacctccaaggtggatgtgatctcggcgaacaccagtaacagcgtgatgtttgtgactttatccagtgctgggcggaccacagatagagtccccaggtgctgagacactgactgtagtgtgctcagaggagggcggctagggcagtgagcaggaagccccaaaatcgtccctgtcaagcccagctggggagccgacagtgccttccctagaggaagggtgccaggggtggtcatttagttgtcctgacatgatccgttggccccacgagcagcagccaggtctgtatctgagagctgtaatttcctgctgataacaggaacacagataaggggcaccccatcccagagtgatattaggttggcttttgaatcaccaggctccttggatgtgccttaagcccacaggtgccctttaagcacctgccgtgagggcagatgtgacagatcgtgtttgctctctgggcagtgagtgggttttgggtagcttctctccaggaaatgatgaatcactcggagctgagcaagtgccagagaagtcttcaatcacagactgaacccaggagggtgtttcggcctttctaagtccttaagggttgtagggaaggttttgaacaatggcttttgactttaccttctgagaggctctgtcagggagtggtgatgctgcgggtgagagcagttttgaaggtgtcacatccagggccaaccctgagccttgcttctgtagccacctcctatgggaggtcatgacaataataagattttgcatgtgttgtccaggagcaaagacctttccaaactagtcgttgtgttgaccactgaggatgacagcctggtgggctcagtcagagccattgtgttaataccctgctcccacacacatagctggtaaatgccagaagttaacactcacagccaggccttccgacccccaattttgtgtcatttctgcttttcagtcttacccttaggtgtcacagctgtttatttaaactgtttgcagtgaattttgtt

SEQ ID NO: 23552 - DNA, 1017 bp, Homo sapiens
atttgtcctaatgctctccctccccttcccccccaaccccctgactggccctggtgtgtgatgttcccctccctgtgtccatgtgttctcattgttcaactcccacttatgagtgagaacatgcagtgtttggttttctgttcctctgttagttttctgagaatgatggcttccagcttcatccatgtccctgcaaaggacatgagctcattcttttttatggctgcatagtattccgtggtgtatatgtgccacattttccttatgcagtcttatcattgacgggcacacaaatgaccttccttagcacaactctttaactgggtgcagttctgattttactgctaggttttgaattaggatgaaggaggggaaggtagtgggtggatatgcgtgtggtgcagttggcaaaaacaagccctcagcacaggatggtgatcacttagcctttgtcaggagtgctgcgaatgtcttttcccagttcatagcttttaatgaaaataaacttagttttatgtcattgaatgtattgtttcctctgtagttgtgctttttgtgtattaccaaagtcttctctgacctgtgggcatgaagacagtcctcctggattttatctgaaggtgttgctttcacatttaggtctatagtccactaagaatggatttatttaggtagaatgaagtaggggtgcagtttaattttttttttcctatatggatattcatttgtccccacaccatgtgctaaaaagactgccctggctgggcgcagtggctcacgcctgtaatcccagcactttgggaggccaaggcaggtggatcacgaggtcaggagatggagaccatctggctaacacggtgaaaccctgtctgtactaaaaatacaaaaaattagccgggcatggtggcaggcacctgtagtgtagtcccagctacgcgggaggctgaggcaggagaattacatgaacccaggaggcggagcttgcagtgagccgagatagcgccactgcactccagc

SEQ ID NO: 23553 - DNA, 1030 bp, Homo sapiens
taaaagtaaaagtattgttggaaaaaaaaatgatagtttaggacaatagtccaaacctaggaacttgaggacctcatttaaaaatataaaatgtattggttccctcccctggatatactgaatcagaatttccagagaataggaattagaatctttttttatttgtttgttttttaagaaaagcagctcctccaggtgattctttttggttttggttttatttttgagatgaggtctcactctgtcacctaggctggagtacagtggtgcctcatagctcactgcagtctcaaactctagggctcaagcaatcctcccacctaagcctccagagtagctgggactgcaagcaagtgccacagtgcttggctaattttattttttgtggagacatggtcttgctatgttgtgcaggctggtctcgaactcctggcctcaagcaatccttgtgtctccgcctccgaaagtgctggattataggtgtgagctactgcatctggcctttactctcctgatactgtcctttggaagtcttaattttgatgaaatccaatttatctgtttttctcttttgtcatggtgttttgatgttgtagttaagatagactatgcctaacccaaggtcatgaaaattttatttgtgttgtcttctgagttttatgtttaggttctacatttaggtctgtgatacatttagagttaatttctgtgtatggcatgagaaagggttttaacttcagtcttttgcatgtgcatatccatgtgtcccagtgccagttggccagtcattgaaatgagaaacattcaaacacaaaagggtactgtgaaaagtgagtcttctttcactcctttccccaatttctagttatcctttctggaggcaacgttttaaattgatttttgtatattccttcagggcattttatatacatacaagtatatatgtctgaaaacatagattgaaaccaggttttaaagaaccttgaattatcctaatgtagaagaatatgtagatgagaataattttttc

SEQ ID NO: 23554 - DNA, 1033 bp, Homo sapiens
ctctagaccacttgctttggagatgtcctggaactactataaccaatctcaaagctatgtgatgacagctctgtgcagtcttcacgcacattaatcactcgtttagaaacgaacttttaattgatgtgacagcaaagacaagactgaatttcagacatgtaaatattagaatggaggggatctttctaatcaccttgttcatgcccttgttttatgagagagaaagctgagtttagaggaatgcacattcacatggcctggtggttagaactggaaatagaactcgggtttcttcagtttcagcttttactctttgggctggctacctttggaggatgactctcaggtccaaattgcaaggccagagaggaatcctggatagagctcagcaatggtggagatgtttttttcctctttaattacttactgaccaactggaattacccagggaacaagagttttcaaaggaagaagccacatgtaaccagactagccgaggagttgtttggagacctgacttgctcttttttcctgctcatatcaccattaattctttcctttattctcagtcttgcttccagatgctgattccttcaggccatcgtattaatgccaagaatgcaagtaactgttaaaagtcgggttaagatgtggtcactgggcctgagggatgctaattgcctgcctccttcgggattgcctttcccaggttctggtcaacggggtacgagtcaaagtgatgtgtacaacttccgggccttgtcctgcccaccctgtccctcttctctcaggctagaacttggatgtggtattagtgagcctattgccaccattagaaaagtgtaatacttggggagtggcagaacaaggcagaggaacctggtggccttgggaaagagagctgcccaccctctccgaactgcctgttataataacttgatgttatctgagctgctcatgtttagggctctttgttacagaactttagcctctaccccaactaatatataaaacactagaggcccttcaaagt

SEQ ID NO: 23555 - DNA, 1029 bp, Homo sapiens
gtctgcttgctcagtaggtccgtgccatgcacacagcttccccaggaccatctcctgccttcagggtggctttcacagcagcagtctcctatggcatgcaaagcttttgcagtgcatggaggccagcagcacccagggctagcaccccatggtactcccagcctcagatgtgtttatagcaaattgtctctcatgaaacacttttccttgagcagcttccccttgcacccaagagggcaggcttccagcaagttttgctggtgtggcaacacaatggcttctcttccgtcttgtgagcactggcctctccaataaggtctggacctcagtcctgaggaacctcttgcttgggtgctctaccttagtctcaggtgtagtgactcctctttgtgtttgctcttcctatattctctgatgctccctttacttctaactagacagtccctcactgtagttgataagttcttattttagatattccctgtttaaattgctgtgtgattttcctctactgattggaccctgactgatacacccagctactgcactgggtactgaggaatgactagaatttggataagcaaagaggaaggagaatgggagatttcagctagaacaagagcattgagattcatgtttttcatatttatattactttcttaaggatgaaagatgatcgttaaatattctgaatctgattataaattccttgaggcaaaaactatgtctgattcttccacaaggtgtataatattggaatgcttgatgaaagatcaaaatcttgtggtcactggctggtcaatcaatttaaccataactgagactggaggagaaaaacgtcattgcagcacttcggagagaataataaattaataataaaataatgataataatgttagaaaaaatattgagtgaatattatgtgccaggctttatattactgagcgcatatgtaaggacttgcaaaacatctataaggtaaatataattattatacctgaagcactgaaaggttgggcagcttgacta

SEQ ID NO: 23556 - DNA, 1028 bp, Homo sapiens
taaaatgtacatttcacataattttcctctttcagaactaaccatggttaatcattctttaaaccaggtttgtttccgacaaaagaaatgaaataataaaaactaaattctaactgtagtaatcatgtgatattaaagatattatttatggggttaaaagccctctttatcttgcttaggggtttccaataatcgaatcagtgctggactttttttttttttttttaggcatggctgccccctgttaataatatatttaattaacagctttacacaatgatcttaatatacttgaaatacttagaggactgcagtttataaaatcaagagtctaccttattgctgttttatttttttttttaccataaccctcagaaggaatacagttaacatcacagtcctatatataaatgtgtgtttatgtgtgccatcataaacatcactgcactaggtggcaatcttcactactattcatttgtgtatgtgtagtcaacctacgaaaggaatcattagaaacagggtaggaatgttgaaccttagaaccggaagttgccagagaaaatatgtgccctggccaactccacaggactagttctaggcaatctgaaggaaaccagaaaatgtgaatttctcttccctcaaaaagctatactgaagtagtatttaatattcaagtacttgtaaatttgcagaacagtactttttaatttgacccatgaattctatttaaatttgtcacttaatatttagccaagaagcaaaccatctaaaaagatttctggtttatttctccaactcctaataaatagggtcacatattttttaacttttttctaatttgaaaagtaatacaggcatatggtattttaaaaatgaaacaacacaaagggatatgttttgaaaagtggttcttgccatccctgaactgtaatcatccctaacatattcatacctgttttcattttaaaagttgggtcagtttttttattagtacatgtatttctatcctactgatttatttgctatat

SEQ ID NO: 23557 - DNA, 1050 bp, Homo sapiens
gacacttaatattataagcaagaatagaataatgtagtaccacagcttgaatctcagtaaactgttactctagattaagagattcacatttatgtttgactatctttttaaataaatataggagttattcttttcttgtattatgccattgtttctttcactcttttttctgttttttagttttcagtattctttgtgcacatgctcaatgctattactgttgctaagtcacgtgatcattgggataagccattcatatttccatgcctctcagcgttgtgctgggttttgttcatggaaatatttgtatcttaagatgcacaatctagtgctctgtaacaaataggtataacaggtgagtgatgagttaagtattatgagaataatcccatttttttaaatgtagtgtttaaaaatagaaaatgactggtattgtaggtcttactatgtagttcccttattatgttcctactgattatttctgtatccttacaatccgtcattttacctctattcccaagagaagtataaagaagaatgacatgtaattttttttccatctgagctcaggagaaaggaaaatatagcagggtaataaaattattaagcctaatttgtaatttatatcatcaaagaactttttttaaactgtgaggaaaagaaagcaggaggaaagaaacttttaaataccacaaaccattattttgtaattctccttctaaagtaaaagacgatttcctaaataaaattatatcataattaaaatctataaacagcccaatgtttaatttaagaaaaaatttgctgacttgaactcacagaaaccaactttagctacagtggtatttaaattatgcattagccatagctatattgaccttttgtgttttttaaaaccaaaactgctatgtatttacattgttctacttaaagacttttaagactatgtactaacttgatttgccttcaaaaacttaaagctaatgctaatacaagaagaatgatattcaagatatctaataacgtgtatgccaaagacataggcaatag

SEQ ID NO: 23558 - DNA, 1034 bp, Homo sapiens
atttaaaaaattggggaagttttttataaaaataaaatttgttggtgttcttgacaaactaggtgatctggccacgtgatacccacagataagggacaacagttggccagtgccctccttcagcaagaccggtgttccctagtagttacagtggccaggtgtcctcctcctctcattttgggtccctgccttgctcctgcagacattttattaatattttgtgaccccagatttaagatttgggaagaggacacagagtttcacagaaaactaaacatgagtagtcagacaagtgggagagaacacagcaaatggtgttagtgaattgcagaagcagaggaggtcagtaggacaaatgctatggacagatgcagatatgcagattgggaagtgtcctttcggtttggtcacctggagatgcccttagcaaaaacgcttaaaaatggggtattaggtcaagaattgtagaataaaaggaagggtgaatgtagaaaataatttcaagaagctgtgttacagagaggaatttgaggttgggagactgtgtgtgtgtgtgtgtgtgtgtgtgtgtgtgtgtgtgtgttttaatgtgagtgacttgagtatgtctatataaagatgtatttgacataaaatagtactttatttgtccttgacttacatttgataagaattacaaaaggtctagtcttagctttgattgacagattattctaaaactggtggtttttatgaaaacaaagccctccagcttataggatgggataaagtgctttttatacatctatgcgaagacagccctgcccctttagatctttactagtgttaaatgcattttttactagtttaatatgtaagcagccatgccttaagatgggtaattttacattttaacaactgtaggttaagtcaagcagtgttaatgtggtgatttgccacgtacacttactcatgagtgtgtgcattgtccatttccttttagtattagccaggtggaatctgtatgatgatcttatcagccagcatcacttcta

SEQ ID NO: 23559 - DNA, 1044 bp, Homo sapiens
ctgaagccatggcccaagctgtaccatggccccttatagccatgactggagctgaaatgtctgggatgctgggtgccatgttgcaaggctgcacagagcagcggggccctaggcctagcccataaaaacttttttcctccaggcttctaggcctgtggtgaaaggggctgctgccaagacctctgatatgccctggagaaattttccccattgtcttggcagttaacattcagctcctggttacttatgcaaatttctgcagccagcttgaatttctcctcagaaaatgggtttttcttttctatcacatcatcgggctccaaatttcccaaacctttatgctctgcttcccttttaaacaaaaattccaatttcaaacgatcttttgtgaatgcataaaacagaatgcttttaagagcacctaggtcacatcttggacactttgttgcttagaaatttcttccaccagataccctaaatcatctctctcaagttcaaagttctacagatctctacagcagggggaaaatgccaccagtctctttgctaaagcatagcaagaatgagtgtttgttccaggtcccaatcagtttttcatctccatctgagaccacttcagcctgggctcattgtccatatcactaccagcattttggccaaaaccactcaacaagtctctgggaagttccaaacttttccacatcttcctgtcttctttggaatcctccaaactgttccagcctctgcctgttacccagttccaaagttgcttccacattttggggtatctttatagcagtaccccactctctgtggtgccaatttatagtattagtcaatttccatactgctataaagacatacacaagactgtgtaatttataaagaaaatatgtttaattgactcacagttctgcagagctgaggaagcctcaggaaacttacaatcctgatagaaggggaacaggcatgtcttacatggtggcagatgagagatgagcaaagggggaagagcccctaataaaaccatcaaatcttgtgaga

SEQ ID NO: 23560 - DNA, 1034 bp, Homo sapiens
gccctttcctgtcctccagtttagctcttggctactttgctcatgctgtaaccttctccccatgcctaaaaggccctttctcttcctcttctctcaacatgttctcaacaagaaaacatgccagctttcttgttgatgactcataagttggataatctctcctagcaccattttactacctgctttccacatactagtgactcctcataatctttggggaggacatttaatttgtgaacattcactgccctttaattttgacttctggttgcattttagtattcttttccaatggactgcctcataacctgtgcaacatcagcatccaatcactgtaaagtgtgcaaatgtccccatgttttttctggtctatatctatgctggccctgatgttggtataattcccagagggtcttttacaacctcttttaggaaggcttcattgacagcctcaggctaggtttatgctatttctttatgttcacctaacactgcatattttactctgtcaaaggactttgtgattctctagtgaatttttcaatttactcatctaattttccaattatattgcaaatattgaaagcaggagctataaccaactcagctggttacccacagtgcttagcataggaacagctaataataggaatgtagaaaatgctgaaaaataatgtgacttgagccaggcatggtggctcatgcctgtaatcccagcacttggggaggccgaggtgggcggatcacgagatcaggagatcaagaccatcctgactaactcagtgaaaccccttctctactgaaaatacaaaataattagccaggtgtggtggtgggtgcctgtagtcccagctcctcgggaggctgaggcaggagaatggcgtgaacccgggaggtggagattgcagtgagccgagatcgcacaactgcactccagcctgggcgacagagcaagactctgtctcaaaaaaaaaaaaaaaaaaaaggtgacttgaatgtactaatttctttaacaaaatgtagagagacctatg

SEQ ID NO: 23561 - DNA, 1037 bp, Homo sapiens
ttatggaactgtgagtcaattaaacctattttctttataaattactaagtctcaggtatttcttcataaaagcgtgagaatgaactaatacagtaacctttgcttactttgctgcaaatctcctttctcacctgaagagttaaccagtaagcatatagaaactttcctggaacccatccttactccttattgttgtcatgtgtgattgcagcttgcccattcagataccttctgtttctcctatgagagaatcctatgtgtgtatctatatatgtgtgcatggacataggaaattgtaagtagttaagatttcctctagcatgtagaaattttccattatccttactcaaatgtcttccaaaatttgtacattaaaagacatgcctaatttttaactttgcaaagtagagtgtcctgtaaatgacctgtatgttattgcttccctagtgcctagaggaatgtgtgacaaattgaacggggtaagagatgtgtgataaactcaatttaatgtgatgttctctgtggtcctttcgaagcctaacattcattgatttattgattcagtgatttaatatgtatttgagtactactacatgaatcatactgttgtagacaatgggatgtaacagtgaacaacgaatgttctccctcattaaatttgcgtactgataaggaaagatggataataaatatacaaatgaataaataggtaatagaagtagtgagccagggggtgtgataaatgttgtgaaagaaagtacagtacagtgcaaggcacagagttggggtcctttttttagataggatggtcacatgaaactttcctgataagatgccatttgagtagacaacctggagggagtgaaatgttaagtgaggcatatattcacaaggtaagcattgcaggcagagtagaggcaaaagtgagagagtgatttgggttttaagaaacagcaagcccacagtgttccagggcagagcaaaggaggtaggtgaggaagttgggaagtggagagatgtaattggagtctagctca

SEQ ID NO: 23562 - DNA, 1060 bp, Homo sapiens
aaatgtttgtataataactagtttcccttgtgagcttcggtatttaatttcaaatatataatgtctacctgagaactccacctggcactggcagcccaacattgagatttacctatatctcaaattctgcatgactccaattgaattttttcttaagaattttttctgacttttcttaagacctccttcttctatcttattttacagtgccaatattctcaaatgcttccagcttggaaacaagaaacaacttgtgactctttttctctatttagccattcagccactattcgtgtacatttttgctccatatttcttacatctgtatgctgtttctttttcctcattagcaactttcccagagttgcagaactactcagatacagagccaggattgtagtccattctgcctgactcactaagttgtatcacctttctggcttatgcttgggtaacagggaacctttgataatatggaaatcaattccaaataatataacttgtaattttctggaacactttggaaaggaaaatactccatggactcttgttttgccttgtgtctgaaacataaaccagctattttttatgaggcattgacagagaaatagatggatggactggtttatttccctcaatagtatgcaatctcacaactgtctaaagatataaaggtttatacatgtagtaaagtatttttatctaaaatatttctattaaaaatcatcaaatgcattaagtaggataacttctaacttctactcccaaagttctattctactcagttttgatgtcttctcctaagattaatttgcttcccagagcctcatcctacctataaggtaaagtttataattttgagttttaatatccttttgtcttaaccataggtgatatccagtgaatgcttcgtaacagaattaataaataattggatgtacatgtatcttaggaagtaatatgtaaatatatattcacagtagtaccaattaactgattagtatttttccactttcttgccatttgtctgtcaagtagagagggagtaaccttaccaaat

SEQ ID NO: 23563 - DNA, 1050 bp, Homo sapiens
gttttcttctatttttcttatagtttgggccatgcatttaaatttttaattcactttgagttggtttccgtaaatggtgagcaatagaggtctactttaattctttgcaaatggatattcagttttcacagcaatatttattgaagagagtgccttctctcctttcttttcaatatagcattggaatttatagccagagcatttaggcaagataaagttataaagatcatgtaagttggaaagaaggaagtcaaatttccctcttagtagatgatgtagtcttgtatgtagaaagccctacagactccactaaaaagtgtaactgtcaactagtaaatgaattcagtaaactttcaggaaagaaaatcaacatataataaccagtaacatttctgtatgtcaactatctaaaaaagaaataaagaaagtaattctatttacaatagctacaaaaatttaaatacctaggaataaacttaaccaagaagttaaatttatctcctgtagagaaacagctgaaattgtggaaaaacagacacacgctcttatcatgtgagtggctgacctgcaacgaaaggtgcatgcacagcctcacctactgttgaggtgtctactgttaaaatgagagcattgattggaaaagaatgggacccttcaacttggaatggggttgtgtcataggatgctggtgaatctggtgacactgagtttgtaaactctgatgaaccttttttgccagaagaaacagcttcctattcccagtagtggcaacatcccctccctgacccatgctgccatcagcctttccacctttatctgaggagataaaccctgtgctgcctgaggccacagtgatggcctctcctgaggcagtttccaggcaaaatattgttgattcttttcaggagccacccccaacatccccgtttgcttctagacctataattagatgaaagtcccagcgggccgctagaggtgaggttgagagtgtgacccatgagaaggtgcaccacacttgaaaagaactgcttgagttctctaatttgtatg

SEQ ID NO: 23564 - DNA, 1047 bp, Homo sapiens
cttcagtctttgggggttgatcctgtttattactgatgaaacatgatttcccaaccccatgaaaaaatgcctaagtgccttgtaaagtagcacagggggtaacccaaactattttgatgagttagaattcaacaagcttgaaacatcagtttcttctcctttgatacagcataggagcttaagaacagtgggcaagggaggtagctcagtcttggagtgggagctccatatgtgaatatgtgcatgtatgcatgtgtgtctgcacctttgcgtttgtgcacctctgtgcacatatgcggtgttgggtatgcggtagggagcttctacttgtctgtaagacaaataggtcctgaattcagccttttgctcttctccaaactttggagcagttatttctcttagttctgctgaagctcataagaaaagtgagttttgttatagattttcctagaactgactaggccatatgtctggttatatcagctcctttggaatctctcagatctagagaaaatgatgaagtaattccagtaacctgccttaactctcctttattgtagtaaatagcttctatatattgagcacttactgtgtaccaaatgttgtttagatattttataaccatggccacatgtaattctcagggtaactcctcaagatgcatattattatctctatttaattgataaagatatcaaggctaagagaaataaatggcttatagccccagagttggtaagttgttgagcagggattaaaaccccaagatgcctcctgcaaactcagtctgatttcctctttaccccattattgaaaagtctctcttactgtaatcctctgggtcatatcagaatctttcctggtcccagatgagaaaaactcaaattcctcttcactctaaaaacactgcttggtacagtgtctctgctaagcctgctcagcatgcaaacaccccctgaagctccatggttggctttacccacagccttcaggagctcagcacatgtcaagcccttcagaggattttgggctgcttaagggaatctt

SEQ ID NO: 23565 - DNA, 1036 bp, Homo sapiens
cagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttataaaatggctcttgtggtttaatagtgtgtaaaaatacccttgtgaatttggaa

SEQ ID NO: 23566 - DNA, 1050 bp, Homo sapiens
aaacagataaccatggcgcccactgcccccatttagggagaggaaggtgtttgtgctgatgttgcagttagaggcacgaaaatcaggtagcaacaacgggttaggaaattcgaagttccagaatgggagaaccaaaggggtactcgagcatgctttatctcacccccttttgtttctggcccgatgtggggcatcgcttccctggggggctgagcgccgcgtggtgcactccgtgacccactgcaaggctgtaatgcccttcccgagggtttgtgttgcatggggccgtttaccctggaactgctgcaaaaagcatctttctttttttaacttttaaaatttaacgtgcccctgcttcatttttgaaagggaagttttgtctgaaagtagctgttgtggagcttcccagatttctgcaaaggtcggtaccgccacccccccccccccccccgccttttttttttttttttttaatcaattccaataggaaatgttatggaaagtggaaaggatatttttcttttaaacggctgagtctgatctaacaggatattggggtgggataggatctgccaggttcggaagctccccagttggtcagggggaggtgggagccatgcctcgggtggctcaggaggaagttagtgcaatggcccggaatggggaaggtggggctgggggaggggagctactgcttttcctagagacctgccaggaggttttcctaagaagccagggaagaggctctcagggcttgaaaggcaaggaggtgtcctggggcccactccagccgaggactccggcttgccggccaggtaggcggaagctcccggggccgactcgggcttgtgctagttatcaagtaagtcggcctccgctttttacctgctttcgctgtgttgttgctgtagttgttggcagtgtgatagtaacgggaagtgaagccactcaaaaatgcttttgtcagacttcaactcacaacccagacctttagagcagggggaaggtctgccccttcccctcatcggctccctggcttggctgctgtgc

SEQ ID NO: 23567 - DNA, 1125 bp, Homo sapiens
agaaagctcaggataaaatatgttttctggaggggaaatactcaagtgttctaagccaggaacagagactctcaagagaggaattctctggcattctctgccttggataaatcatggattaaacatgagcatccttagaataattttatttttgtatttcactttacactgtaatgcaaacagcttttatgttttctttgacgaagaatcataattgagtcactttaggtcttttagctggaagcatttcaccctaaatgaaaagttaatgcattttttacaaggattaacatgctaactacaacttgccctttcagcagatgacaataagggattctgaaaagtttggactgtctttttctttttgtatacaaataaagcagcagatcctttctctgtgaaggttgttgcagagctcccgtaccagcttataaaatgcggctgtttaagcaggacttgggtgggcagcagaattctgcacatgacgagtggctgcagcttagaaagcaaatttcatctgattccagtactgtgattttaaggaaacggtaaaactcaaagtgccagtaatgccatcaaggctcagtaacatgccatttcctcagcagctaaagacaaaaagaattattttggtgaggggatagaaatcctttcgctttgcagtgacacccactttttcttagcttggcttgggagtaaggagattggagtgtggggggacattagaaactcatttaaggcaaactgaaatctccttcatcagcagtcttcctgctggtgtagccacagcagaactccgaggcttgcaggctgggctgtctccttgctgcctggcttgggtgtttatttgggcaatgcaagctgacattgtgaggtgttgccgatgcccaggccagctagcagggagccctcccagggctggtagaaacctatgtgtatatatattctcaaatttaaatagattgtacatagtgaaatgtaaatgacatgtaaaacagcaatctctatttttcttaactattatatagcagtatatatttgttgaacatgcttgtatactcttcattaaccattttaatattttgtacagataagttgattaaatattttattcataaaaccgct

SEQ ID NO: 23568 - DNA, 1033 bp, Homo sapiens
ggaggcaggggcagaaggattaacctcctggttaagggtgcaatgagccaagattgcaccactgcgctccagcctgagtgctatagcaagatcttgtctctaagtggtatgggagggggaaagctacacctttgttgcaaatagatctgggctcaaacactagctggctacctggacatgatgcaatcataggcaagttaatctcttggagcgtagctacctcatatgatagcatcaagaatacctttgttgtcccatgtctgccttcataggcctgttggaggtgggagggtaattcctgccttccagtaacatggacaaatttatccgtgtgaaagccagtttcacctgaggtcagtttcctctgctgccccgtttctgggcagtacctcatgtcatgacatagataatgcaagttgagagtgtgtgggtgacaacttcaactgttgctctacagtagagacctgtggagacaggacagactgatcagggtgggctgtggtcactggggaacctcatgaagcagacagaatttgggggccctccaagagaaaaagtatttatgccggtttccctctctccattcagaaaccgtactctatacacccccggtccccaccctaagtccaccaggtcactgacagctaacaattgaccttcacctgggagaggtaagcttgcaaggcccagcttggacatgcacctgtgatttctaaaggacttcttctgaattcatctctgaatgaggttggcggcactgctatggtgtctgagcctatacaggagccgagggctatgtagtcatcagagcctcagtttagaggctcacatgacagagacatggagtgtggagcccatctcagcaagtcagggcctgacgcgttatgcccgctcacatgtaggcacaggagacctgggacagaggaagcgatctgctcctgcctgaagtagtgggaggggcaggaaggtgcattgctgagcagagggactatctgctggtccaaggagcctctgtccggctggactgaggcta

SEQ ID NO: 23569 - DNA, 1100 bp, Homo sapiens
gttgagcttgggtttaaattcattcacagccagacaaacgtgagtatgaagaaccagtcagacatcactttccccattggtgatccctgaaggactttccattcgcagcacaaagataaccccttgaagagagcaaagaagaagagaaaggctgaccagaaatatgaccgtaatatctaggcacttcactctccgcagctgtactgagctcacattatattgtcatcttctccagattaaggccttctatcagttatgggaaaggcaaggatttctcctaccctgattcttcctagcatatggctggaggtgggggcggaatctccccacatccccacacagacggcttgtgaatgttctgatggtgtgcgtttcctccgttggacgaacaactcatcttttactctttgctttttatgccagtttgggaaggttgtttttctcccacttgaaaatcttcctcggaaggaatatgttgccatcagcaattcctctgtgttgtaactatctcctatgaagccagactgtaaggcagtgcgtcttccctcaatagaacccaagcccattcttcatggttcagcaaatctctgagtgccttctgcgtgccaggcactgtgcttggtgttggaactcgacagggagcaaaaccatgcctggttctttccctcaaggagtttacagtctagtgggggagacagatgtttatcagatagtgcaaaaggcaataaacactatgaaggaagatggtcagtgccattacagggagctccgcctcttcttggattcagggagtagggggaactgatctgagatttaaagaaatgataagcttagcatttaaagggagggtgagctggggaaggagcagggatgatgcattccaggcagaggagatacatgtgcaggagagagtatggtgccttcaaggagatgcgaaaaggtcagagaaactggcattaagaaaccagaggggagcatggcacaggcggagagtggagaattaggagggagaggccatgcagggtttgtctagccgcataagtatgctgtgtctttattgcaagagcactgactggctgactgtttttaagcaagggaat

SEQ ID NO: 23570 - DNA, 1293 bp, Homo sapiens
ggcaggggaagcaggtgtggagtgggttcaggctggctgggtcctgcagactgggtggaaagcatgtcagctgaagtacagaggtcacacagggagagcaggaggggcccatggggctggagagctcaatttgagcctctttcccccaaaggtatggggacccactggagatccttcagccagggagtgacccatgatggggcttctcattctggtgtgttatcccttgacaatgggggaagccacatagcatagccccaaatgcccgtctacagatccttgccggtctcagactggtctgcagcaaacagaggaaaatactgacaccatgcagtgagtttttcatagaactaaatgcattgcatttaaagtgctgtccttattctgagactgtgttctatcatccaagattctttgtagcaagcaacagaaaccaatcctgggtaattgaaacagaaaaggaatttattaaaaggatattagtcagcccagagtctccagggtagttggagaaccaggctcagaggccacatggccaggaatgacaacagtcatacccagatcaggccccacaaggccccacagctgccctgctggtcagacctccagttggtccagaacagcaccaccaagcttccaaaagtgggtgctgcaaatgctgcagttctgcgctctccccactcctatgggtcaccagtttctgatataaagtgtgtgtcggtgcgtcctgttggtggagcaagggaggtaagtgaatttgccattttcagcttctataatgcaagacgggcttagcttccacagcaaggcaggggcttagctgtgtcttagcttcctagacacaaggcaggggctcaggtgctgagaacctgcccaggaaggaaaggtgtttcttctctgtctctttgagtgtctgtgcatgtgtgaattttaaaaacgttctttcttttgtgaagcgaaggtgattaggttgtttgatgtttaaagcattattgttacttggcagaatatgaagttggaaagctattatttgttcccacaagttttggaggtttagtagtccatgaaatccaaaagactaggactttagtgccagacaggctgggcctcaatcccagagctgccccttactaatcaagtagctttgcatgaaggtttctgaggtcctgttttgttgttgttgttttttaaatccccttagtctgtttatgtatccttagatctaaaggtagtctttttatttttttttttgacatagactctcactctgttgcccaggctaaaatgcagtgg

SEQ ID NO: 23571 - DNA, 1028 bp, Homo sapiens
cagaaaggcagggtgactcgctcagtagtgtagacaaggctccagcccaccctgtaattccactcaatgtttcttccacctgttccaggtcctttgagcccctgcagtcctcctggtctgtcacatgctagacaatggttggcacctgtcttgtggtgtctcccggcatggcctggattgtagtgatctgtggtctgtccattgctgaaggggtgtctgctcctgaagatcacatggtcagggcagagccggaggctgggctgggggcccagtagggcctccctacagagcacagggaagtggaggccgtctctgcctctcctctcctctcctcctcttttggggtggctgctcctggaggggagaagtgaaggatttctggtacaaagtcattctgcttgtcctgaatgtcaggaaggaaggtttagacaagattgtgtgtgtgtgtgtgtgtgtgtgtgtgtgtgtgtgtgtgtctgtagctgtgtgtgtctgtgtgtctgtgtcggcatgtctgctttgtgtgtctgagtgtgtgttcatgtgcctgtgtgtcttggtgtgtgaacctgtgtgtgtgtgttatatgttgtgtgtgtgactgtgtatgtgtgactgtgtctgttagtgtgtctctgtgttgtgtgtatgtgtgtgtgttcatgtgtgtgtgtgtgtctgtgtgcatatgtgttcatacatctgtgtgtgtgtccatttgtctgtgtgtatgtacatctctggctccaaagaccaggtctgtgtgtgaatgtgtatttctgtatgtatgtgtgtatctgtgtgtctgtgtttgtgtcagtttatctgcctctgtgtctgagtcagtgtgtctgcctttgtgtgtctgtgtgtgtcatatgttgtgtgtgtgttcatgtgtttgtctctgtcagtgtatctgtgtgtcatatgtcttatgtctgtgtgtgttcatgtgtttgtgtgtctctgtgtgtgtcagtgtgtctccctttgctgtctgtatgtttgtgtgagtgtgtcagtat

SEQ ID NO: 23572 - DNA, 1068 bp, Homo sapiens
caggatggaggctcagcttccaggagtgattctcaacaggacactgcatggctggaccctcaagattgctgcttccacagtcaggaaagttgagaatcaggactctattgcaggaactgtcaaccccaggaacacccactcaaccaccttctggggaccaggagaggtgaccatgactgtttgcttcagagttggcatgccttttgctgcacctgcaatctgcttttcagcacacctgcaaaactggtgactggtctccttgcctgtgcttgccagagaacggcagaatctaccaccgtatggcctccacctcatttccttagcttctcaaagcatatgcaaacacgtctgcttggtagaatcttaaacacatctagaacctggaggtgcaaaggaataggtcgttgtcattttgccaactttggcatacagcaaggcacatggggaggaaggtccaatggatgttgattgagccagtctgcagacccacacattaaataacttcccagagcttacacaggaagtggtggatccaggatttgaagccaggctgtgtgttcccagcatctaagctctgtgaagtgtactgcctcacaggaatcccgtgagctcatgcttggggctggctggactccatgacaaacatgtcttctccatattctgtttcttcagcaggttcacagctctagtccatgtgtctgtatggtacaaggaggactcttgagctggctctgaatcctttgaggactgattttgatggtgtctatctaatggctattgactggttgtatccattaccctttgatctaacaatgctgcctaacaagtcaccctaaaattcactgacttaaaacagtagacatgtaatattgttcgcctagtctataggttggctggttcttctcagctgggttcactcatgcatcagtggtcagctgcaggtcacttaggtggctctgcttatcttggctgggacctgtcacatgcttggggttagctggctgatctctcactaagtaggctggtttctcatcctccaatagtccagccagtgtgttcttatagcaa

SEQ ID NO: 23573 - DNA, 1050 bp, Homo sapiens
ctggagggtgactgccaggttcactcatgccatcagccccgcctttgtgtcctcagtaatttttactctgagcataatcacagccctcgttgagaggagccactgtccctgttggtcttctttctagaagtatctcttatatactgatatacagcagtgcatttacattgttaactgtaaaaatgacaccaacacatttagaaaggccaccagataaaataaagaaaaatgtatccctcaacgctgacatacttactggcttgcttttggaacgttcttctttctgtcttcaggtgctagaactttaggagagtaagtgggctctgttgagggactctgaagactggtcacccccccgcccacacacacacacacatcccccagcacttgagctgcgcttccacataaccacttcctttatgctgggactgtggtttctttgtgtgtttttatgtcttttccatgtctgggtctgggtttgcctcccctgagagaccgtaaacttctaaagaacaagaactgtgttgtctccttttataggagtgtatgtttcattaaaaaaaaaaaaagtaaaagtaaattttaaaaaacgtttcttgtctatgcctacgatgttcttattgacttgagggtttagacagtgtctctgaaaattctctggcaaacactccctggccccaccataaacagctggttgatgtaaccacaccgtagctcagtcaccacgtcacaggagctgtgtcttcttctgcccgggaactacctgtcctgtgtgacagaaaaatgcagcggttgccagccaagggcccacaggcaggattcccctgaagctgtgggactttgctaacaatgcatctcccacattgaggcttttcagaaatgcgattgaaaatagaagtgtgggtgcagcattttccttcctgccacatgggaattctggggaaagagctcaccttgaaggaacaaccttgctgggagtgcagtggggggacctttcccctggagccggagcccctgctgggttctggcagccccaggatgcccactgag

SEQ ID NO: 23574 - DNA, 1098 bp, Homo sapiens
gttttaaaacgaattttatttttatgcttagtaggatggattttatttaaacccccaggcagactccatttaaatctgtctataaattgtatagtcttgatgtttttgtataactttgatatacattctttacaaaatcccggttttatttttacaagatgaagattatacattttaaagcagttatttcgtcagctttttctgtctccttgtataatcatatcagaggactgaataatgatttcgttatttcatttgcacagtctctcgtgactgctaagcactctgcttgtagttcctgttttttgctattcctctgttcttgcgtttttttctgcaatctctccccgccttgcccagatctcttcctcaatgatttttttttaaattttgtacaacaaatattcctcggtgcctcctgcccaccagacactatgccaggtgccaagtgtagaatgcagattaaacagccaggttgtctaccccttggcacttggcatggaattccgtggcgcctttccattaaagagggctaagggctgtcagctgaatttgacaactcgtagaaacaggaacagtgggttggggggggggcatttatttctctcgcatctgcagcctctgtgcaatcagtttgtcatctctgaagacaaatttattgtgaattaaataagatcaccctttgatgtctcttgaatgtggcctcttctcaggcctggctccttctggtagagctgttgtctttagttgctgacattatcaataacaaaatcttggcccacccataaaattgtcccacttccataatccttgacctcttgtgactgattagtaaagctctgtaaaaaggttacctgaaaatatattttataaataccgtgtattatgattcagagttacacctcgtgcctaaaatatgttcttcaactttaacctattttaagttgaaatagttttgctagatttggttggtttatcattactgttgttatcaacattggtttggtctgttgttagtgaaggtctttgttaaaaagcaaataaataagtggaaatccagttaatgtaagatattttggtttgtgaattttatttgcc

SEQ ID NO: 23575 - DNA, 1029 bp, Homo sapiens
ctgagggcaggagtacctttctcttttgttcactcatgtattcccagtgccttgaacatactgcctgacacatagagggaatcaatatttattaaatgaatgaatgaatgaatgagattctcaagcacctaaaaatggtttgacccctatctcctagacctctctgttcaccagcacttatctgccaaggatctttcccagaatacatcgatcaccagtattgccaataccttgtggtcaaagtgatcagtttctccttgtgcttcaccttggagaggaaatgtactcgccactttggttctgtgtcaaaattaaatggcgaccttggctgattttgcttccccgcagaggttatttcttagtcgtaaagagaacattctatccttgagaaaaataatatttttgccaccttcagcttgaaaatggctatttgatatggatcacgtgcatctctatcagcggccgctggaaaagcttaggttgagaggatctgagaaagactcgttgcgttgtcagagggaagctgaccataaggcagaatgagtttacaataacttatttacctgtccaaatccttcatatcacattaaagctttcccctgctacccgggactctggagtgctaagaggaaaaaggaaaatcaattgataatgatatatttggtttaaaaaaatatattgattcccaggtaatgacagtcgtgcgttttgcagtgggggatgccatttcccgttgtgaagatggctttctcatagattacatttaaaagaaggaaccaggagtagctctgcctccccgtaatagatagcctctttctcctaggtattaaatctataatttaaaaaaaaaaaaaaattctccccagggaacctattctttgcctcctcaaggtcttcttgcccattgtgtgaaaaaagtaatgatttgtttttgtaattctagagtttgtgtccttttcagtattagattaaagacttaaatgttttctttttccccattgctggagtttcttagtttggattagatgg

SEQ ID NO: 23576 - DNA, 1113 bp, Homo sapiens
ccctggcccactctggggacctctgcagccccttcttcaaataggtatgtgggcgctcacacccctgaaaaggccgtgtgaccacacccactagctggggcccagatccctcaacagaacctcagccgaaccctcagccctacacaggcatcatttgggattctggtccgttccctgcctggtgccctgcagctgctccgcacctttccatcaacagggctgcagacccccagcctgcgctgtccacctcggtgtcagcaagtggcctctcctcctgcttcctgtccatcttgctcgtgtgagctgccgtcctccagctccaccgcctcctcctgccaggaagggaagctgttggtgccgcaggctttccttggctccctgtatccccagccctccctccactccctctgcttcagctgttcccagacttgactcccagatggcacctctgtcctaaggtccggaccatttctccagtggctcatgcgtagcagatccctgctgtctgattcacatatcagactctacctgtccaaaacaaagctgcttccttgctctccaaggaagccttgtactcgtactgtctcagtcctcctccctccctcccttagccatgcatctccttctcctttgccttaggctgctcaccttccttcctggaccctgagctcactgaggacagggatcatcctcttttctctacaagcccggcacagggccctgttcatgcatatctcttgggattagattattttattcagttcagagattacagaaccaccgacagtgtgtcctcataagcagcgtggtggcagggaacctgggattggaggcaagctctggattctagtcccaaatctacctctaactctgggaaagccctataaaaccttctgagcctcagtcttctgagctgtaaaacgggaataaccacggccttcccatttctcaggaccttgaaaggtgacaagggaggaacggtgccaccagggccagcagttcttagcccttggtgcacattgaccggagtgctttaagaattacagatggcccggccgtggtggctcacgcctgtaatcccagcactttgggaggccgaggtgggcggatcac

SEQ ID NO: 23577 - DNA, 1045 bp, Homo sapiens
gcaatgatgctgagtggtcctgacaacactcggacagcacacagtgaatacaagagaagaatttttatatttcctaggctagtggaattaaaaccttcctactctgcaggataaatggagagaaacagaatctctttttcctaagcagttatctaagtgtgatacttagatgtgagcaaggtaattaggctttgtttttttccgctgcttggtcaaaagcccccttctcaaactacttggctccaataccatgggggaaaaaacccacctacattgattggatttaaataatggaattgccattaatatctttcataaaagatgattgatttctgactttggatttatggaaagttggggcttgtaaaagtgttcagagtggcagtcattcagtattaatgctggttcatacccttccctcctcagggctggttacatggatggctcccaacctaaacccccccatgccagctgctaggtcacagggatctctggagggtgtaacgggcagccctgggcccatccagttgccagctgtggtggtccaggaggctgggctgaaccctagccctctttccttctttacatcagatttttttttacctaatatgatttttttttattttactttaagttctgggatgcatgtgcagaacatgcaggtttgttacacaggtatacatgtgccatggtggtttgctgcacctatcaacccatcatctaggttttaagccctgcatgcgttaggtatatgtcctaatgctctccctcccctttcccccaactctatatcagattctagtatgaaactcagtgctccagcccctagggacaccagcagcttccacctgtgctctgtggaagctcactgcccctcataggatggaggaccactgatgacccagagaggccctctgcaggtgggtgggtatgtgaatgacacagcctctgagctctgctctcctaccctgggagctcagatggactggcctttagtacagggacctgcgcgaatgtggtctggtggttcagtatgagttcctgt

SEQ ID NO: 23578 - DNA, 1033 bp, Homo sapiens
agcaagataacagtgaatgaaaacatctctgctctaaagtagatattctccccagcccttcccagcatggtctggaagggaacagcaggatattcagacagtgccttagcaaggaaggacacagtggtgcgttcgtgtcaaacactggtgtgcagaaggtagggagtccaggagggcttcatggaagagggagacttgactgcgccttgagatgtctggaaggagtacagagggctcttcaggagtcagaacaaacagataagtgatcggaagccgtggagaaagtttaattgttagaatttccatttattttggtgtgtatgtgctatgtttaaaccttaggaatttgcataccacttggtatcattttattagatcctagttttgtaggtctagaagtcaagaccaatgttaggaaaactgcccttgatatgtagagacacccacctggccatctcctgtcttccccagcagaaggatggagaaacagacaagctcctgatagcagtgacatgatgcatatgtgatgggcaaccaactgtgactctgaagccactttaaacactgtttctctgatttaaaaacctgtttggagctttggaagttgatttttaggtttataaaaaaactggactattttgagtttggaaacataatttactatttccaagaaaagagttttaaaaaccgattactttccctaactcctcatccccttgcgacaatttataaaagagaaatcaggatttcaaatcctgcacgtggagtgagtagcttttttgagttcagttcacgaggttgcactttgacatgctttttaagatttgaatatttttataaatcatgattatgctactgtttaatgagaacaaaagtggaaatcgcatctgtttgtctgcggcggagcatctcccggcctgtgtgtgctgtctgggaaagtggtggcccagtctggagagctgacgagcagcttgattagctgaaattacttcctgcagtagtttgagggtgtcagtcctgggatgaactgggt

SEQ ID NO: 23579 - DNA, 1260 bp, Homo sapiens
ggaggcagtgacagctcaggccagtaatgggtattcttgagagcaatcccaggtcatcaagggaagagaaggttatgcttcgtatactgtgttcaggggccagataagttttaatacgttccagaagtgtgctcaagcaaaaaaaattattagaatttttaaaaattaatatttgtgcttaaagagacaaatgtcagagatctagaacgttaatttatttggaaaaagttcaagcagagggtgagagctctgatcgcccaccagccttagcattccggagttttcagggtcggagtgggggccacttctaggcactaagaagagctacaggcagggatgtctacagggtgccccactgcccatggggtcagaggcctggagctttaggcaaggcctcacctctgggcagcaaaggcggctgtctggagccccggggcctccctagggtttccatggttaagtcccagtgtttccagttagggaggctggagggagggggcacagggggcagggaaagaggcccagccttccctgaaagggagtcatggctcctgtttgcagctggaactggaagggggtaggcactaactgggccagaaaaagaagctggagcaaggttctagtgccggggctgggcttggattggactcagtaattctgggcctctggggctggctgtcctcgagccagcatgtgccgggcacaagccaggagccgtggcagctcccctcagtctgctcaggggccttgtgtgcccagcctgtgggccgccattctggccgttgaatgtgcccaggcctctcctcctcaaaccaccaagctcagctgatggccctggtgacccagctcctcccaggcagccaaccgaagcctccacggggcaggcactgagcagctttgatctgcccacctgctgccatgagggggacagtcatttcagagcatccttttgcctctcaccttcccgctgggaacaaaacccttaaatcctctcctcccctctaccagaatgctctgtcttctctcatgtttggctttttatacactatatttgacagtgtctctcccttcgaggttaagtgtcgttcaccatggtccctcactttctgctgctaggggcctttgcaggtggagaaactgaggcccaggcactgagaggagatctgagagccctgtgatgcagggtgtcagaggagacaggccttgtcctggcaagctgtcccctggaccctagcagctgcctccccgacctccgtggag

SEQ ID NO: 23580 - DNA, 1079 bp, Homo sapiens
atggggaaatgttaaatttggggagggtggaaaaagggtcagagagacagaacttgctgactcctattttgggactagttctgcaatccaatttcttttttcttaaacaatcttatagaaatctgccagagacaatgaataaaggcagaactccctggtcgaagcagagatgcctctttctggagtccctgaattacccatatgggatctgaggcttcctctgagccagtttgaaaatgcctgccctcggaaatcctccttgccttctgagccacgccctctgtcagggtgggcagggtccaggagagaagggaccgccgcttctgctagaaccaggcaggtttcgttttggatgatcattaccaaactcttggctcaaatgcattgtttaaacttgacttttctacattctcccaggacctgagtactaactaaggcctgagcaggtaagctgaaccgcttgacgtgataatccaaactgacaggattgtcagctggttacgagtctcctcctccttcccacgtcactcagaggacaggagggcagagggagagatcggaagtgctgggcattaggatcgaggatgcgctgggtgcaggacccaccgaggaggtgtggactctggcaagagggcctaaaaaccccaaaaggctccatctatagactttccacgtcagcctacagccaccccaaattttctatgattattattttaacaacacataggccttatttttaaaatctgctgcacttgagcaatttcatctgacgtcagctggctgccggcaactctgcttgaaaacaagaataaccaaatcttctaaggagtaatgctgaacctgcttcaaacgcaataaatcacaaaaaccattgtttacaataagtggtatctgattgctgttagaacctgtgtttattgcttttgtgcattatggtctcttgtaatttggacagccagaaattgtattcctttatgcagtgcgtaggcagggtttgtaaggggggaggcatctgtaattatgctgccagggagtgaggttgaggagcctccaaggagcaagaaaatgcagttgcctgt

SEQ ID NO: 23581 - DNA, 1024 bp, Homo sapiens
acccaggcaactggcaggggtggccaatgcagtgtgttttcagagcttagtatgtcatcagatacaggggaccctgcagaatgagggctagaaaagattggggccaagggatgaggcagcagagtgacctggaatcatcaggaagacttcatggaggaggcaagagctgagctggaggaggagtgaatcatttatatcaagatgtgaaataaagctattcctgttgttttggggcctcaggtgaggccccaggctgtgcatgaaaggtatccggcacccccacattagaaagaggagctagacagccccagggcccgtctctactcccatgagaaaagctttgggctgactatagggagcagcgatcctagaagagagctggcctaggagggaaactgaggcttctccccctctcccggggaggagctccccactctaccagcccctcaaccagtactctgtgggagctgctgctaccccaagactggggtaccccaagcacttagaaggatgtgacctgtgttccttggaatttgggggacaccaaggctgtgcctgaatcttaccaggaagtgtccagatgcaaaaggctcccggggatatctggaacatgcagtggagagcgagggttgtgctggtggcagtaggaccagagttggtcatcaagggagagttatggttgtgagtccagagtggacactgcacagggagacagacttgagccatctgggaagaccctgcccaggaggacagcctgccagggtgtgaaccatcagagccgcctgagggagcatttccagcagagcacacaccctcgtggagctcccgcagagaacccaccacagtgccacagcggaaggagggccggcaccgggtctctgcacacggaggctgtctctgcccgtttacatcactctgctcacaccttgcccttgtgctcccagccccgctccctggccactctggggaggctgaagcagcagttagtgagaaggaggcaaaaccagagaagggcgatgctgcc

SEQ ID NO: 23582 - DNA, 1014 bp, Homo sapiens
agccctgcttcccattaataactgtgagtgttgccggccacagagcctggcagaggctgagacaatggagctattggaggctggctcggagcgcactgacatcttgctgcagtgccttattgattttattttcctgttatgaaaacaccaccccactgaggcggggagggaaagaatgttggacaggggagaggagatggaggattatttgggcacgctgcccccaggccagccaaacacattcctcccctgggcgccagcccgagcgctggtctgactcagtgacctctgcccagtagggccagccgctggacctgctggccacatctggcaggcgctctgcagggccagctgttggccatatggagaatggcagccgctggaaccgactgctcggggctccaggtgggagagagaggctgggcccggaggccgtcttgaaagtgtctgtccttttaaggatacatgcctttgtagggatggtgttgggctgctctgggggatgaagtggaggggctcggtgctggggctcccccacagggctgtgctgcctgcagagctcccgctttgctccagagtggcttgatattcaccatccttgactggcctgatcccaaaccacagccacatgagaggaagggaacccagtctcagacagaaaacaacagctggggcaaggactgggcagggtggccaggagggggagagggggcgaaagttcattcctgtgaggacagcccgctccttggcatgtcacaacagaggaactgaattctgcctccagcccggcctgtttcctgcaggggcttgtttgattccccggattaagccctggtcccttggtgcccaggagcactgggtggggggaagggaggacagcagtgctggcttcccgagcacccctggcagatttgggccacagtgccttcccgccgttctagcctggctcctgcccacccagaggcctgtcccctagcctatgtgtctgaccccgtgccaagaccacatcaactg

SEQ ID NO: 23583 - DNA, 1024 bp, Homo sapiens
tgaacttgctacaatttcccagttccactccccatcccatccaggtagggatttaagctatatttcagggtggtaaggtgggccacttccaaaggaacccatctcttcttgaaaacattcaaactgatgagaaagcagaattttactttcagggcactccccatgtagtaggttaaatagtaccccaccccccagccaaatatatgtccacccagaatatctaaacgtgaccttgtttggaaatagggtctttgcagaggtaactaaagtaaggctcaagatgagaccatctagattggggtgggccctaaatccaatgacgagtgtttttacaagagaacagagaaggagatttgacaacacagagaaggccacgtgaagacggagcagagatgaatgatgccaccataaagcaaggaatgcctggagccaccagaactggaagaggcaaaggaccctcccctggagcatccagagggggtgtggccctgctgacagcttcacttcagacttcggacctcccaaactgtgagaagggacctttctgtcctgtaagccacccactgtgtggtcgtttgttgccgcagccccagaaaaatgataccccatggacaccccatggaagggtctcttcctagcatctccttcaagaaggtccatccgcgtgggactggatttttgcaaaacatgctcttgatgctgtgagtttaatccaggagcagcaggctgacctgctgacctcgtctctgctgagttgaaatgaaacaccatcacaccttcttccttggtgtcgaaaaatgtttctacaagcttcctaatgatcacctgcctgcttcctataacatatggactccaatttggaaaagtttcaaagggcgattaaagcgagaagctctagtactcccatgtccctctcagaagggaaggagctgggtgcgtcatttacgtgcagtggtgtctccaaggaggggcagacttgtgagtaggatcagacactcgatgtggcctccatttaaagggagcc

SEQ ID NO: 23584 - DNA, 1051 bp, Homo sapiens
gagctcaaatttcagttggggccctattagtctgcctttccaaaaagggcgttgggactttaatttaaaacttaaccagttgaaaaataaaggtggcgtggaaatgctttttgatttgcagtaggtcaagcgattgtctctcatctgtgactagagaagccagcttgtgtgccattcactttaatgagtgttatttaaatgcattgagcacatatagattttcttaagaaacttacaagacaaatctttctttctctaagaacaatttgggggtgggagcaagctgtaggattttttttttagatgatgtattgaaagctaattaaaaatagatttcatgtgtgcaaagtgataagggaggaaaaaagaattcgttccatttgaatcctgttatgaagtacctaagacatttgtctcgttgttggattggaaccaccgagctaacacatggggagaggtgtggccaagctcaggcctcggtgagacctggagtcagtgttactaccccaggatcccgtgaacccagctgtgcgtgcctgatgacagagcacaggctatgaatgcagctatttctacccctgccttctttggcaaacagtttttggtggctcagaggatgtatggggaccttttaaagccccaagctccaggcctagtggtgagctgcagaaaggctattgtgtcttcacctgcgtggctgggagtgaagagtcaggctgcacctgctcccacctgcttctagaccagaaagcaaagcccgtgtcaacctgagcagggaaaggtatctcttcggacttcatattttgcaggggcctagggtgaggggtcatgaggatccatctacaggcttgtcctcccttctgggaggccgtactgggagagagggatggttcagccccttcctttggttctccagctcctcccttcctattctggcactggacttccacctcatggcacaccattcatcctcgctgctgcattcatccctgtcttcacaagtaacagtgatgagatcttgtgaaaatactttgaggcacagggaatagct

SEQ ID NO: 23585 - DNA, 1050 bp, Homo sapiens
tccatgcacattccagaaatctttggtctgtgaacctctagtcttagggcttactttgtttcagatcaaaacctgcttctgtcctagggtggaaatgggggtttggggagtagaggccagaagtggggtcctctgaggacaccccttactcccttttcctgcttgtctctgacaaggcacccctgccagctcttcctgggccgaatgaatttgagagcttcctgaggaaggtttgcaaattttcagtggcatccttaaatgtacggaattcccccaacccgggcacatgcatttagattctgaggacgaaggcagttcgtgatgtagcgtattcaaggctctcagaatcctaaaaggtcacagtccttttattcttgcctcttttcacttctttactgttcttattgatttatttgggcacataagaaaacacagtaggcaaagcccactacttctattgaaataaagtattctgcagtcaaaccacacaccataaagaaataattgcagtctgtatatattgctaatggacatctctcagcaattccctgtctcataagctttaaacacagacattagtataaatatgcagaaatccccattcgggcaaattactctgcatttctgaatggaaggaagattaaccatgtgctgatatcaagctttgaaggagcccagcagagcagaaagaattcactggccctctctgggagggaggttgggactccctgagagagttttggctggcatctcctcaccccctgggcccagtgctcccccagagcactgagagctgtgcctcgggagtgggggaccggcctcgcctaagaaggctggttggtcaccgggatgtatttgctgagccttccgggctcctgaggctctggcaggagcaggagcaggaaggctgaaggtggatgctttggcctggcctctcagctgcctgacagaagcccttaggggtggtccaggcctctgaggccaatgggctttgcggagccacggggcagttcgtggagccagctggctgtgcgtctcagcccctcaagc

SEQ ID NO: 23586 - DNA, 1672 bp, Homo sapiens
tgtgctagaggaaacagaggcccagaaagctggggtgctggcccagggtcacacaccaattagtggcagtgctggaacaagaaccaggatccaggtcttcagaatcccagcccagaattctgtcccctcccctaccgcttcactcaaaaaggggatgtcatctacctggctcgtggtttgggcattaattcggctggtgactctttctggagatacgtgtgagcatggcagctgagccttatccagcctggccctgcaactggccctgtgctgtctcccctccgcctgggctgtgcgcaggcgccgctgggctctctaccttgtctctagcccaggcctctatccaccgcctcctaccccatcccccaggtgtcccacaggccccaccccacaactgatcttcttgttccctcccttcctgatgtcccaccaccatcccctccaaaaacctgttagtggtctccatgcctccccctccccacttccttcctgcactgagccccacggggtccacacgctcctgtttctctgtcctgctgttgctgtgtaattccggccttctcacctctccctcggaaagaccgtcaccatcagcagcactgcacactcccacccgctgagcgctccctgtgtgcccgccacatgctgtctcatggaaccttcaacaagtgtggaccctgaggctctgaggatgtgggtcccctttcccaaggtcacagagctgataggaggcccagtgcaggttcaccctcaggtctggcttcgaggctcaactctctgcacggcgctatcttgcctcccattggcctcccaagccactccccatcctgcctctgtgtggatttgtctgaaacccaagtctaaccttgccacttcctgtccagaatcccctgtggctccctggtgccccaggatgaagctggagctcccaggcaagactgttgcgatctggccccgcccaccgcctcattgtgttccctgttgcccatggcccttttgtccacctgcacctgccccctcgtgctcctgcaccctcccacaccctcccgcaccctcccgcgccctcccactggtgctctgagcctgttggtctctgtctgtagctcccaccccccttgctccgggtctgagctcaccccacgtagatccttcctgaagtcccagccagagcccccttccgcacccctggagatgctctgctgtgactccagactcagtgtgacttggggttggcggggtcagtgattcggccttgccatggctcccagagggcagggcccccaaccccgatccctgaacatgcatgtggcgtgttctccaggagcccctcccaccgtcttccttggtcttcagcagagcccagtgtgtcctcaccaaaaagggcctgcctggcaatcagggagcagaagcaggatcctcaatccccattttacagatgcagaagcagaggctcagagagacaaagggtcttggccaagtgtcagaagcagggctggggccaggaaggagtcctggcgggcagccggccctggcccatgtggacagcaacaaccaatgaggctggagcaggggcgatggccggtggggctggagagcagggctcagctctgcaggccaccctctcccacacacctgccaagggaaatcgcctggcctgaagacagtctaggtc

SEQ ID NO: 23587 - DNA, 1048 bp, Homo sapiens
tctgtgccagccccaggtccaagacaccgggcacaggtaggtgtgcagcagagtgggagcctccgaggccacttcctgggatctgccgggctgtaaagcaggctctgccccatgtcaaagccccaggagagggtgggtgtcctgagagactcaactgggacatgggaggaggcgcagagggtccctgtcccttgcttgcttgctttcccgaaaagtccccacaagtgtgaaacagaaggaggtgcttgccaggcctcccatggccccctcctttctcggggtctcctcccacgccatggctgtgagtgtctaacataagggacgctgtttttgcaggttttgtggttgtgattcctttgaaccatatccagcccatcttacatcacagtgccatgcttgacttggtctccaatacatcggcacccattggcatttggagaacttgctccgtagttatttgacagtttttagttgtctgtgataatgtattctctatgtttccaatcgtcagtatgggaatctctcccccaacctttcaatttctgggtttgattttttgtatcatatttggtttttttgctttttaaagttgtgattcctttggttattagcccctcccagtggctgcttgtttatgcattatgtttgtgacttcttttgactgtcagtgttgagccagtcttgccaagaaacaatatcaagtatttcctatttctctacttcttgaaaaaagaaaaaaaactttttttaattaaaaaaaaaaaaactcttaatgggaacctggccctgtctgtcttctctgttctgcagaaatgttgaaggaattgaaccagcaacgcagagcgaaagcgtttacagacctgaaaattgttgttgaaggcagagagtttgaagtccaccaaaatgttctagcttcctgcagcttgtatttcaaggacctgattcaaaggtttgccttccttccagctgtggtcgggtctgttcctttgtaggacgcttttgtgtcgcttttctcttcccctctcttgcaggttcctgaagcgtgact

SEQ ID NO: 23588 - DNA, 1024 bp, Homo sapiens
tcactcagccatggactgtccgtctgcccagcacccctccccaccgggggacttcacggctcttagggtcagtgcatatgtgtgcgtgtgcatgtgctcgcacatcctgaagtccccctgggctcagcccttcactggctttgagctcctctgcctgaggactcctgggtggacaagtgggctggccagaggtgaaggcagcagtgactgggggcctcgggagaaggctgtggcccagtgtgacctccacagggcagaaagggcatgcagaggagaggctggacagcggcttgtaggaatgaagtcccaggcagcaaagacaggagtacgaggttgaccagatggctctggggccgggggtgttgaggatttctgtgattttaagtgatcacgtagtgaattatttttacgcttaacaaagccaccgaggtatggaaatccatcctgacagcagaagactaggtgtgtgaattcactttagaagtcactctgtgttggggggtttggaggggcctctgtggagtccacaccttgccccctctgccttctgggctggccccgggcttggaggcagaggccccttggggtcctggtgggatgagccgttgtgtggggagggcctactgtggccacgctgggagagaggctggacgccagctccgcagcaggattgcacctccccctctcctcctggccatgcctgtgctgaggccctgggagggcggtgcctgacctcagagaatgtcgctctaatggtggaatttcaggtactgccacgtagggaagagtctcgtgggaagggcattttccagcctctgtcacaaaatctccaagggaattcagacctcatctagttccatcctcttattttgcagaagaggaggctgagggcccgggagaccaaggctgcccacctgtgggtggcagagcccaggcacccagtgcccccagctccctgccccctgctctttccgcccacccacacacccagcagctggcctctctgcggccagcctgctcgctt

SEQ ID NO: 23589 - DNA, 1099 bp, Homo sapiens
tacatggatatattgtacagtagtaaagtcagagcttttaatgtatccatcactggaataatttctcatcatccccccacccccacccccacccccaccccaaggatcgctactctttgctttgcacttgctgcacactgtgaaggatacaggaaatgtgtaagtcatggtacttatcctcagcgatgtcagatctggtaaagagagtgaaaagaaacagtaataagcaatatcacacaatatgatttaaatgccaaaaatctaaatgcttaggaggagactattactaagggtctaatatttcatctttatggtggaaatggatcttgagctgggacttaaaggatagttaggatttgaatgcctaggacgatgattacaatgtgaacaaagtagtagaatgaacatgttatgcttttgagataatgaagaccagatctaaactatggaaatattttattttatttttattttattattattattactgtttttgagacggattctcgctctgttgtccacgctggagtgcagtggcatgatcttggctcactgcgacctccgactcctgggttccagcaattctcccacctcagcctcttggtagctgggattacaggcgccctccaccatgcctggctaattttttgtatttttagtagagatggggtttcaccatgttggctgggttggtctcgaactcctgacctcaagtgatccgcccacctcggtcttccagtgtgctcggattacaggcatgagcctctgcgcctggcctattttattttattttttgagatgaagttttgctcttacgcccaggctggagtgaagtggcacgatcttggctcactgcaacctccacccgccgggttcaagcgattctcctgcctcagactcccgagtagttgggattacaggtatgcgccaccacacccatgcgtggttcgccgtgttggccaggctggtctcgaactcctgacctcaggtgatccacccacattggcctcccaaagtgctaggattacaggcatgagccaccatgcctggcctattcattattttttagttgacaataattttatatatttatgggata

SEQ ID NO: 23590 - DNA, 1047 bp, Homo sapiens
atagaaccagaccttgtctcaaaaaatatctatataaggattgttctaattttctcctttccatatttgtaactaacttctacagtgcaaggcctggctccagttataattaacacatttatttaatcagttttcctatatgtgaccaatgtcctttttccactgctgcctcctaccccacatgtaagccttcctcacactgcttgggctttgactctccttgttgaattccaatatggattccctcctcttcctgctaggctctctgacacatcatcaccccagggcaccccttcactggaatgccctctcacactgcttgacttgaggactctatgccagtgacctcctctgcttggtagactgacattctgggctgcctctaagatgctctcctcaccactgtctggttctgacacactgcagtcaactgctcttccatatgaatgcttttttactctgcttgggacaacctgctctgttgtgatttttactgggcaatagctgactgattcagccatgtaaacttggactgttacccataaaggtagactgaataattatttttataatggaagacagtaatcaaaaaatatttgcagctgggcgtggtggctcaggcctgaaatcccagcactttgggaggccgggggggcgggggggcggatcacttgaggtcggaagttcaagaccaacctggccaacatggtgaaaccccatctccacaaaaaatacaaaaattagctgagtgtggtggcccactcctgtaatcccagctacttgggaggctgaagcaggagaatggcttgaacccaggaggtggaggttgcagtgagctgaaatcacaccactgcactccagcctgggtgacagagtgagactccatctcaaaaaaaaaaaaaaagtatttgctatggctgcacacataaacatggatgagtcccaaaaacataatgtagagataaagctatagaacacatacactatgattccattcatgtcaggtttaaaaaagtaaaactgtccttaaaagctactaagccatga

SEQ ID NO: 23591 - DNA, 1032 bp, Homo sapiens
gaggcgggcggatcacgaggtcaggagatcgagaccatcctggctaacatggtgaaaccccggatctactaaaaatacaaaaaaaattagccaggcgtggtagcgggcgtctgtagtcccagctactcgggaggctgaggcaggagaatggtgtgaacccagggggcggagcttgcagtgagccaagatcacgccactgcactccagcctgggcgacagagcaagactctgtctcaaaaaaaaaaaagaaaagaaaaaaaaaagaaaatgcatttaataccctgatgaacccattgtaaagttgaaaaatagttacgtcaaagcattttaagtctgtatattgtccagcttttatagcaatatttttaggagcactacttcaataaaagccatttcatcaatgatcaaaacaaaatcctcttattgtctttttattttttatttatttgtttttttgagatgaattcttgttctgtcacccaatttggagtgcagtggctcaatctcggctcactgcaacctgcaccacctcccaggttcgagcaattctcctgcctcagccttccaagtagctgggattacaggtgtgcgtcaccacgcctggctaatttttttttttttttttttgagtcagagtcttgctctgtcgccaaggctggagtgcagtggcatgatctcggctcactgcaacctctgtttcctgggttcaagtgattctcctgcctcagcctcccgagtagctgggactacaggcgcgtgccaccatgcttggctaattttttatatttttagtagaaacagtgttcaccatattggccaggctggtcttgaactcctgaactcaggtgatctgtctgcctcagcctcctaaagtgctgagagtacaggcatgagtcaccatgcccagccctcttaatgtctttttacactctgctgaatctttagttatgctgcatttgcattcctattgttgttcaattatgccttctctttttctgttttcttttttctttttctttttctttttttttt

SEQ ID NO: 23592 - DNA, 1046 bp, Homo sapiens
aactatccagtgaattactgaatggttggtatccctcattttcattaccggcatagttaaaacagatggtgggggaggcaaggatgttagctagggtcaatttctgagcacgacctaccatgtagcatttcaatgagagaaaggccaaaagtctgctgaactgtactgagccttagtttaccatcacagagaagcaccgctcttttttcaacaacaggacctagataataaggtttctgcaaataaaaaataaaagttgttaaactgattgcagaagtaatcgagttaacatttcttaagaaaggaatgtgtaaatagttttttaaaaaattcttatctattaccactaatcaactggacttcagttttaaggagctctttgctgcattatttaacacaactaaaaaatccgaacaaaacagccttatttttccttttgttctactctttcctcagggttcttcatcactaggaactggctctcctagaatacaactaataacactaaaaggatgatggacagcagcctgagagacacaatctgacggtaagaacaccttcttggctgtttcagatatagctaagacacctcatggtttattaggaaaaaaaatgccgagagagtgtcctaagtggtagagtagcagaggatttgcataaaataaacaaaccatggtcaaaattcacatagcttagaaaaagcacaaataaaaataaatgatttgtaaattttaaagtcattaaaaattggctgggcacagtggctcaccccttagtaccaaaagtttgggaggctaagatggacagatcacttgagcccaggagttcaagaccagcctgggcaatatggcaaaaccctgtctttacaaaaaataaaaaagttagccaggcatggtggtacacacttgtagtcccagctactcgggaggctgaggtaggagaatcacttgaacccaggaggcaaaggttgcagtgagctgagaaggtgccactgtactccaggctgagtgacagagacagactccatctctaaataaataaataaa

SEQ ID NO: 23593 - DNA, 1047 bp, Homo sapiens
gactcgaggccggaagatggaaaggcgagagtccaagacacttccgggctctgtaccgtaaagggcggggcgtagcctccaaaaggcgagatgttccggtcggggaggccctgagcagaggaacccgggtggagagggcggggcctgaggagggcggagagctggggcgggtctcaggtgagtaactggggagcggaggaggcggggcttgagcagggttatgacaggtagggcgggacccaggtgagtagcgggagggggcggggcctgaggagggtgcggagagctggggtggggcccaagtgagtatccgggagggagccgggcctgagcaaggcggtgagctggggcgggacccaagtgagtaatggaaggggcggggcctgaggagggtggtggcggtggggcggggcccagatgtgtagcgggaggtggtggggcctgaggagggtggcgagaggtggggtggggcccaggtgagtagcgggcgaaggcggggcctgaggaggactgagctggggcgggacccaggtgagtagcggaagggatcggggcctgaggagggtggtggaggtgcggcggggcccagaagtgtagcaggaggtggttggggctgaggaaagtggtggaggtggggcggggctcagatgtgtagcgggaggtggtggggcctgaggagggcggcgagaggtggggtggggcccaggtgagtagcgggcagggctggggcctgctgtggtgcccactggttgcggggcgcgcgggcaggtgccggaggtggtgggcctgggcctctagctgtgcgcaaggcggaatatgtggggttctggcggcttgtgtcacggctgacgctgtaactatacccagaatctccgtccctggaggggccctcaggttgagcgtcagctgatcgggcctcagtaatccccgctgcgacgcccgtccggactcccacctcaaccccgccgcggcggccccagtccgcgtgccacccttccagttcactctttatttcctcatatcagctttaaacggctctggaggaag

SEQ ID NO: 23594 - DNA, 1047 bp, Homo sapiens
tcatactggccttgtctctgcagagaaagaagtgcactaagtggtgagcatgatcagaaatctgtatgtcactacccctggccccccttccaagatcccctcttttttttttcaaaaataaatttcagaatgaagtcaggtttttgtaagtaaggagaagaaaaaggagaggccattagttttatgcaaataaactggaggtcacatgatcagtggatgttataactggtagagtccttagctatttacctcatctgaaccccttgctttacagatggagaaactgagtcccagacgggaaataatagtagtgggattaggaaccttgacgatggttcccatgcatcaagcgctaggctctgtgctcactcaccccagtcctcagaagctgtagagcagagggacttaaccaggagtgtgtggcagaaccacctgaggagtatttcaaagtacacgtgcctgggcccccatcacgtttcttttgtgccccgggggattctgatgcacatttctgaatgaccccaaccaatgcagctggcccaggtcagtaaatcagcatcagacagaagaaaattcttaagagtactgcccgctgtcagctccgggactctcagagtggaaagagttaagaggtctttggagccacaaagacctcagcttgaatcccagctcttctgattgctagtgtcacggccttgggcgtactgcttaacctcactgaacttcagtttccttatctgtagaattaagatggcgaacagggtagcctggggagtaagtgtgcccacaccccacaacaatgttagttccgccctcatctggaggcctgagtggctatggattagctcggggtggattctgctttacaagtactcccccttgttttgcatgaacaaagagggcgccctgggtttaggtctgggaagccccagcgcagctgcctgctgggtgtggagcggtgcacgccttcacgtctggtcaatgtccactgagtgctgttgagagggaggctctggagtcccgcccgccccggcgcggctgagccct

SEQ ID NO: 23595 - DNA, 1032 bp, Homo sapiens
acagactgcctccttaagtgggtccctcacccccatgtagcctaactaggagatacctcccaggaggggccgacagacacctcatataggcacctgcctctctgggacgaagcttccagaggaaggatcaggaagtagtatttgctgttctgcaatatttgctgttctgcagcctccgctggtgatacccaggaaaacagggtctggggtggacctccagcaaactccaaccgacctgcagctgagggacctgacagttagaaggaaaactgaaaaacagaaaggaatagcatcaacatcaccaaaaaggtcatctacaccaaaaccccatctgtaggtcaccaacatcaaagaccaaaggtagataaaaccacaaagatggggagaaaccagagcagaaaagctgaaaattctaaaaatcagagtgcctcttctcctccaaaggatcgcaactcctcgccagcaaagagacaaagctggatggagaatgactttgacaagtcgacagaagtaggcttcagaaggttggtaaaaacaaacttctccgagctaaaggaggacgtttgaacccatcgcaaggaagtaaaacccttgaaaaaagattagacgaatggctaactggaataaacagtgtagagaataccttaaatgacctgatggagctgaaaaccacggcacaagaacttcgtgacacatgcacaaccttcaatagccgattcgatcaagtggaagaaagggtatcagtgattgaagatcaaattaatgaaataaagcaaataagacaaggttacaggaaaaagagtaaaaagacatgaacaaagcctccaagacaaatgggactatgtgaaaagaccaaatctatgtttgattggtgtacctggaagtgatggggagaatggaaccaacttggaaaacactcttcaggatattatccaggagaacttccccaacctagcaaggcaggccaacattcaaattcagaaaatacagagaacaccacaaagatactccttgagaagagcaaccccaaga

SEQ ID NO: 23596 - DNA, 1512 bp, Homo sapiens
tggcctcccaaagtgctgggattacaggcgtgagccaccgcgcctggccagtagtttcttaacattaaattatccgcaaaatggaagaaatactagaggtctgtgaagatgtttcttctctttcagtctgttgtggtggtttgtagtttacaggggcttgggtaactggatttttaggtttattattttaaatagtagactcaacactattttgtattgcagtagagatcacttatgcagatctttttaataccatttcatagagattaagtggtcaccttgaggcagaggagttaagaatgatctaacttaaagatgacttactcagtattttttcacaaaaagacaaatgtcccaagtttgttggtcctttttgtgaaacgtggctataagtgctatgttacctagcaaataaacacacttaatctgcccctttgagataatagggtaagttcttaacagtgattcaaaaagtaactacctttcagaacaacaacaaaaaatttaatgctgtagggaaaggatattgaaaatggatatttagaatttttcctgttatggaatttaattgttgaaaattatatgtgttaactttaagagctttttttatatgtatacttgaacttggaaacagaattttctaacctgtataaaaatcttttaaaagagctgtttagtgattttgagcccatctgctgaaaacacaaaaaggcaataccatctgattagtttataagaacaactgattgccatcagaaggtatggaaatgcactagctgaattttagcaaaaacctttgcataaatggtgaatgggattggaaattgaatatcatgttttattcagtgcacccagtaatggagttcttttggttttattcatatttgtgaggtaacattttttcagctatgataaccattaaaaccaaataaaatagttatatctcataaaaatgaaccgaatatagaactagaccttcaagttgttatattacaaagtatgaaagcaagatataaaaataacaaaccatgttcatttacattgctgtcaccaaaagtagtgagtggtattaatataataacaatattaggaaaagcacaaagtttttgtgtcatcaataagaaaagtaaatgtttaaaaatttgtttacttgctataatattctttttaatttccttttttgtatatgccatatctacataatttattgatttggtgtgcaatatatacaaattataaataagtataatggcttcctattcataaacttttaaaccatgagatatgtgataaaaatggctatcatgattctataccagaagttcctaacctggggttcatagaataagagcccctagataggctttaggggatctgtaagcactctgaaattgtatgtaaaattttgtgagtctatatatttatctggggagagggtctagagctttcaccaaatttctgaaagggtccatgacctcccccaatggtttaggatctctgtttttgtggact

SEQ ID NO: 23597 - DNA, 1032 bp, Homo sapiens
aaaacctagaaacagcattttttgagaattgcttaaataaaacactttcaatccattgctttagaaagaatcagtttttacttggaccaggccagaataccagagagtatgttgattgcattgttttagactgggatagaattgcttttacagaattgttctttggtgtaatgcaataaacatttattaagagctattaaaacaaacagctttatgaaatttagcacttctcttgtagaattcttgtgagggtattatctcctttatctcagtgtccttgttgatgttgttactactattacagtagtactgttactattagcggctcatctggaggacgaagactgaacataaaatgagctaatatatgatgggcaaatactgtctttagctggaagcaaatgcttatatccaaagggagacagctttatggatgaggggctgtgttaggagtatgggctctggagccagatttcctaagcttgaattctggctctctctgctactgcctagttgttgtgttacttaacctcttggtgcctcagccttttcatcgttaaatagggatgatagtacctgtctccacaaggtggttgtgagaattttgtgagtttacacatacaaaatgctgaggtcatgccaggtccagaacatatacagtgaaggtgagctgctgggttttttttttttttttttttaatgtttaaaataaatagtacatacttatggggtgcctatgatattttgatacatgcatacaatgtataattatcaaatcaggatatttaggatatccattacctcaaacatttatcatttctttgtgttggaaacatttcagatctattgttttttatcatcttcatcatcatcattagaatctatggtagtaattttttctccacgtctcggtaccaggaaaagctgtttcctttgaccagctggttcacttgtattacgtggtcatcatgacttgtaactgattgttatttctctcttaggaagggaactcaaagtcaaatgtgtgttcct

SEQ ID NO: 23598 - DNA, 1026 bp, Homo sapiens
ctggaacgctcacattatggtgggaatgtaaaaccatacactactttggaaaatagcttgacaatttttttttaaagttaaacatatacttaacatgtgacccagccattctactcttaagcaatttacttaagataaatgaaagcatatgtccatatacattttgaacatgagtttttattatagcaatgttatttttaatactcccaaattagaaacaatccaaacgtccttaataggtaaatggatagatgtggtatatccattaaatggaatagtactcatcaataaaaatgaaataaccatatgcccaacaacttgaatgaatatcaaaataattattttgagttaaagctgccaaccaaaaaagagtgcattctgtatgattccatttgttaaaatccaggaacatgcatcttaatcaatagtgaaagagtgcagttcagtgcttgtctgcagattgtgttgagcacagggaagtgtgggaatgagggatcataagatgcacaaggaaacttatgagagtgatggatattgcattatctggattgtggtgatggttttattggtgtatacatgtgtcaaaatttataaaactaaattttaaacacatgcagctgattatgtgttcattatgcctcaaagctgttataagtataacaaaataaaatgaaaaagtcttgtgaatgggaaaaggtcaaagtctgtgtagtgtcctacaaagctctatatgatctggcccttgttgtctttctgaccttctctcctattgttctttttccttgctcattctttgctgttccttgactattccaggccgcttcctgccttaggagaatttgctttagctttttttttttgacctccctgcttttgatgttcttttccccagatacttgcttcataacgctctcaactccttcaggtctttgctcacatcttaccttgagtatcaaggaagtctacctgtttattttttctctctctccagctttattagagtataattgatgaataaaaatgtta

SEQ ID NO: 23599 - DNA, 1030 bp, Homo sapiens
gaaaaaatttagtaatacaacaagatataatacagattaaaaaaatacagtgtaacaactatttacatagtgtttacatttattaggtataagtagtcttgaggttatttcaagtatataggacaatatgcataggttatatgcaaaccattttacataaggaagttgagcattctcataatttggtatcctggggtggggtctgggaactaatcccccacagatatgaggaatgactatatagtaaaatagttactatagtaagacaaatcaacatatccatcatctcactgttaaccactgtttccccatggtaagagcagctatcatctatctactctttgagcaaaaatcctgagtaaaatatactattattatagtcctgatgttgtacattagatctttagacttttatatcctacatatctgctactttgtatcttttgaccaacatcatccagtttcctacaccaacccttgcctctgatgactgttttattctctctctctgtacatttgacttttaaaacattccatatgtgaggtcatataatcttcttatttttgtgtctggcttattttacttagcataatgtcttccaggttcatccgtgttgtggcaaatggcaggatctccttttttaaggcttacataatattccactgtgtatatatatgtacaccacagttttttattcatttgttcatgattaatggacgactagtttgtttctgtatcttacctattgtgaataatgctgcaatgaacatgagagtgcagatatctttacaaggtggtaatttaatctcctttgtgtatataaccagaagcagaattgcctgagtcatgtggtaattccatttttaatttctttaggaacctccataacattttccataatggctgcactaatccacatttcctaccaacaatgtacaaaggttcccttttctccataccgttgccaacacttgttatctctttcctttttaataacagctatcctaattggtttaaggtgatatctca

SEQ ID NO: 23600 - DNA, 1032 bp, Homo sapiens
taattattaaaataaaactatatagagatatttatagaaagaatgcatatgcagatattcactttaattctagatagtacagctatgggtgattttaattttatttttatttacctgtattttccaaagttgtgtagtaaaaatgaattacttttgtaattcacacatgcagacaatttggcctccctttttcactcccaacacttgttgaattagtttaataatgtcttcttcactccaactattgctgcttagttcaactactcattatatctggataagacacggcagcctcttgactttgctgctcagctgccaagctcccttcctgaaaatccttactgatgcagttcttcacttgcttcactgttccatttaagtggctatatattaaatctcaaaaaccatcaagaacagaggaaattgtgaatgttattccttgtaactagtttaccatctggtctgaagaccttcagccaatggaattcagccaactcaagatttaatttaatatattcacctaaccttaaccaagtgacttttaaccagagcatggatagttatgcagatttggggtgaggagaggtgaaggaaggaagggtgggagagaaaatatgatttgaactcaggccttcacaaatctgtgctcattccttctgttctacctctacaaactgccataccttgcccttgctgggtgtatgttcccccctcctgtattcaataaacagttcattggttttttttttgagcatttagccagtaagaacaaataggcaaataatgaaaatccatccattttagtgccagttattctatcagcagatcctattagaagtatttattgaggcatgtcatgctaatagtcccaaagtgtaattatacttgcagatttttcttgctttcagagagtttgtaatatgttccagatggttaaataggaaagaggagacaatttatactgtcttttcacttatgattaaaaatttgatgttacttactacttatgttaccattattgctttgttggat

SEQ ID NO: 23601 - DNA, 1034 bp, Homo sapiens
actgcctccagcccctcctatagattcatattgaatgatgggacaatgcttagcgcccacaccaagtgtaaactttgctaccctcaaagtccagacatgcaacctttcatcatgggaattcatatcatcgacaggtactacttatttggagagcttcatatgaaataagccagttcacatatctcttattagagaaattttttatactcttgatggctagaaagcagaaattctaaattaggcgtaaaactagtgtgatgagtatatataatcaatatatccatattgggttttatagttttatcatgtaatagctttgttgttcataaagggaggtaggaaagctgaggctgaaaatctgctttttagagggtaaaaccaaaaagatggctaaaaatttacaacattccatatgtgaatcttataagagatttgtgagtttgttaacattgttatttttatttttatttttgaaagtgctctattttcattagggcatacttggtggctcctgagttcaagttgacaatttctcacagaaattacaaatcattaaactatcaacttgatttttgagtgccattgtctctaatttgttcccctaagtatgttttacactgatatatggtaaattcatgaaactattatcctatgaattattagaaatcctacatttacagtggtgaaaatgtagcattaaaaacaaagacatttcccctcacttcatctttttctcatctaatgtatttgcttattggaacatggtaatgccagtcacaaatctgttgtcataattatgaatttgagtaaaggactcactgaaaacctgaattcagtattgtggtttttttctacttttagtttaaattatgcttgtgagtggaattagcacagttctttttttttcatattgtgatttctctttcaaaacatctgctatgtctgcatatcactctttttaatttttacatcagtgacacagtattttccttacccagtcttcctctttggagttgaaatacttaaaagctgta

SEQ ID NO: 23602 - DNA, 1190 bp, Homo sapiens
ttactaaactccgaaaatagtgataggagttcagtgacagtggggcagctagaacttgctgaacaaagtacccgagaagagaaggatatgtagaaaatagcaacaaaaatctgaatcagggttcttttctatccttggctgaatactacactgtgcatgtattcaacgatactccatcaggtggggcaaagaacagtttgtgaaggaagaacaactatcaggaaggagtgagctgaacaactaccagaactcacacaagattggaagataatcaagtcctgaccaatcagagtcggtagaccttcttgaacatctgggacatttagtggaaaatggcctcactttaagagtggatttaccctagacctgctttgacatcttaaaaacaaacctcaaaaggatcaagcttatgtacaagtaaattaactgtctgaaagaacactattcaatagtttttaaagaagacaccaaaattcagacattcagcagcattatattcataatttccaacatataataaaaaaaattaagacacatgatgtagcaagaaactgtgacccatacccaaacaaagtcagttaatagatccagaaatgacagagatgatagaagtaatagaaaaagatttgaaaatagctattctaaatatgttgaagaacttaagggacaacatgaacataatgagggaagagatataaactacaaaaaaaaagagccaaatagagctggtagagctgaaaaatacagtatttaaaatgaaaaatttgttggaggagcctaccagcagattagacactgcaggaaaaaaagagcaataaacatgacatagtattagaaactactcaaattagaggagaaaaagaataccacaaaagtattgaaagacctcagtcacctgtggaacaatacaaagcagtctagtatacacataatatataaataatacataattatggaagaagggggagcaggtgaaatttttgaaaaaacagccaaaatatttacaaatttgtggaaatttgtaaacctacaaatccaagagtttaatgaatcccaagcaaaataaacacaaagaaaactactataagccatgtcataatcaaattgctgaaacaaaaatcttaaaaccaatcaaagaaaaatgacacattatgtcagataaacaagaaaaaactttctatacttagtat

SEQ ID NO: 23603 - DNA, 1050 bp, Homo sapiens
ttgttatgtgtgaatttgatcctgtcattatgatgttagctggttattttgcccattaattcatgcagtttcttcatagcattgctggtctttacaatttggcatgtttttgcagtggctggtaccggttgttcctttccacgtttagtgcttccttcaggagctcttttagggcaggcctggtggtgacaaaatctctcagcatttgcttgtctgtaaaggattttatttctccttcacttatgaagcttagtttggctggatatgaaattctgggatgagaattcttttctttaagaatgttgaacattggcccccactctcttctgacttgtagagtttgtgccgagagatcagctgttagtctgatgggcttccctttgtgggtagcccgacctttctctctggctgcccttacattttttccttcatttcaactttggtgaatctgacaattatgtgtcttggggttgctcttctcaaggagtatctttgtggcgttctctgtagttcctgaatatgaatattggcctgccttgctagtttggggaagttctcctggataatatcctgcagagtgttttccaacttggttccattctccccatcactttcaggtacacctatcagacgtagatttggtcttttcacatagtcccatatttcttggaggctttgttcgtttctttttattcttttttctctaaacttctcttcttgcttcatttcattcatttcatcttccatcactgatgccctttcttccagttgatcgaatcggctactgaggcttgtgcattcgtcacgtgggtctcacgccatggttttcagctccatcaggtcctttaaggacttctctgcattggttattctagttagccattcgtgtaatttttttcaaggtttttaacttctttgccatgggttcgaacttcctcctgtagctcggagtagtttgatcgtctgaagctgtcttctctcaactcgtcaaagtcattctccgtccagctttgttccattgctggtgaggagctgcgttcctttggagga

SEQ ID NO: 23604 - DNA, 1034 bp, Homo sapiens
aatcttggcccgtagaaagtctgctttgataccattaatgtccagtgtttgttccggatgagactgctgcggagtctagtttatgcctttctatgtggcccagtgtgccttgcatatgaataaggaaatgctctgaggccagaggctgcagggaagccagctcagagcatttgtcagtactctccaatcctggctatttggatccttctggaatgccttcaaaccatttgctctctttgcttgcttgtttctttttggtattttatccagcttgcatagttgttctcagagggcgggtcagcctggtaccttctgctgggccatagctagcagcgtaagccttggagccctggcacttgaaaccccacactgtccaagcacaacttacccagccttgcctcttcacagccacctgttgtgtccaccctgtgcttagcctagactttccacacaaccttttcttgctgctctctcagtcctgtccattcccatcaaaaatcgaattgttcttcagacctgtacagtctccacttctgattcctggcattgtgacccatgagattcttcctctgcagtgaattcatagcaataactgaccggccactgtagcatttcttgatgtattatatcatgtgccttgtatttagctttcatccagttgggggagggcggggatgttgtagtgtacctctttgtaccaagattgatttgctgcatatcttgcaggtgaaagcatgtattgccaatgtagaacccaaccaaacagtggagatcaatgagcaagaagcattggaagagaaattggaaaatgtgaaagccattctgcaggcatatcattttacaggttttgtttgtttttttaacctaatttagtctgggtctgcctctagtgagttagtttgctagatgtgttatcagtcctggaattatttcataatttatagtattttacaccctctgccctcatcactcacacacacacacacacacagacacacacacagctgacgtgctatttgtaggcctatcttcac

SEQ ID NO: 23605 - DNA, 1042 bp, Homo sapiens
aactgcagatactggtacaactgctcaggactttttcacagattaaatgaatcaacatacataaggtacctagcacaggcctgggcacatggaactgtgctctcggactctgggagaggagcttcaaggaaacaagtccatcccagaggctccctggatgacagggacaagactccttccactaggtggggatgatgtgtttgggaacctaagagccactccaaagctacatgacggtggagggatggactgagaaactgcttgtgtgacccaaacagaagcccttctccactgagaacaggggcgtcccttcaacaaggacagcaggagctcaccatgtccacgacatttgccatcaccaggatgaagatggcgagcatggcccaggtgttcctggcccagcgggtccggtcaatccaagttgagaaggccacaagcttcttaggaaaggcctagaaggaacagaatttcaagggccatgagcctttgccagtcctttctcctgcgacgtgactgacagcaactcaggctggtcccgtattccagtcccaggagcctcaaaacggactctgcctgggagtcacctgacagctgaccaaggggcagagctgagaagagggcgtgggagttctgacgctgtgttggacctcctcgatgtgcctgttcaacagcacagcctccaggtcgcagccctttccacagcagacgtggtgacgaggtgaggccagggcaggaacagttttcagggctgctcgtctctggccagctactcctgcctatcctggctccaagtgacctggcgagccacctgtcagatttatgttcctaaacactgctttacctttgtcattctgattaaaaaaaaaaaaaactctgcttggtacctcagtgccttacaggagaaagttttaatccctttagtctggcttctaagggccttcaccatcggggccaacccaccttccagccggccctccacttcctctctacccaggttcttgtttacccagactctgccgtactcatacgtgctgcagcgcca

SEQ ID NO: 23606 - DNA, 1032 bp, Homo sapiens
gatatctgtggaatagcttgcattctaaattttcaaggcaaacaaaatgaaatctaaatgactgtacaaaactactagcttgaagttgtttacagtttcaacaatagatggcgccaaattccttggctatgtcatgtcttggggcatctaggctttccagttggttgtgatgaaaagtgagtacactgggccgggcgcagtggctcacgcctgtaatcccagcactctgggaggccgaggcgggcggatcacgaggtcaggagatcgagaccattctggctaacacagtgaaacctcgtcactactaaaaaatacaaaaaattagctggatgtggtggtaggcgcctgtaatcccagctactcgggaggctgaggcaggaggataccttgaacctggaaggcggaggttgcagtgagccgagatagcaccactgcactccagcctgggtgacagagcgagactccctctcaaaacaaaacaaaacaaaacaaaaccctgagatgctgaaagcactgtgaacaaagaaaatttgggaaacttttatctaattcacagttaacactcaaatttcaccatttgtcccaataatattctttatagctgtgtttgacttggtcaactggtctaggatctaatctaggatcatttagttacatatctttagtctttaagctggaatggttcctcagcttttctttttctttcaaaatgacggttatttttagaatattcctcaatttgtgtttgtttgtgtattcttgaaattagagtcagttatgttatatttggctggaataccacagaaaagatgttatgggccaggtgcggtggctcatacctgtaatcccagcactttgggaggccaaggtgagcagattacctgaggtcaggagttcgagagcagcctggccgacatggtgaagccgtgtctctaccaaaagtacaaaaaaattagctgagcatggttgcacgtgtctgtagtcccagctactcgggaggctgaggcacaagaattgcttgaacctgggagg

SEQ ID NO: 23607 - DNA, 1652 bp, Homo sapiens
tggtgctgaatcctgtagggtcataaaaagtctaagcctcttagaataagaaccttactaataatatgccttgagttcacacagttcctgttactccaggagctcagggagcttttctgaatcttctctactttattcatgttcctaggaggtgatagatacattttaaagaaaaggaaacaggccaggtgcggtggctcatgcctgtaatcccagcactttgggaggccaaggcaggcagattgcttgagaccaggagtttgagaccagcctggtcaacatggcaaaaccccgtctctactaaaaatacaaaaattatccaggtgtggtggcgggcacctgtaatcctagctttttgggaggctgaggcatgagaattgcttgaacccaggaggcagaggttgcagcaaaccaagatggcgccactgcactccagcttgggcagcagggcgagactgtctcaaaaaaaaaattttttttttttttgaagattcgaaactaatatgtcagggaagaggagtacagaagaacacacatccagggactcatggagccgcagaaggagagagcaagggagttttccagtgaggttagcagctgtggctgacccgcttgggacagattcaggagaaactgctgacctggtctggaatgaggccttctgtggttttaggaaagggattaccacttatgttttctacctcgcaccacctcaggggtagctgcagaactctcatttttaaaaatttgattttaatgtcaattctgaccttacagccagggataatgattgaaatatttaacagcatagacagcagggataatgaggacagacgctggccgtgagcagctgcactggctgtgtgacttgactggcctcagtcctatggcgccacggctcgctgaggaagaggaaagtcaaagttgaacgtggaggggtcttggtgtccccgttccaccaggatcaggaatgggttccaaggggcatgggtgtagggaggcgagaggaagagagtaggcgggactgcccgtcagcccctgcctgcggctcccaggcgtggcttcccaggtgtgggcctcagactggcccactgagattccccagcctcttccaggacagactcagcatgtctgggaggggtgggggacagaaaccagtgtggtcagcagcgccctgtgactctgctgtctggaagtgtttgaaaagccaagtcctcccacctccagccccaccctacctgtcccccaccctctttttttttttttttgaaacagagttttttgctcttattacccaggctggagtgcaatggtgcaatctcggctcactgcaacctccacttcccaggttcaagcgattctcttgcctcagccttcccaagtagctgggattataggcatgcgccaccaagcccggctaattttgtatttttagtggagatggggtttctccgtgtgggcaggctggtctcgaactcctgacctcaggtgatctgcccaccttggcctcccaaagtgctgggattacaggcatgagccaccgtgcccggctcctcttaataaaataatactaaggtgcctattgcccactttctcatccacctcttgttctctaacaatatcatcccctgctccccagcagcaatgctcct

SEQ ID NO: 23608 - DNA, 1054 bp, Homo sapiens
ttcacctctgcctgccttcctaaggctgtggctgccctgtacctccagcgtatactctggacaccctgagccagctggcagaggttctggaccccccacccctgccagctcacttccgtgtgtttgtgtctaggcatcgctgctccagagcaaactcaatcagatctttgaaatcaccatccggtaagtgacaaccctgggcaggggaccctgacctccgtggcccagtattggggttcctcatcctgagtcctctcacccctgtcttctcttctctcctccccacctccttctaccactgtaatctctatcccctgggctggagtcagccaccaactctaaccctccctagacaaggaaatagagaccagagagggaaagagcctgcctcaatgaaacctggaaagacgcaagagtcctagtgttccgggctggcactttctaaagcagcagtgtcactgcggagcctgcagggaagcttgactccaagctgtagattctagtagaacgtggaatcctgggaacctgtggaatgaaggggtctctggtgcctgtgcaaaaagaaacccaagtcacctactctgtttggttgcacaagggtgggatcctaaaattctcttttcatgcctttctccccatgtgttcctgccccctaggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccg

SEQ ID NO: 23609 - DNA, 1065 bp, Homo sapiens
tggcgggtgcctgtagtcccagctacttgggaggctgaggcaggagaatggcgtgaacccggtaggcagagcttgcagtgagccgagatcaagccactgcactccagcctgggcaacagagtgagactctgtctcaaaaaaaaaaaaaaaaaaataaagaactcattcaaggccgggcacagtgcctcatgcctggaatccctgtactttaggagactgaggtgggtggatcatttgaggtgaggagtttgagaccagcctggccaacatggtgaagccccatctctactaaaaactaaaaacattagctaggtgtggcgtcaggcgcctgtaaacccagctactcaggaggctgaggcaggagaatcgcttgaacctgggaggcagaggttgcagtgagccaagatcgtgccattgcactctagcctaggaaacagagcgagactccatctcaaaaaaaaaaaaaaaaaaaaaaaaaagaaagaaagaaacgaactcattcagcatatagccttttggaactggctcttttcaccaagcataaccctctggagattcatctagattgttgcatgtgtctctagttcacccctctgtattgctgggtaacagttcatggtatggttatgccagcatgtaaacactcacctgttgaaggacatccgcaggatttctagtttccaactacagcttagaaaactgaggccagagagtgaagcaactgcacaggcataatacggcacagctggcatttcagctccagtccatttgccagagtcacacgggatgacaggtgagaaacagaccaggcagcttcaatgggatagatggagacttgacgtcattgataatctgatgccttgaaagtcgtgtgtaagaagctgactctgaattggagggaggccaggagatttgcacccagctctggcaatgggtttggggaagctataaaccacctttcaaagggaacacctggtcgggtgcagtggctcatgcctgtaatcccagtactttgggaggccaaggtgggtggatcacctgaagtcaggagttcgacaccagcct

SEQ ID NO: 23610 - DNA, 1025 bp, Homo sapiens
ggtctcggtagctgcataccgtttattttactccagacatcttgcttcccgtaatatacgcctttgtttcagtgattccgattccaaacgacacatccaagttactgtttgaatcggcatcgagcttactggggcggggtcttcccatgatttccatccggtcttttgctttcgagtctcccactatgctcagtgccttctgttacaaaatatgcatcatttaaccatgttccagaaccttatttcttcaggcgactggactggctttttccacatttgcgtggaattagtagatgtgtgatatttttaaggtatttatttcagtggttgcgattgaagcagtactagctatttgggaaaggcctgaatttatactttggggcaaagaaaagattccatatggtgataacttagagtaaacttgagggtttctgagaagaataattaaggtaaattagaagggaagagtgagttgccctcattcactaatccattgatgtgtcaaacaatcggaggctcttcgcgcttggggtgggactctggcatatttgcctcagtgcttttcgagacatcaacagaagcagtaatctgagggagatgatcagtttctgtcctcaaacccaacggagtgaagtcaagctctctcttctattttatttgactctagtatttacaggaaagtattttgccagtcatagccctatggacttataatgcactttcaccatgtttcagaattacttagtgtggaagtaagagctaaagagtgacctttttaatcgaatttcccgtttaggaaaggaaaagggaaggctctaggaaagtcccttttgaatctggttagaaaatttaagtggcattgacgctaattgtgctatattaattgtgaaacccatccgctccgcaataaatttcttaaaagacacatggctctcagcattgtggcggtgcagttgaacccatttttaaatgtacttttatattgagaggcttttaaaaagcaacggcagtcgtctttgaactct

SEQ ID NO: 23611 - DNA, 1024 bp, Homo sapiens
gagcacctaatgctgggcactgtttttaggcactgggaataaatgatgaacacaacagaccccttgaggagcattccggtgagataatcataatagtgtggaagatgctacaatagtaagcacagggaggaagagtggctagtctaaatcgtgaggagtttgagtaggcttacgtggagatgatacctaaaatgaagtctgggccgggcgcggtggctcatgcctgtaatcccagcactttgggaggccttggcgggcggatcacaaggtcgggaggtcaagaccagtttggccaatatggtgaaaccccgtttttactaaaaatacaaaaattagctgggcgtagtggcaggcacctgtagtcccagctactcaggaggctgaggcaggagaatcacttgaacctgggaggcggaggttgcagtgagctgagattgtgccactgcactccagcctgggcaacaaagccagactccgtctcaaaataataataaataaatgaagtctgaaggactaataggaatagagtcagaggggtaggatagggcctttctggaaaagggagcatagaacaaatgtatagtaaggttgaggatttaattcatgtggtcaactttatttatttattttgagactgagcctcactctgtggcccaggctggagtgcagtggcgtgatctcggcccactgcaacctccgcctcaggggttcaagcaattctgcctcagcttcctgagtagcagagactacaggtgcccaccaccacacctggctaatttctgtatttttagtagagatggtttcaccatgttggtcaggctggtcttgacctcaagcaatccaccgccccagcctcccaaagtgctgggattacaggcgtgagccaccacgcctggctgtgtggtcaactttaacctatccttaggaacagtgtggagtaggaagcaaaacattaactctgtctactccaatctttttgtaaagggtgcatgcccccaactaaaactcaatcctgtaagataat

SEQ ID NO: 23612 - DNA, 1077 bp, Homo sapiens
atttttaatagagacggggtttcaccatgttggccaggctggtctcgaacttctgacctcaggtgatctgcccgcctcagcgtctcaaagtgctgggattacaggcggaagccaccacactgccctcctttgtttgtttgttttttttttttttgagatggattttcgcttttgttgctcaggctggagtgtagtggcacaatctctgttcactgcaacctctgcctcccaggttcaagcgattctcctgcctcagcctcctgagtagctgggattacaggtgcgcaccaccacgcctggccaatttagtatttttagtagaggtggtgtttcatcatgttggtcaggctgctcttgaactcctgacctcaggtgatccacctgcctcagcctcccaaactgctgggattacaggcatgagccactgcgcccagcctagactctgacattttcatactttcaggtaaaaatgttttcacatataagatgttgaatagtgtaagttgagaaaataaatgattctgagtacagcttgaacacatacatgtattagctctgtgcacaggtttaaaataccattgggcggggcgcgatggctcacgcctataatcccagcgctttgggaggctgaggtgggtggatcacgaggtcaggagatcgagaccatcctgccaaacatggtgaaacttcgtctctactaaaaatacaaaaaattagctgtccgtggtggtgggcgcttgtagtcccagctgctcgggaggctgaggcaggggaatggcatgaacccagaaggtggcggagcttgcagtgagccgaggtcgcactactgcacttcagcctgggcaacagagcgagactctgtctcaaaaaaaaaaaaaaaaaaatctaccattgcgtttaaccagtgccgttcaaaagaaataatgtgagccacatatattacttttaatagccacttttttttttttttttttttaagatatagagtcttgttctgttgcctagactggagtgcagtggtgcagtcttggctcactgcaacctccgcctcctaggttcaagcaattctactgcctc

SEQ ID NO: 23613 - DNA, 1200 bp, Homo sapiens
ataattactatttaaaaaaaaaaaacctctgtaggtatttctccaaagaagctaagcagatgcccaataaacatatggaaagatgttcagcatcactaataattagggaaatgcaaatcaaaaccacagtgagatgttactttgcgaccatttaggatagttataacaacaacaacaaacgacaaaagcaagtgatgaggttgtagagaaattggaaccttggtgcattgctggtgggaatgtgaaatggtgcagccacagtgagaaacaatagggtggtttctcaaaaaattaaaaatgaaattaccatatgatctagtgatctcacttcgagttatatccaggataatttaaatcaaagattcaaacagggccaggcaaggtggcttatgcccgtaaatcccagcactttaggaggccagattacttgggctcaggagttcaagaccagcctgggcaacatggtgagatcctgtctctaccaagaaaccccccaaaattagctgtacatgttggcgcatgcctgtagtaccagctgcttgggaggctgaggtgagaggatcacttgaacccgggaagcggaggttgcagtgagctgatgatcatgccactgtactccagcctggatgacagagcaagaccctgtctcaaaacaaacaacaacaaaaaagactcaaacagctatttgtacaccagcattcatagtagcattatgcacgatagctgaaaggtggaaacaactcacatgttcatcagtggataaatggataaacaaaatgtggtatacacatagaatggaatattattcagccttaaaagggagggaaattctaacatgctaccacatggatacgccttgaaaatagtttactaagtaaaatgagttggacacaaaaggacaaataatgtgtgaggtacctatagtagacaaaattagtggaatagtggttactggggcctgggggacagagtaatggggagttattgcttaatgatcacagagttttagtttggaaggatgaaaaagttccagagaggaatagtgttgatggttgtataacagtgtgaattaatttaatgccaatgaattgtacacttaaaaatgtttgaaatgcatgaaaagacaaatactatgtgatttcatttatatgaatatgaggctatctaaagtcaaattcatagaaacagaaataatggtga

SEQ ID NO: 23614 - DNA, 1028 bp, Homo sapiens
tttttttgtatttttagtggagacgaggtttcaccatgttgaccagactggtcttgaactcctgacctcaggtgatctgccggcctcggccttggcctcccaaagtgttgggattacaggcgtgagccaccgtgccgggcccattagtttttttttttttttttttaaattgttgagtagtatacttcatggtatgtaccagtttgtttaatctttacccattgaccgacatctgggctgattctagtttttagctaatatgaataaagctgctaggaatattttgtgtacaggttgtgtgatcataaatttttgtttctttggaataaacacccaaaactgcaattgttgggtcacatagtaattgcatgtttcgttttataagaaactgccagactgtttccagaatggctataccattttacacccccatcctcagcagtgtatgagtgcactttctctgcatcctcaccagcatttgataatgttatcatactattttgtactgtagtcattctgataagtgtgtagtgataatctcattgtggtttttaatttgcattttcctgattgccaaaggtgttgaaaagtccttttatgtgcttatttgccatctttggaaaaatgtctgttcatgtggttgccaattttctaattggattgttttttaactgttgagtttagagaattctttgtacatttaaaattctagtcttgaccaggtgcagtggctcacacctgtaatcccagcactttgggaggcctaggtgggtgagttgtttgagactagcttgggcaacatggcgaaaccctatctctacaaaaaagaaaaaaattagctggatgtggtggtgtgcacctgtagtttcagctatctgagagactgagatgggaggatcagctgaggccagggaggttgaggctgcagtgagctgtgatcactccagcctgggcgacagtgagactctatctcaatacaataaaataaaattctagtcctttgttggatatgtggtttacagatattt

SEQ ID NO: 23615 - DNA, 1050 bp, Homo sapiens
tcagggctctctgcagcctcaacctcccgggctcaagagatcttcctgggttcaagtgatcttcccacctcggcctcctaagtagctaggactacaggcatgtgccactgcatctggttaatttttaaattttttgtagagactgggcctcactatgttgtccaggctgatcttaactcctgggctcaattgatcctcctaccttggcctcccagagtgctgggattttaagtgtgagccaccatgcctggcataaatttgttttttaaaattcttgttttttgaatatactattttctcttcttggaggatagcttatttgatgttttcttctatttcttactttctcttcccttccttcaagtcctccctttttgccccccccccccccccccgttttattgtaaattttttttggaagccttcctcaaatgattgttgatttcagactgcacattcataattaagaatgagtcattaaaggccaggcgcagtggctcacgcctgtaatccccacactttgggaggccaaggtgggtggatcacgaacgaggtcaagagatcgagaccatcctgaccaacatggtgaaacaccgtttccactaaaaatacaaaaaaaaaaaagccggacgtggtggtgagtgcctgtagtcccagctactcgggaggctgaggcaggagaatcacttgaacccaggaggcagaggttgcagtgaaccaagattgcgccactgcactctagcctgggtgacaaagcgagactccgtctccaaaaaaaaaaagagtcattaaggccaggtgaggtggttcacgcctgtaatcccagcactttgggaggctgaggcaggcggatcaggaggtcaggagttccaagaccagcctgaccaacatggtgaaaccccgtctctactaaaaatacaaaaattagctgggcatggtggcacgcacctgtaatcccagctactcaggaggctgagtcaggagaatcacttgaacccgggaggcggaggttgcagtgagctgagatcccgccactgcactccagcctgg

SEQ ID NO: 23616 - DNA, 1061 bp, Homo sapiens
tacacccctcactttctgccttggtgtctgatatctcttactgctaaaccctcccaaatgaattgacttgttcctctttgatgtcttcagtgggccttgaagttgtaagcttgttttcatctactgtggttacagttgcaatgtctattcattgaaatggaggaaaagtttatatttcttgttttctctatgttggtgtgactttggagagaaggggttagaaagatctctctgctgtctcaactggaggttgaggtaatttttgacttcaaatgatttttgactccacttttttaaaacttgtaacattagtagagttggggtgaatgatattttgctattgtttttgtaaatatccagtcctccttcaaaataatgagatttttgttctttaggatagtggaatgtagtattgagtccaagtagttccaccactatccagatcagtgacatttaaaggagacagctttaatttagatgtgtaatttttagctgatttacttggggggaaatggagtatttttgctttttgaacaaagtagaactgtagtcttaaatttcaatcttatgctcttgatggatactattttatagaatactgaacagcaagtgattcggcaaattcataatctattagaggatttcagtgggtcctatatatcatagcatttggcattgaataataagttatcattcttgattttttgctggtttgaaacctggtaaatattcgtgcttacaaagtgggagtattgttcatctacctctttatatattcttagtgttacataaatgcttttgctttccttaaattagatattaatggacaagtgtatatttcttttttttttattttttgagatggagtctcactcttgtcactcatgctggagtgcaatggcacagtctcggctcactgcaacttctgccttccgggttcaagcgattctcctgcctcagcctcctgagtagctgggattacaggcgtgtgccaccacgcccagctaatttttgtatttttagtagagacagggtttcatcatgttggccaggctggtcta

SEQ ID NO: 23617 - DNA, 1101 bp, Homo sapiens
tgaggtcaggaattcaagaccattctggtgacatgataaaaccctgcctctactacaaatacaaaaattagctgagtatggtggtgcccacctgtagtcccagctactctggaggctgaggcatgagaattgcttgaacctaggaggcggaggttgtggcgagctgagattgtgccattacactccaggctgggcaacagagcaagactccatctcaaaaaatttttttgtgaactacatactgtaaggctaaagataaaaagaaccacatacatgtattttattctagttagcaaatctggttcctcacggagtgggggtaggagctagcaagtttgaaacacacacacacaaacacacacacacacacacacacacacacactatatacacatactaggattaaacatttaagtaaaaatttgtagataatgacagctgggtttctcgttgttgaagaaagaagttgaaaggaagaaggctagaatgaactgtggtattggattggaattggaggtatcagtatgaactcatggttcaatatagatacgtaaatgtaaatatttcctctctctgctgggaagtcatagaagaaatgatgctgaggtagcagtaaagacacttaatgcccagatcttggactataaatacaattctttcctccatccctcctcccttttctccctcccttttctcttctttcttttccttttttgacagagtctcactctgtcacccaggctggagtgcagtggtgggatcacaactcactgaagcctcaacttcatgggctcaagtgatcctcttgccttagcctccctagtagctgggactacaggcatgtgccaccatgcctggctaaattttgcattttttgtagagacgaggtctcattatgttgcccaggctgaactcctgggctcaagccatccacctgcctcagcctcccaaagtgctgggattatagatgtgagccactgctcccggcttaaatacaatttcttaataaaaggaactagggcccctgaagaacttgtttatttcagagctggggtaggagaaatacagaatgatcctggaacatcttgtgattctagaaaa

SEQ ID NO: 23618 - DNA, 1063 bp, Homo sapiens
ccataatacaggtttctaagcctgctttcaaaactactctcttatcctctgccattaaaaaattattccctgacagtctacttagtaagatcaagtttctgaaattacaagacaatgagaatagaattgtccttacttaaagtaataaatagacagccaataattgctgtgaaatcctacttttcccactgacattataaaaaagaagtgatacgtttctaggaattaaaaaggtatatttccttaattgttagtaccacacttggggttggggaagctgtgtactctggctgttattgtgacagttatttttggtctgggcactgacaaaaccagtacaggccagaggcatatcaatctgctctgcaaggcagagaccccagatttcataaccctgtgttttttggtaacataatgaagttattccttaccttataaattaggatgtcaaatttctcatgttgcattttattttaagaagacctggatgtcttcagagataaacaatttgtctatacccaaaataccatgaacttaaattatgtttgtcttcattcaaggatttttttttttttttcccaaaagtagacagcctgacacctgccctgtcagagctcacacccatagggacaggagcaaacaagtaaataaatatatcacaaattgtgataaatgctagcaaggtgaatagggtaaagtgttggagaatggggtaaggatgagggaggaagtgatctagatagaatgatcagggaggtcctctctatagaggtgatgtttaagatgagaagtgaaatacgaacagtaagcaaccaaagtcatttagtcaataaatgtttgttgagtatgtatttgccaggtgttggtggtaggaatataagcataaatcggacagataggagccctgcctgcaaaagcttacattttagtggggtaagtctagatcttactatgctttttaccatgttgcccaggctggaccctctcccttttcagagtcctagttaattcactatatttttcttgtataaaagcactacatagcagccacagctggagcctg

SEQ ID NO: 23619 - DNA, 1035 bp, Homo sapiens
tttatcctcccaattccctggccagggaaaccactgatcaactttgtctgtataaaatttctttatgtggacttttcaaatagatggaatcatataatatatggtcttttgtgactagtttctttcacttagcatgaggttatcagggtctgtctgtgttgtacatgaatcagtacttcattctttttttttaatggctgaataatactccattgtatggatataccacattttatttatccgttcattagtaatggacctttcagttgttctgctttttggctattatgaataatgttgctgtgaacattcacgtctacgtttttgtgtggacgtacaagttttcatttcttttggttatatgcctagaattgttggatcatatggtacctccatgttgaacattttgaggaactacctgactgttttctaacatggctgcatcattttacattgtcaccaacagggtataagggtcccaatttctctacatcctcactaacgtatattgtcgtttgggtcatagccatcctgtggtggtggggagctaggttggtatctcattatggtttttatttgcatttcactaatgactaaggatgttgagcatcttaagtgtttattggctatttgtgtatcttctttggataaatgcctgtttagatcttttgctgatttttaagtttggtcatttgtccttttattgttgagttgtaagttatttgtatattctgcatacccaagtcccatatcagatacacaagtttgcaaatagtttcttccattctgtgggttgtcttttcaccttgtattgttcgctgaaatacaagtttttaattttcacgtcccatttacctgttttttcttttgttgtttgtgctttggtgacatgtgtaagaaacagttgtcaaatccaagatttgaagatgacccctatgttttcttctaagagtttttatagttcagctgttggatttaggtcttgatctgttttgaggtaattttttttttttttttttgagatggagtcttgct

SEQ ID NO: 23620 - DNA, 1032 bp, Homo sapiens
agcctgggcgacagagcaagactctgtctcaaaaaaaagtcaacaaactaggaatagcaaagaacttccttaatcctgtaagtgacatctataaaaataccacagctattattgtacctgtcccctaagatcaagagcatggcaagaatatctactctggccacttctgttcaacattatgctgagttccagccagagctaaaaaaaaaaaaaaaaagaaagaaagaaaaaaagccatccagagtgaaacaactatttataaatggtagaatattttatatagaaaatccttaagaacccacaaacatatacccagaaaactcttagaactaataaacaagttcagcaaggttacaagaaatgagatcaacatataaaaatcagctttatttctgtacactagcaataacctaaaaattacattgagaataaatttccatttgtaataatatcaaaaggcaaaaaatacttaggagtaaatttaaccaaaagagtgtaagacttgaacacagaaaaccacaaaatattgttgaaagaaattaaagatctaaataattagatagccattatttgtgaattggaagacaatattaagatggcattactacccaaagtgatctacagatttagtgcaatccctatcaaaatcccaattgcttttttaaaaattcccccccgtagaaattgacaaattgaccctaaaactaatatagaaaggcaagggacccagagtagccaaaataatcttgaaaaggaagtacacagttgtaagatttatactttctggttttaaaacttaaccgcaaagccacaataatcaaaacactgtgatactgacataaggatagtcataaagattgattgaatagtattgagagtctaaaaataaactcttacatatatggtcagttgacttttaacaagatggctagacaattcaatgggcaaaagaatagtctttccaacaaatggtgctgggaaaactggctatccttgtgtggaagaatgaaagttagacacctacttcatacc

SEQ ID NO: 23621 - DNA, 1050 bp, Homo sapiens
gtggggtgggggtggggaattaacaggttctcatgtacctagtcaaatatcagaacaactatgaggcttatatttgtgaaatatatattggtttctgaatggtttcattattattaaacttcaacatccttttaaagtatttgttgtttctatttaatgatagacagtgatctctaaatctgtgattctcagtcaaggacagttttacatttgtcaatatgtggagatatttttggttatcacagcttgggtacaagaagaatgctaacccagaatgctgacccaaaatgtctgtatggccgaagttgagaaaccttggtctaaatgcacctctctgtattagtaccttgggaaaattaaccatattttaagctagttacagtctgcatgtgtgattcatagagatatgtgtcctcctgcataaacatgtctctttatggatatgtctgtgtggtgcaactaccaatctttctttgggtgtttttgccgtaagtggttgtaaacacaatgcgtatccgactgaaaaaagattaatgtgcatgttggcataagaaaatgtatgagagaagttctgtgtattctgagtgctgttttattggtcccctggctcagcagtgaagtctttaacctcatcatgcttgctgcttattgttagtaagatcatccaagtaaggatgtatagggctgtgcacggtggctcacacctgtaatcccagcactttgggaatccaaggtgggaggattgcttgagtttaggagttcgagaccagcttgagcaacatagcaagacctcatctctactaaaaaagtttattttttaaagtcggatatggcggtgagtacctgtagtcccagctatttggtaggctgaggtgggaggatcacctgagcccaggagatcaaggctgtagtgagctgattatagcagtgcattccagcctgggtgacacagcgagaccctgtctcaaaaaaaaaataaattttaaaaagagttgtataatactattttgacctttgtcttagtttttgtgttttgttattcaaagaagt

SEQ ID NO: 23622 - DNA, 1054 bp, Homo sapiens
cccccttttaaactgtcattgacccttgaactgcaggttcacttacacatggatatttttgtttaaagagatggggactcgcagtgttgcccaggctggtctcaaactccaggggtcaagtgattcttccttctcagcctcccaagaagctgggattacaggtgtgtgccaccacacccagctctataaacaggtttttaaaaacaaatcttttggaaaaaatgttagagacttgcaacaacttgaaaaactcacagacaagccacataacctagaaatattgggcgggggggaaattaagaaaaagttaagtatattatgaatgtctaaagtatatgtagatactagtctattttattactaccataaaacatacacagatctattattaaaagtttaaatttattaacactcaaacacacagagcccatacaaggcaccttttgcatcaagagaaatgtaacagagatgcagtattaaatcataattgcataaaaataactaatacatactgtactactgtgataattttgtagccacctcctgttgctattttggtgagctcgtatgtttccaagtgtctgcttaaaacaccatgtgatgtggatcatctccccgtgaacagtttgtgtctccagtaaatcccatattgcaatcaaaagaggtcttttgtggttcttgcgtgttttcatcgtgtctagtgcaataccataaaccttgaataacaccatcagacctatacaaagtgccactagtgatgccagaagcaatcctgagaaacagaaaagtcatgacattacaagaaaaaattgaattgcttaatatgtactgtagaatgaggtctgcagctgtggttgcccgttatttcaagataaattaatccagcataaggaccattttaaataaaagaaaatttgtgaagccatcactgcagccacagcaggaggtgtgaaaccttgcactttttacagaatacctttttatctcatgttgaaaatgcagctcttatgtgggtacaggattgctataagaaaggcatacttgtaggctgggc

SEQ ID NO: 23623 - DNA, 1018 bp, Homo sapiens
tggttctaaaatgtgacaatcaggagcctatggtgagcagaaattagaccctgaggagtcaggttgagcttctcataagtttgcccccagtgtgaagtatctgacttagaatatctgaaataaacttttggggtaaggagattacttttcttttgtttgttttatgaaagagcttgacttgctgaaatattctgtgttatatattctagttgggaccactgccttcagaataagattaatatttaagctgttaaagtcagcagttggcaacccatgcttgataattttatgatgatattttgtttctgttttagattgcaagggagcatggtattaggttttttgagactagtgcaaaagcaaatataaacatcgaaaaggcgttcctcacgttagctgaagatatccttcgaaaggtaagttcctgtttttatatcctgccaggtacctgagtatctctgttgaatattttgtctattctgaagtactggatttacatacagaatttgagtttgggtggtattgtttctgtagggcagcagtccccagcctttttggcaccaaggactggtttcatggaagataatttttccatggaccgtactggggggtagtttcacccagaaactaccccacctcagatcatcaggcgttagatcctcctaaggagcacgcaacctagatcccttgcatgtgcagttcacagtggggtttgcactcctatgagaatctaatgctatcactgatctgatgggaggcggagctcaggtaataatgctcactcacttgctgctcacctcctgctgggtggccccgttcttaacaggccacggaccggtaagagtccacagccccggggttggggacttgtgctataaggaactggggaaacagaaagccatctagaaatctgaaggatctagtcagtggtaaccattaatattctgagctccacagtcactgtctagtccctagttcaattattttttccagctttttgtcttttctagccttttta

SEQ ID NO: 23624 - DNA, 1035 bp, Homo sapiens
tcgaagtaagagttatcagatatggtcgctaaggcgtggaggggcaactcatttaaggtggcacagctgctagtggtctctccaggatgaacgtggatctcctggcctaccatctagtccgagccccgggagggcggaagaggaaggctgttttccctttccagtctctgggagctggccgtgtggctttccctgggacctggctaaggccctgccctgtctctgggatccccaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccgg

SEQ ID NO: 23625 - DNA, 1068 bp, Homo sapiens
tcgccagtgataagggctctgtgtttagaaaactttcttccacgagggcttctgtaactctttggtctcaggaactgcttagaactttgtaactaatggtgctagttatgtttccttgaggctactcacctaggaagcccttggacaccatctgtgtcagcagttctgggtttccacctccaaaccgctccccaaagactttgcccagatcttccgccacatgtttcgctacatccacaccaacttcatccaccagtgtggcggcacccacaggaaagccaaagcttgtggtcagggaatccagcttcttcgggtcaactccttcctgaacaggaagcgatgcagggacctcaggggaagggcagcccaaatccccccaaagggctccctgtactggctccaaacactgccttgtgtaaaacccacttctgagtgtcacctgaccaggcccaggactggtgctatttcattcagggaagcacaaagaagtttggggccacaagtggaaagtctgagccttctctaatctacagcactttaaggacgtttagagatgactaaattcttcattttcttcttgtttgcatttctgaatctcaataataaggagattgcatgacagacggctgagtgtgtcatgaccaacagaagaaacatcatcaaagaggagcactcagagccctgtgatccccaagtctgggtaagtgcccagcgaggaggatccctctcctttcctgccagaatgacctcgatggctactggagaggtctgtgtgctgtggaaacagatgcagcaccagttgaaccaagcgggccctgttctggatggtccctgcctcagagaggtgcagaaacagcatagaagacatgctggggggtggggtgcctttagcttgctggaacagtgaggaggctgtggggcagagggaaagctctgcccctttcagtgcagtataagcccaacttccgactgctgtgcagagagagggcaccagggaccttcctagacaagagcaggagttggtgtatcagaaggaagcttggtccttatcttgacatcatgagtttt

SEQ ID NO: 23626 - DNA, 1035 bp, Homo sapiens
ctactaaaaatacaaaaaattagccaggcgtggtggcgggcgcctgtagtcccagctactcgggaggttttggcaagagaatggcatgaacccgagaggcagagcttgcagtgagccaagatcacgccactgcactccagcctgggcgacagagcgagactccatctcaaaaaaataaataaataaataaaatagtagtaatcctttccattggtatatcatgttacagttttggattattttccatttttttcctataagttttacatatatatatggacacacacaacttatattctttttcattaagatagcatatgcattttttcatatggctacacaccctgctacacaatcttcctaatatagccttttataaaagcctccccatgtttagactctgttccgttccctcacaaggctgtagcctctagcctccactgtgacgttcacatcagtcaagccctttcccttgccttgctctttgaactctgttcttccagttcttcatgttattagcttgtccttatccctcactgtttatttattatcaatttctctgactctgcaacataagagtagagggcatgtctgtacagtttcactattttatctttaacatttcattaatcagtacagaaaaatcaaagaatgagtgaaaagacattagagtacctatgtaaaactcagtttggggaatatgaaggagctcttagtttaaaaattaaagttttaagatattacttattttttctttgcagaccaacatatgctactccaaaagttctagaaaaggcaggattgaccatgaatgatattgatgcttttgaatttcatgaagctttctcggtaagtaatttgaaagacacatatgaagggactatagtcataaaaaatgtcatccatatttgtgggagagagcaaggcatggtttatgatgtgagtagagcaggagtggacctgcatattttaagtactgattcacactgctgggaggggcccgaggggagggaagcaagggccacacatacagtg

SEQ ID NO: 23627 - DNA, 1034 bp, Homo sapiens
ctcaaaaagcaaataaagaaattaaaataaataaaaaataaaataagcaagccagagaggagtagtctaccttattatgaattctttcaggacaacccccaagtcagtcaaaccttcctatccctgctctttttttgtctgcttgtgccttttcaatgtacttaacatgccaggtgtggtagctcatgcctgtaatcctagcactttgggaggctgaggtgggcagattgcttgagctcaggagttcgagaccatcctggacaacatggcaaaaccccatctctactaaaaatacaaaaactagctgggcgtggtggtgggtgcctgtagtcccagctactcgggaggctgaggtggaagtatcacctgagcccgggaggttgaggctgcagtgagccgtgttcaggccactgcactccagcctgggtgacagagggaggccctgtttcaaaaaaaacagaaaaaccaagtacttaacagtttgttttgaactccagtgtatacttgattgaggacaaagaccatgtggcaaatctttaaacctgcagtgttcaacttggcactttgtaaataatagtttcttttatttacttttttgttttttagagggtgtctaaaaattctatgctaggatttagactcatctaaactaaggacatagctagtacatagcactgtgcatagtgctggataaaagatattctacttctggccgggcacagtggctcatgcctgtaatccagcactttgggaggccgaggcaggcagatcacgaggtcaggatatcgagaccatcctggctaacacggtgaaaccccatctctactaaaaatacaaaaaattagccggacgtggtggcgggcgcctgtagtcccagctactcgggaggctgaggcaggagaatggcgtgaacccgggaggcggagcttgcagtgagctgagatcgcgtcactgtactccagcctgggcaacggcgaggcacggtctccaaaataataaataaaaaaaataaaaaaagaaagatattctacttc

SEQ ID NO: 23628 - DNA, 1041 bp, Homo sapiens
gctggaattataggcgtgagccacgcacctagccagcccatcatcatttcttactactgtctcagatcttttgtccaatttatttcattttagttaggatgggttggagaaatggaagaacctcagacatggagtctgttgaataaacatttggcttattggttgactctttgctaaaagagttgactcttttagcagagtcttgctctgtcgcccaggctggagtaagctccacctcccgggttcacgccattctcctacctcagcctcccgagtagctaggagtacaggcacctgccaccgtgcccggctaattttttgtatttttagtagagacggggtttcaccgtgttagccaggatggtctcgatctcctgacctcgtgatccatcacacttttaagtcttgaaacactgatgtatttcttccatattcataaaacttattcagaaagaaattttgatctttaattatgatttttaaaaatcagatactcaaatgattactacttattttgtatacatactgaacacacatagaaaatataagcaaaggtggccaggtctggtggctcacgcctgtaatcccagcactttgggaggccgaggcaggtgggtcacctgagatcaggagttcaagaccagcctggccaacatggtgaaaccccgtctctactaaaaatacaaaaactagccaggtggtgcacacctctaatcccagctactcgggaggctgaggcaggagaattggttgaactcaggaggcggaggttgcagtgagctgagatcgcgccactgcattcccgcctgggtgacagagcgactctgtctcaaaaaaaagaaaaaaaaaagaaaaactttttcaagcgtgtgactagtataatatgtaaatttcagatggatgaattaggtaatcacccaggtaatactgtgaaccctcaaggagggtttgaactaggctaatattacctagttcaagacttgtctgttaccagttttgtatctcttcttccccatacctagcagtgtgtgtgtgtgtgga

SEQ ID NO: 23629 - DNA, 1002 bp, Homo sapiens
gcgcctggctttactattattttcacctaagaaatgttattctgtctactagtaggcaaggatttactctgaatattttctttcatttcttaacagtacagtgctgtggataccaatccactttctctgtatgtcatgcatccattctggaacactatagtaaaggtaagataattaatatgtatgtactttttgttttagtaagttttaaagattttaacctattttatggagtattataaatgcaactctcagtttcataagatatttagagaaaccacccttccccaatcacaataccccaaatcacataccttttgatttatcttactgttgaagtttataccctgggatttgtcacttttgtaaaatcccttttaaaatttttctaaaatagacttaatgttatgattatagaagtttgctgattacagagttagttaaaaaatagaggatggaagaaagaatgctgatggagattatcgtttacgtgttaatgtctataacttctccatatgatctttcaaatgtatagcttttattatgacttcagtttgcatgttgtagtatacattggacagagattcctctactttaattattttataattattttgcaaaaataggtatttcctacttggctggcgcccaatctgataactttttctggctttctgctggtcgtattcaattttctgctaatggcatactttgatcctgacttttatgcctcaggtaagaatattactttattataaaatttaactgagtagaaaaaaatgaaatgtggatgcttattttctggttttgttaaaatgttcatatttctaaaaaattttgaatattataatggcatcaccttgcctattgaattagatatgttgtctaaaaagcaatgaggttttggcagataaagaataattgggtttacatgaagatggaaaattaagactcaaaactttgcctaaaaatgaatacaaacagggctcagtttacctgtca

SEQ ID NO: 23630 - DNA, 1068 bp, Homo sapiens
atttgcctttctcttactatgaatgagcttttctagtgtttaagagccgtttgtatgtccttttctgcatattttacatctctcaaacagatttttttttctatagggttgttggccatttcctttatttttagaagctattcatatattaggtatattaatcctttgatatagattatagttttccccattattgtttctctttttaacttttcttaaggtactttttgtcttggtggttttaactgaagtgtacctacttaataaataaactggaaatgtgaggaatgaaaatattttttatgaccatgctatccttggattgtatctccttcagtttggtctttttttttttttttttttttttttttttttacaaattctactccaatttttctctagctgttaagtttcctatattatgaagtctgggccttcacttgtgcaagatgaaaagcgggtctacatatatatggtctctatcactgttctctacttgaaacatagagcttcatagataagtatttaacaattaagtactcgtttcagaaagtacattaagtactataaagaagaaacagaagatgcagcgtttctctttggcagcctgtatagagctccggctttctacatgctcactatacttgagatagttatttcaagatttttaaaactaaaattactcttggtggcaaatcttttgctagtttgtctcagcctatttccaacacctcagagctacaagtaattctgcattaattcatttagccttggctcccctttggtgcttcccagcttgacgtggagtaagctgctaaaaatttctgagaacactgaggacctcaggtggtcttctccttcctttccctctaagttcgtctaatttggggaactttgttctacttgggcttggaagtagcagagtaattctttttagagataagatttctgttgggttctagtcttctgttttaagccagatgtcttaggaattgtttagaaggaatgttttctgcctttaatctttaaggccatagctgcattgaccctcaaaccaagtagagtcac

SEQ ID NO: 23631 - DNA, 1050 bp, Homo sapiens
gtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattttaaggtcacgtcctatagtttgggggcccttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcagg

SEQ ID NO: 23632 - DNA, 1045 bp, Homo sapiens
tctgttataaaattcaaaaacaacccccaattttttcatttaatatctttttgctcttgtttccagcatacgtgaaacactttcaaccttaatgaagttacttaaattgttttaagtttgccgtattgtcaagtggcaatacacatacatgaaacagtcacttttggggggtacagtggctgagggtgcattttaaaaaaaactagtaaagtataacagataaactgagaagtgtacaaaccataagtgtatagcttgatgagacatacccatgtaatctgcaccaaattaagaaacagaaaattggagtctctgagcctactatggctcagaagcctgcctgattcaaaatcttattatttaaaaaagggaaaaaaagaaagaaacagaattatcagtactcaaggagagtctctagttacttagtattcttcctccatatcctgactgcttatacacagatcaatcagctttgcctatttttgaatttttacaaatggaatcatgtagtggatattctctcaccaggggcttcttgtgctcaaggttatatttgcgagatttctcttactgttgtatctaatttgcttatttttttcattgctatatagcatcccattgtatgtatgtaccaaatgtgtcagttatgttgctaatggtatttggatagtttccggtttggggctttcatggacagtgctgctgtgaacattctagtaggtgtttctgttgggtatatatatacctaggagtgaaattactgggtcagggatacacacatgttctgttttagtaaattgtgccaaatgctaagattaatggagaaattaaaaaaaaaatcctctgaagtatacaatgcagctgtttaaaccaaaatcctaaagactggcacaatattatggctggatcagaggttgacttccaactcttattcttcagcaaaaagtagaactttaagctatatctctgactccacagtaatctatcagttaaaaaaattatatatattatatatacatatataatatatgtaataaatattata

SEQ ID NO: 23633 - DNA, 1050 bp, Homo sapiens
taaagatatacaagcacatgtgcttgatgaaaaataggaagggctgttattgcagcactatttgtactaggaaaaaattagacatgacctatcattggagaatgaatggaatgcactatgacacgtccttacaaaggaataccatacagccattacaaagaataaggcaggtatttctgttctgatgtagaacaatctctaatatatatcattgaatgggaggaaaacaatgcagaacaatatttaatgcgtgccaccctttctgtaatacattatgtaatgtgaaatatatacttaaatatgcatagaccatccatggaaggaaacacaacaaaacctatgatgttgcttgtctctggaggggtcagggaggagctgggaaaactcacaatttacatggctttaaatgtttatcatgtctatgttttacctgtctaaacagtaataataatttgtcacccgtggctggctctggctcaccctgtcagagactcaacaagacttgaggagggtgaagttcttgggcccatgtggatggcttatgttcccaaacggacccccagatgcaggcctccgaaataagacacaagcatacagagttgggctttcaggcttactgaacagacagactgtgtttttttgactgcccattcaaacaagaaaggctctgagatcaggaagtaggtatgacccattattgctgactatcaaatagcttttccaatatttcccctttgagtcttttttattcagaggaaaacttggttggaactgtaggacacagaagatgagaagcactaactgggcattgtgaaccttcccacaggttcacaatgtgtgtgatgtgtgtgtctgctcatcccttcatcccttccttcaggcagcaagtgcttgatgaatacctgcactgggccaggtgtcatcataggatattgggtctaaaagaactttagagaacgtttagtcatttcacagaggaggaacccacagggcactttagctttcagtgagtggtatcggtgcagagagaatggtgatttttgccttctt

SEQ ID NO: 23634 - DNA, 1022 bp, Homo sapiens
gagatgttagcttgctagtggctttgcctgacctggcacaaacatcctcagagtgtagtccggtgtaactaccccattcaccagtgctgttactgattccacagccacttttttttttttttttttttttgagaacgaagtctcgctcttgtcccctggctggagtgcaatggcgtgatcttggctccctgcaacctccgcctcccaggttcaagcgattctcttgcctcagcctcccgagtagctgggattataggcgcctgccaccaagcccggctaatttttgtatttttagtagaaacggggtttcaccatgttggccaggctggctggaactcctgacctcaggtgatctgccggcctccgcctcccaaagtgctgggattacaggcatgagccaccgcgcctggcccatagccactttattataacaatatttttatttctatttatttatttatttttttaaggccaaggaattaagtgactgtatttagaacagaaggtattccatgaataacatcaaaacaatgtggacactaagagaatacatgtaactcatggatgcaggggacgcacattgtctgcattcctgttttctgtgcctactacatgtgctccaccccacacctgctgagtacatgctgggaagatcatgtcaacccttggagcagctagtgtttaatcatctcctgctagcgcctcatgttttacattttggcactgtcatgcagatactcccctttccccctaaataagacactgtcacacaatatcttttaactcatctgtatttgtataacaatatttttaaaattatatagtaccaagagattgagttccactgtaattctcctgtgggaaaactgcagttaatagtttcatatatatatgaaatctcactcatataaatacacatatagataaacataccttgggttctggttttgtcctgtaaactactttcttcactcataacctcccatgtcaatacttagagatctacagaatccttttcaatg

SEQ ID NO: 23635 - DNA, 1073 bp, Homo sapiens
attatttctggggcctggagacagctggcaagagcacgggaagcacagcagggctgagttatctgccaggagtcggtgccgggtgggcgaggtgctggtggtggtgtggtgcctcctctggtcacagacgcttgtccttccccagctaaagccccaatcgggagtcaggagtccttgtctcccatgtgtacacctgtctgtccttcttccaggacctgcgggagctgggcttatggaagtgggatttactcacacttacttttgagggtcctcagcctgcccaggcctcaagtaatgaagcctcctggcctcagggagtcagccaacacttacaaggagccaggcttcagcttgaacgcccaagactggtgctgtgcacacttgggctgggaggtgcacgtgaacacacatcaacgcacagctaagcttgtcctatctcacacacacacacacacacacacacacacacacactcagctctggcttctgacaactgccccttagctcttctgtgcctttgaactaatctcactgaacaagtggtcagcagctcccatttcttaccaccctctcacagctaatcctttgcaatgtagcttttgccctctgcacactgatggtccttgttcattaagtccagccacgtggggccgggccaactcagatgaactcatgggattaaaacctcttacttgatcttagcctgttaagaaatcatccctgtggatttatatacaccttcccagaagctatttgtttcattcaactcctgcttgcttggggcccaagcttgatctgtacttgtgtcagtttcttttaaaaaccgtctcaggaggccgggcatggtggctcatgcctgtaatcccagcactttgggaggctgaggcaggcggatcacctgaagtcaggagttaagagaccagcctgacccacatggtgaaaccccatctctattaaaaatacaaaatcagctgggcgtggtggcaggtacctgtaatcccagctactcgggaggctgaggcaggggaattgcttgaacctgggaggtggaggttgcagtgagctcggatcgt

SEQ ID NO: 23636 - DNA, 1043 bp, Homo sapiens
aattcagcacaattgggcctggaggctgggccatcactcacactgcggtgtctctactgagctgctttagatctggggtccagctcacccctccttctgtatggctcaaggctagatgcttgtattagtctgctcaggctgtcataacaaaataccacagactgggtggcttaaactacaggaatttattttctcacagttctggaggctggaagtccaagatcagggtgcaggcgggtcgggttgtggtgagctctctcctcccggctggtcaatagctgccttctcactgtgtcctcacacggcctttcttctgttcctgtgcctgagagagaaagcgagctctctggtgtctcctaaccaggacactaatcctagcagatcacggccctgccctatgacctcatttaacccttaaaactttctaagaggccccatctccaaatacagccacactggggttaaggcttcagcatatgaattagaggggacacatacatctagtccataataactctagagacgaactgtctggctttcaatctctgctctgttacaaactagttgtgggaccttaaggacgttcttttaacttttctaagcttcaggttcttcttggtaaaaatgggggcaatgatggtacctatctccaggcattgtaaggattaaatcagatgatgcacacaatgggcatagcgaagggcccagtatatagtcagtgtctagtaattattagttagcattattaatagagtcctttaagttctgagaatgagttttctagatggtagtcctaggagagcagtctatcctggatttccaggaccagcccaggcctgcgtgaatgggattcctgggccagagaggttccagggctccccagtgttctgcaagggagccaagcctcttcagagcctcgttagcctccggagacttccaactaggaagtggaaaaaaataggccgaggtggtggcagcccaagggttctagagaaggggagtagtcagccccatctattcctccctcacccatctcctttcaa

SEQ ID NO: 23637 - DNA, 1049 bp, Homo sapiens
ccttgtttgttgaggccttctgttaatgatggttgccattattctatgctacctccttcgggagctcacatcaaaaatagtcccttgatctcttagacctttaatctctcccttggctccttcttcactccctgaaaaatattagtcctaaaattgatactttccctcagccatgctccttgggccgtttctaggctttctttactcacagagatcttgacgactgtatacacagtctccacaaacttgccttcagtcagagttcatcaaagtctcactgatttccaaagcagaggtcaagatcttctgtggtccttgcccccacttcactgcatggctccatttaatgctaagggaagggagctctacagaggagggagtagtcagtggtgtcatatgtggttacttgatgcataatccattttgagttcatttttatataagattttaggtttaaattaaggctgggtttttggcctatgaatatccaacaccaattgttgaaaagactgtcctcccttcattgaattgcttttgcacctttgtcaaaaatcagttgaccatagttgtcaagatcatgcagtcttgattactatagctatgtaatatgtcttggaatcaagtagactgattcctctgactttattcttctttgtggagtttgctttagctgttctagttcctttgccagtccacatacattttgacaataatatgcaaaagatttgtgctgggattttaataggaattgcattaaacatgtatgtcaatttggggagaattgacaccatgttgagtcttccaatccatgaacatggtatgtctctccacttacttagattgtctttgatttctttcattggcattttgtagttttcagcatacaagtcctatgtgtgttttttctttttttatattgacagataaaattgtatgtatttgttgtgtgcaacatgatgttttgaagcacatacgcattgtggaatgactaaatccagttaattaatagatgaattacctcatataatgagaggttagaacacttgata

SEQ ID NO: 23638 - DNA, 1042 bp, Homo sapiens
ttttgtaacacattattggttataatttatatgatgcaagatacttgatagaaaattcagacaccaattattattcctataagaaaatatgagctgtttcctaattatctactttagggtatgatttgtgatttgttaggccctgcaggaataaaaaagtacaatctatagatataactatttatgctttattctggcttgtttttttttttcagacagggtctggctctgtcactcaggctggaatgcagtggtacaacctcctgagtagctggggctacacgtgtgcaccaccatgcctggctagttttttgtttgtttgtttgtttgtttgtttgtttgtttgttgagccagggtctcactctgtctcccaggctggagtgcagcctcccaaagtgctggggttacaggcgtgagccaccctgcaccaccgtgcccagcctaatttttgtattttttgtattttttcatcatgttgcccatgctggcctcaaactcctgacctcaactgatccacccgcctcggcctcccaaaatgctgggattacagatgtgagccactgcacctggcctaaaatctggtttcttaaagggacaagaaattttttcatttgatcatataaaatgttacagtgcttagcaaagccagtcatgttttaaactttaaatggtttggatgggggcttcctacctcccagattcagggcagcactgagagagctcagagggcctcctagaatgtaactaccgtcattcacagctgcttagtgggtacctttgtgtaggagccttttcagaaagctgggtgctcaggaagacttgctggttaaagagcaggagttgagcctgttgctctcagggtccctgacctgcccttcatgactgcagtgggcatcttctgccctgagccctgctcaggtatccagagggcccctcaggagaaaggaaaccctaaagattccattcatctatcagggcttctgcaggtccagagagtgtggggagccttggggctctgcgggagaatctcttgcaaagagt

SEQ ID NO: 23639 - DNA, 1067 bp, Homo sapiens
atccctccttccccttctgggccattagaatccccacatccaaggaaggctatgagtccaagttattcaacaaagcttaacactgaacttgtgaatgcttgttgccagcaggttggggttggagagctgatgagagggaattggtatacaattccatgagagtagaactacctccaccatctcacttcagctagactctaagttcggcttttctctgctatcttcactcttaaacattgctatcccaaggctctcactgaagtctcctgtgacacagacagactgtgccacactcattctgtagatgagtaaactgaggttcacatagatgcagtaactcacgacagaccacatggcctaagcggcagagctgaaattggagtcggctttgcctgcttcccacacggaggattttccctatatctatcctcaccctctaagttcctcacctcccctccccttactggtcacctccttttctctacccagtgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggtatgtttcctagagccccgccccgatctgatccctgctctaatccccgtttcatccccgttctaatcccaataagagtattcactcctcagatcctgtcaaagaatgttcttagaagggctggttcaatcccagctgtttgtttcactcaaaaacaaaacacaaaaggtctttcccccaattagaaaggtagtaagacctattatggaaatttggaaaatacagaaaagtataagaaaaaaagaaaccttaattccacgcctagaaattaaactactattaacattttaatatatttctttcatttagttctgtgcatgtactgtacttttttttttttttttccttttttactatgttgtccagacaggtcttgaactcatgggctcaagctatccttccacctctgcctccttaagtgctgcgattataggtg

SEQ ID NO: 23640 - DNA, 1024 bp, Homo sapiens
gctacaaaactaaaaatgagatggctaagtgacagcaaaatctaaggatgtcaggatgctccactctgctgccaggagactctccggacttcgtttgccttgcttgtcttatgaaggatggtgtgaatactcgctatcacataaggaggggcagcctagtgtggtggttaagagaaaagactttggggtcactgacctgttgaatcagaatattgagttaggagatggagaagctgcagttttaagaaatttccagctgtgtgtggtagctcaggcctgtaatcctagcactttgagaagccgaggtgggacgattacttgaggccaggagctcaagacaagcctagacaacatagtgagaccctgtctctacaaaaaatcttaaaattatctgggtacagtggtgcgtgcctgaagtcccagctacttggggagctgaggcgggaggaacgctggagcccaggagtgtgaggctgcagtgagcctgaaccattgccctccagcctgggcgacaaagcaagactgtcttgaaaacaaacaaaaaattcccaagtgattttgatgcagaccaaagtttgaagaacagtgtagctcccctggactcctgatggttcccaaggaagctgtgtatttccacaccccctcctatgcgccccatgctctccccgctccctgagccgctttccactcagtccttcctatgcatgcatcagaagcatcatcttttgggtttgcttccactaagtgaactcccactcttccttcaaaactaggttacacatcacttcttgcccaaaacttttcctgaacctttgcagaggaatgaatccttctcagataccaaagaataccatgcaaccatcaaagagaatgagggatggaaaactaaccatatttttagaggagaaaaaaaaactcacaatatttctattttgattcagtttttcttaaatgactgtacaaataggtatatatagtttgaatatgtatatagaaaggtctgaggaatatacatacctggtaa

SEQ ID NO: 23641 - DNA, 1048 bp, Homo sapiens
ctcccgagtacctaggactacaggcacaagccaccatgcccagctaattttgttgttgttgttgctcaagacggaatctcactatgttgcccaagatggcagacattttttgtaagggccagatagtaaatattgtatgctttgctggccatattgtctcaagtcaaaactactctactctgctgttgtaaagtgaaagcagctatagacactaggtaaatgaatgggtgtggttgtgttccagtaaaacatcttgaccaaaagggaggctctagctcataatttgccagcccctgcttattagtcataatcacagaggggactctattctttcctggttttgctgcagtcctattttgtcctagatattaataggttgtttaaatcttcaaaagtagtttccactctcccctaaaagaactcagaatcctcagagaaatgccttgcttcaagaccgaggcagggaaactgcaagttgatcctggaacaaattattcttctagaaagtaaggaacttaccaaagaatgatgggatgtgtcaacaagactcaagagccagctgtaaggggctcccactgtggccaccaatactgggacactatgaacatcaaaataaatgataataatgtattataaccctttgaataaaataatcatctatgagtttatactggcctaaataaataaaagaaaaaataaatggaggaggaagggatagcttttcctttatgatggagttaaaagttaagaacagttcttaagtaggttggaggccaaatcagaatggggactttttcaaatacctgagggtctttctaagagaggtgtgtgtgtgtgtgtgtgtgtgtgtgtgtgtgtgtgtgtgtgtgtgtgtatgtgtgtgtgttttggaaaagctccccacaagatactaatgggccttttctgtttggggactactgatattccggccacagaagacagtggaaagatagcagagggaagtatgtcttcagcttgcttggcccattcatatctgcctatcgcctctattccttgttatcctcat

SEQ ID NO: 23642 - DNA, 1032 bp, Homo sapiens
gattgtaccactgaactccagtgtgggtgagacagagtgagatcccatcattcatagatagatagatagatagataactgatagataggcatataattgatagataggtacgtagatctaaacatagaaagggtacggtgaactatgattgcaccactgcactccagcctaggaaacaaatcaagaccccttcattaattcattcattcactcataaataaataaatgcatatatacacacatacgtacatacatgtatacatacatacattaaacagaaagggtacagtaaaaatacagcataatcttatggaaccactgtcgtacatgcagtctgttgttgatgtaaacattgtgatgcggtgcgtgactgtgttttcccccggcttcatggactgtaaacatctttccatgtgttttatcaattgggattgtgttttgaaacaagtaacagcaaaccctgtcaacagtggcttgaacaaataatggggtattttgctcgtgaggcaggagtctgaaagtaggaggtctaggctagtggaacagctcaaggacgttgccaaggacactcctgctgtcttaggcggctgtgttgctttacggtctcaaggtggctcttaactctcagggaggctgagaaagcaggcattttgtgttactggcctctctattggagacaggtaaggaagaagggtgttgggatgggagctgagtcacccagccagcagtgccagcatcattacatattctagaacatccctcttttcagagtggcattgtttggatgtgtcacaatttatttaacaattcattgttggacatttcggtggtttccagtttttcattattgtaaacatgctaatatctaaagttttacacatatctataattagtgattcagtataaaattcctagaagtggaattaaggtcaaagagtatataaaatctaaaggcttttaatctttttttttttttaaccaaactgctctccaaaatggctgtactaaactatattctcaccaatcatgttt

SEQ ID NO: 23643 - DNA, 1043 bp, Homo sapiens
caatttttgtatttttagtagagacgggtttcaccatgttggccaggctggtcctgaactcttgacctcaggtgatccaccagcctcatcctcccaaagtgctaggattacaggcgtgagccattgcacccaacctcattcttttttggtcagcctcttctagctcttaactcatagttcctgggaattccttcatcagcatcctaagttctcctttcctgactacaaagggaaatagtaaagagctttttctaggttgtcactggaatattctaggcccctcttttttttttttatttgagatagagtttcgctcgttacctaggctggagtgcaatggtgcaatctcggctcactgcagcctctgcctcctgggtccaagcgattctcctgcctcagcctcccaagtagctgggattataggcacccgccgccacgcccaacaaattttttgtatttttagtagagacaagatttcactatgttcgctaggctggtcttgaactcctgacctcaggcggattcacccgcctcagcttcccaaagtgctgggactacaggcatgaaccactgtgcccatctaggcctttttttttttttttttttttgagacggaatttcactcttgttgcccaggctggagtgcaatggcatgatctcggctcaccacaacctcctcctcccaagttcaagtgattatcctgcttcagcctcccaattagctgggattacagggatgcaccaccacacccgctaattttttttgtatttttagtagagacggggtttctccatgtcggtcaggctggtcttgaactcccaacctcaggcaatccacccgcctcggcctcccaaagtgctgggattacaggcatgagccatggcgtccggctaggcactttttaatcactattttattgacatcctccctgccccgcttccaatgcacaacactgcattgagccccctgaggtgaaggacatgtattctatttctctgttacttccccctaccaatagaaaatatgcacagtcagtactaag

SEQ ID NO: 23644 - DNA, 1024 bp, Homo sapiens
caggatttaatagcatcgtgttagccaatttccatttcaactcaggcatcaggtgtcaggtgtcaggcatcaggatccccattttactgataagtatagattcagagaccaaggggcttatccaggggcacacagctacctgcttctgctgtttctttttaaaccccaagcctatgcacttgcctctcatcaacatttacttctaacttatttatccacatatctcgcacctatttctgagaaagatttgaggtagcttacagtaaaaagtatgtacagttaaactgttggagaacatttaagaccatggtatttgagcttcaactatagctcagggcttgctggcactggaggcaaacatgagatgccatgggttatgtatggatagagctggttcatgagccctggcaagctttttcctggtgctaaattccaagaggagtttaccagaagtccttttcacagaggtcaatgaacaccgtttagtagtgggaaatatctttctcagttgtctgctagaaactgaagagtcagttgttggttctttttttttttttttttttttttttttgagacagggtctcattctgtcgtccaggctggagtgcagtggtgcaaccatgctcactgcagccttgacctccagactcaagtgatcctcccacctcagcctcctgagtagctgggaccacacatgcacgtcaccatcccagctgtattttaaattttgtataagggacgggttctcactatactgatcagagtggtcttgagctcctgggctcaagcagtcctcctgctttggcctctcaaagtactgggattacaggcatgagccactgcacccagccgatttgttggttctttttctttttgagacagagtctcgctctgttgcccaggctggaatgcagtggcatgatcttggctcactgcaacctccgcctcctggattcaagcgattctcctgcctcaacctcctgggtagctgggattataggcatacgccaccatgccccactaa

SEQ ID NO: 23645 - DNA, 1062 bp, Homo sapiens
ggataaagtgatgttctctatttctctctggcctccagaaatgtgtcctgagaatggatcttgtgtacctgatggtccaggtcttttgcagtgtgtttgtgctgatggtttccatggatacaagtgtatgcgccaggtgaggaattaggccgtctaactagggatacaaggaatgcatagagcaagtcttctcagaaaggagagccacaagaccaggagctgatacaaatttcctataggtggaaaactatagaattgccctagacaaagtgataggtatattaggaaagaactaggtgttaggatgtggccctccgtgtaacgttgtatgggggtgttttttggtctgttgttcacagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttttttttcctctctttctttttaaggaaaggcgccctgcctttacgtgtttcttgcttggggtgggagggactgctttagggcagccggttttttcaggtttcccccggttttgcagtgcggagaccacgggggcccactccccgtggctccgcggaccccgccccttacgtgcccggccccgcccctcacgccgcctgtgtccgcgccgccgcagtctctgctgctgccgccaagcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctccc

SEQ ID NO: 23646 - DNA, 1052 bp, Homo sapiens
ccatgttattttctttatatctttttttatgtgggacaggcacaccttggacagtaggaaataacctgtttgttcatctcttccactcattgcaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgagtgaatgggggaagggtgggcgtcgtgtcaggcaggatgagcttttggaagagcagaggcccaggccaaggtctttgagagttgtatgtccctcagacccaggttaggtgcagccccagaggtaacaggaccctggggtgcagccttctgcctctcctgactctgcttggcagtgacctccatggcaccccccttcacaggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcaggtaagctctaggccctggaactgatagtctagttgttaccccctcttcttgtataatttttggcccttgaggttgaggtcttttgggcttacagtccctggagtacaagctggaatcttctttactaggttacttttctctcctttctgagacctctcctagacagggtcttctaggccagtgactttattctccttctttgcagtattacatcattgaagtgaatgccaggctctctcgcagctctgccctggccagtaaggccacaggttatccactggcttatgtggcagccaagctagcattgggcatccctttgcctgagctcaggtacgaggatga

SEQ ID NO: 23647 - DNA, 1054 bp, Homo sapiens
actgtggaggggctgacttgtacacagtaaaatagagcacaacttatatctaggacagctcccttgaggtgctaccgctgtcaaaggaattgtttctcagatgaccagggtagacaggggaacagggactgagggaagggaggggcacccaagagaacattatgagcatatgtagattgcctcatctcattttctgtgtttatgtgaagggttgtatctctttctctaaatagcttcggaaggagtatggggccaatgtgcttcctgcattccccccaaagaagcttttctctctgactcctgctgaggtagaacagaggagagagcagttagagaagtacatgcaagctggtgagtggttgcaggaaactaggttgactatattgaggactatggggagagacttaaaaacagctggttctgtggaagggcctgatttaatttctagatctaggaaggctcttgtttgatctgttatgcagttagcaaagtaaatagtgtacgaggatgtgtaactctgtgtactagcaaaacaatttgggcactaacatctatgagaaatactagtataacactagtcttaatatcagtggagagaacttaatttgtatctgatgtgctttagattaacatcattgttatttccctagttctatagactggactcacctagatggcagccaagggtggggcaggtgaagaatttatgcaaacagtgagtgaggtgaggccagctgggggatgtggcaggccaccatcagcccaggaaatggggtcgggggaacctactgagaggaggactggggagccaagagtgagtgctaagttcctgtaataatgttctcttgtcctcgtagttcggcaagacccattgcttgggagcagcgagactttcaacagtttcctgcgtcgggcacaacaggtagggctttgggtgggaccaagatttaaggaaaggaccttgctggaaggtcatgtcttttatttttttgagacagagtcttgctcttttgcacaggctggagtgcagtggtgcgatctcagctcactgcaa

SEQ ID NO: 23648 - DNA, 1032 bp, Homo sapiens
tggcagacagtgttgaggaataagggggtagaacaggagtctaaaatgttttggtggattaaaagtggaacagattcaagggtattagctcaattctgagctgttttgagtttcactcagcaaaggtgggtaagaaggaggctacctcctgagctgtatgttaatacttcttatccttatttatccaagttcctgaggtctccaattgtcccagattaggaagggctgcctgtgtttttatgttatttgcagggtggatgaaaaaactaaaaccaaatattttcatgtgagcagggattagaggtacctgggatttagggaaggtgaacgcagtacaagtgaaaatttttccttaaacttcattgcttctagaccagcctgaagcccctgtgtatctgttaatttagtctggtgcttttgttgctcctgatttagggacattagatgagaagcagtaggcctaagaaaggggaggtaggtggcatccatgtgtggtctgtagttcaggacaggaaagggaatatgtttgtgcctgttgagggtcatcagaaaggagacttcaggagagaatttggcttttggggcctctctctggagtgagactattcttcattgatgatggtcagattgtgggtgtctcccctactcccagtggctcctgacactatcaacaatcatgtgaagacttgtcgagaagagcagaagaatctacacttctttgcaccagagtatggaggtgagccttcctgctttctctgccctgtcctcatccccctgcttttgcaccttataacttgaggtacagaggcaatataactgaaacttctaggccttctctaccagcatacaaaatatttttcttttcttttttttttttcctaaggcattcctgccaaccctagcccccaatcctctgattaaccaaagccttctctgttttccctagaagtcactaatgtgacaacagcagtggacatctactcctttggcatgtgtgcactggaggtgaggggactggaggggaggggggaa

SEQ ID NO: 23649 - DNA, 1090 bp, Homo sapiens
gattgggtagaattaaataagtttacaaaggataccgagatgaactaaagtacttttctaatgaaatctaaatatttgcacatggaagaatgagctaggggctcttaaaaatttttggtagatcagaaaggagttgaaaataggctaaactttttatgtttgtgatcagaagctgagagttgccacactggtggcaacaaattataaaataaatgcaattatgatagtcattgtatcacaacaaagctttttcttgttatatgtatggaaagggaagtttgagcttaatctggttttttttacaaataatcaaatgtcctggggttgatgggtagatattgtaaaatacttgagaattgtttttgttgagtgctttaaaaataaaacatgagacctggaggagggattccctaaccaccttgatttaatctccaagagttaattatgatcatatgaactgttgccttttcagtatgcttatgcttattcataagagggtatatgggtactgtatttctgagtcctacactgatagtaagaaattcctacatggagagtttcctaagagttattacatgggactcagctcttaatggcctgttggtaccatcaagtctttgttgttgttgttgttgttgttgttgttgttggagatggagtcttgctctgtcgcctaggctggagtgcagtggcatgatctcggctcaccacaacctccacctcctgggttcaagcaattctcctgcctcagcctcccgagtagctgggattacaggtgcacaccgctgtgccctgctaagtttttgtattttagtagagaaggggtttcacagtgttgcccaggctggtcttgaactcctgagctcaggcagttcgcccatcttggccttccaaagtgctaggattacaggcatgagccactgcgcctgtcccatcaagtgtttctagcattgtttgggatggtaggttttggccttagaggcctgccagtccattaatttttaaaaatacctttattgaggtataattagagtacaatagactgcacatatttaaagcgtacactatggtcagctttgacgtatgtctg

SEQ ID NO: 23650 - DNA, 1057 bp, Homo sapiens
ttctagaattaaagctgcctatgctgctctgcaagtggggttcatcctcattgcaaattcttacttgagggaaaaagacagaattggaaaactcaccccatttggggcacttctcccaactttgactcccctgcataatttacttgtttttgtttgttttacagagtccagtgagcaggaggggtgggccttagtgggcttagctgcccctccagagccaggacttctgtgtattaaatttgtgttattggacctcatgtgtggagagccgaaactcattcttccctatttgtaacatactgacataaccagtctctgttatgtttactcatccccatttccatcccctccctcctagaggaaactgtataaacaagtgtgatgtttgcacttaaatatttatgactcctttaaaaaataagctttaaaataagctgctttatgtgtggatttgtttttagcttgctgaactgacattgtgctagagatactgttttgtttcttttttcattcaacaatatactttttagttatggtcgtgtctctatgtgtagaattagtttattgcttctaacagcagcacagtattccatagtaggcatctatcacattttgcaaggatggtcactgtgttacttccaactccctgatgtcataagcaaacctctctatgtgtaattcttattagctctacatctaaagtgttaccttgaatctgccaattcaagttaacttttttccttttgtttactctttctcccatgggctgtctccatagagcagccagaaggatctttctgaaccataaatctaaagtaggcctcacaggtatttagctggaaaagggaggttctaggagtccattgaccactcttggagaactgctgctctgctgcatcttgagccacctagaagaatgtctgatgctttgtagttacagagtaatgttttttagctgtcatactgactggtcttagattttggaatctggattcagctgtataccagaaatctctggccaggttaattcatgcaagatagcatccatcctttagct

SEQ ID NO: 23651 - DNA, 1028 bp, Homo sapiens
gagagagccatctttaaactatcacagctatagtagattcagtactttgcagaggagtaaatataaaagaagtgggaacacatttgcactaaataaagcagattttaaaaaaaactatataattttctgtgtttctcttaagtgtcagagaaagtactgagggaaggaaatggcttaatctttcctaaacaacttgttcaccttctgtttcttttctttttacctttccttggctttccttcttttgcggcttgcatgtatattcttttttcgtttgttttgtggcacaaattattggttttcttccttcaaatgtggagttggtcagtgtaaatggccagattgttcagagaagggagctatttggcatagtcttcatactatttcttctcttttgcagggctgtgaggctgtctacagcagtgtatctggccttaaagctcacctgggctcttgtacattggtttgtaactttttaaacttactatcttaacatgtcctctaaaatagtctgacatggaagagaattcagtttaggtgaacagctagttgtcctgtttaccattatcttcagaggctgctttagatttttatgtctctaagattcttggtctggtattgggtgggatgccagggcatgtccaagacttagaaaagatcaccatagtcacaagtcattatcaatttaaaggaattggaagaaacatatatttgttctgagttcctatccctgaattctaagagattcagctccttgcatttgagcatctcctacactgggcctgccctgtttaggtgggcctaaaactttgtagaatcaccttacatgtgcttacctggattggtaaagatcctctatacccatctgaaccatactggcctctcgggatgggaggtgggatagggtgtcaggctaacagccattcacctcactgaatcttttccatgttgacccaggtgtcctacaacctaccagccatgggaattgctgccattttccaatctcctcacacaaaatgagcaccatg

SEQ ID NO: 23652 - DNA, 1026 bp, Homo sapiens
gagaggaaggaaagaaattaacagtggtaaatttgattgttcattgaactgttgcaacttttctgaaggtttgtaatttttcaaaataaaattttaaaattgtgtataaaaatgctttaaagttcagaaggtcaagggttttctcttggggaaggttttttagtaatacaggtgaacagagaaatcgtttatgatataattaaatagtcctactacaacagcttaggaatacaatttgcattctcttggaatatctcactgcagaaactattgctgcctgatgtggaaaaataaagggaacacctttatttattttctgccctcaaatttgatagtacttaacaatgtgagctttaattacttccataaaatttggtttctgttgctttactggcataagctttcagaatccctaaccaaagcctgagatgtcttctgaaggcagtcatatctttttagtaataatagcatatctttttttgctttaggaagtatttaaaaggtaattatcggctgggcacggtggctcacgcctgtaatcccagcactttgggaggccgaggcgggcagatcacctgaggtcaggagttcaagaccagcctggccatcatggtgaaaccccatctctactaaaaagttagctgggtgtggtggcgggcacctgtaatcccagctacttgggaggctgaggcaggagatttgcttgaacccaggagacggaggttgcagtgagccgagattgcgccactgcactccagcctgggcaacagagcaagactctgttaaaaaaaaaaggtaattatctcctgacaaaatctggcctttatatagttaaatggtttgtctattttcttcctaaaaagttaaaatcaaaagaattggaaccaacaaatttcacttggtttggggcatgctcccaggcatttgtttattgatttatgcctctatgaattttgtgggtggtaaaacatctttaccctgtttcttcctccctccatcacattttcttacactactttttttttt

SEQ ID NO: 23653 - DNA, 1166 bp, Homo sapiens
ttacaaatttgccatttattgaagaaaccggatcacttgtcacatacatgtacccacattctggaattttgctgattgcaccctatgatagtattcctgtattctggccatttccttttttgctttttgttgttgttgtttgtttttgaggtacagggaccactgcagtggagtcttgcagtggggcagagagattgggctcaactccctattctggcttttcctatgaattggtagatttagaagattgaacagatcacttgataagattgaagttctttcttttttggcaaaaatacttcataattggatttcatgtcccctaccccttaattttttaaagtgagcctcgaaaatgttaagtaattcgcccatggtcacgtatctagaaacagagctgggatttgcacccagggggtctggctgcaaaatttatgctcttagttacgatgccgtcatggaataaaaatctcctatggctcagtgtgttacatctcatgatgagatttatactcaggagatataagagtgggatgatgctaagtaaacagactttgtagatcatttattaaagtccctagaattacgccttacaaaatatgtgcttgtaatagctgctctgtgttggatttctccatcttaaaatatagaatcctgaggtatggttccatatctgtttccttcttactgtgttctgccctaatcatgccttttttccattcttcctccacctttctttatgttcttcactatattttcgactggatgacatttctattttgcctctctaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgg

SEQ ID NO: 23654 - DNA, 1052 bp, Homo sapiens
ccctgctccagtcccggctggtccagccctgaactgtttaaccgcctcggctaccgaataagcccgagcagccggtcctccagtggctccgctccccgttctctgtgggctcaaaatgacaggcatgctcctcgttttcttgctgtgtgagccctgccctcgggaccccatctcttctggccttcctccgggagacaaaagccctcccaggctgcagagatcagcgcccttttcctagctcccttcagccttcctctcgcttgctcagcgcccccacttcctcgccactgtcactagttgactcatcagccctgcccgacgctaagaagatgccctggcaaccgccgcgcccctcacccgctcctttctgacgctgtggtggttttcgttcgcagcccagaacattgcggaagtttctctacccatgcggtgtctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacaggtgacgtacacagcatgggtgtagtaggggagcgcaaaaggttgcctccggcaggcggaaggccaggaagaaagggagggaagaggatttggagggtaccggcgcatggctttcgggggcttcccatcaactttagttccttccccggcaaagcctcctcgggccctagccaggttaattaaggctctcttctgcgcaccttcagggcatactcggtccagcttaccacgttgtacaggaattgtcttgctgataaaattgcgtttctcggaggcaagttacaagtaactttaaagattaatacagtgctagcacacaggttttggtgaagatttgccaaatatttcttgcacgcctgtcatgttccattcactggggatatagcgaaaatgaggttgacaagattcattcgtggggccaaatatttaatggaggagatagagaaaacccacatacgaagaatcaaaacaagtaa

SEQ ID NO: 23655 - DNA, 1031 bp, Homo sapiens
ctcatatttcttggtttatttccttgcacagtagtacatccttctgtacttttagcagattaaaaagctggtacaacactagagggcatgggtgatgatagtcttcaatgaatttcacatctttccttttcttggtctactctcttgttttggtggacatcctctagtagatttcagagaaagagtgtataggaaataaattttattaatccttctcttctgaaaatataattattgtagcttcactcctgattaatagtttggctgggaatacaattctaagttggaaacaatttttcttattttacattcagtgttgcttttgagaaatcctaaactgttcagattttgatcctattgtatgtcatcttttttttccgccttgccagagcttgtaagagtttccctttgttctaaaggttctaaaactatgaagtacttttctgtgggtctatttttcttcatttttctgggtacttgttggatccttttgatctagaaaccttggctgttcaggaagttttctgcaattatgtcattaattgtttcgtccctctgttttctatggaattttattattcagacattggacctcttggacagaccatttaagttttttttcttctttttttcatctgtatgtcttttccttcttgagagatttctgcacctttatctttctgtcttctctattttgccatcaaggttttaatttctttctctttttttaaagtttttaaaatcaggcagtctttcatgccagagaaggctcagagactccaaggttttaatttctaaaagttcatttttggtttttgaattgtcctttttaaaacataatatcctcttgtttcatgggttgtaaatatctcctctctgttttctccatgttatttttctttttatgtggtctctgttctgcatgttaaaggcttttcttaggtgtcatgtaattcttcattgtagtttttttatttggggatgaaaaaggtgattgacagtttggaatatataggtggggtttctgcatg

SEQ ID NO: 23656 - DNA, 1032 bp, Homo sapiens
tgctttaatgaaaaattatttaataagaaattgtgggaaaatatacataacagaaaagtgtaccattttaagcattttaagagtatcactcagtggcattaagtacattcacaatattatggaaccatcaacactgttcattttggaacttttttatcattccatactgaaattggtatctgttaaacactaacttcattctccctccttcccagcctctggcaaccaccattctacttttctgtctctatgaatttgactactttaggtatctcacatgatgcagtaagtgtccttttatatatggcttatttcacttagtataatgtcttcaaggtttagccctttgtttttatacgtagtttggcagcttgtagaacctctctttcagtagttgatggtgacattttaagctccttgcctacttgccttctttctttttcttttcttttttaaaaacttatttattcatcattttatctacctctagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggcaagttttatttatggaagtagctgtggtatttaatagtttaatttttaataacataatgtattatttaaatatgttttatgataatttttaaagtagtagcattgaaatctgatactgaagtataacttttgtggtctgttaatttaatggtaacagacaactagtcttatccaagttgtttgaaaaaaatatggcttgctgctagatcctttccttcaggatattgatccattaattaacattctttggatatgatattacctctctcaaaaggaaaggaaaaagttccaagttagggcgttctgaggtgaaattgactttagccttctggcagtcaagagaagtcaaaggaattttgaagaatgtagtatggtaata

SEQ ID NO: 23657 - DNA, 1037 bp, Homo sapiens
gatttccctgctaccctacaatatatgtctgtctgtatgtttttgctttatctatattcctattcatagattcagcttttaaaaggttttcattacccctaagagctgaaccttgagtattagtttgctagggccaccataacaaaatactagggattgggcagcttaaacaacagaaatttatttgttcacagttgccagcagggttggtttcctctaaggcctctctgcttaccaatggctgccctcttgctggctcttcagatggccatccctctgtgcacttgcactcctggtgtctcttcttcttcttctaaggacatgagtcatactgagttagggccccaccctaatagtgtcattttaattcagtttaatttaatttacagtcatattctgaggtactggggcttgggacttcaaacatgaatttgggcagcagggggcacaattcgtccaaaacaccctgaattagggtatactgccctctggtggcagaaatctgaagtcctagctatgtattctttttgtttgtttcattgagagacagtctcacactgtcacccaggctgcagtgcagtggccatctcggctcactgcaacctcctcctcccgggttcaagcgattctcctgcctcagcttcccgagtagctgggattacaggcacccaccaccacgcccaactaattttttgtatttttttttagtagagacagtttttcaccatggccagactggtctcgaactcctgacctcatgattcacctgcctcggcctcactatgtattctgaatgagtaatggtttacctaacaagtaggcttttcaatctgttgcggtggggacttaggttttaaatagaaaactttttactaaacagccctccttagagaattttagaactaagtcctatatttaaaagataatataggccgggcgcggtggctcatacctgttatcccagcactttgggaggccgaggtgggtggattgcttgagctcactagtcgagaccagcctgggcaacatggtgaaac

SEQ ID NO: 23658 - DNA, 1034 bp, Homo sapiens
atcaaccttttctaataaatacttttattgaatggctttgattagaatatttagctttattctttgagaaatgtcttcctccttttcttcaggatctgtttgatggatttacatgccttgtttccttgaaattacgctaagtctaaaatgaaaaagcagcacaaatgacttatttctgattgtctgatttattccttagaagattttgtaatcaattgaaatcctttaatatcatgagttataacagtccagaattcctgtagctggcactcatctgaaataactattttagttccttacaagctattttcaagtgttttgtatttagtaatctttgactctaggaactaataaagacacttgtttagggtctatagaggggtaaaatttcatgtcaaagtcccacctccagcagacttctgtggagttcatcaacctaaaaagagtaaacattcagtacatttagactgacctccttgaaaagatttttctcttgttgtcattaagtagaactacttgttcatggttttgtttccctcttagaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatggtaatatctttcttctccttcctgtgttgttcagtgggcagttacattgattgtggataggttttaaaaagcaaggccagttcttgtctgtgcatttgactttgtatgtgatatactgactctgtagcaaggaaacatactttcttggtcttcttcctttgaccgccagtcattatttgtcttcattgcaaattaagggcagttatttccaatccattccagaattacagaaaattgaaggctatggaat

SEQ ID NO: 23659 - DNA, 1041 bp, Homo sapiens
atatgtgatatggcatttaatgacatttaatatgtatggaatttactttcgttagcttcaaaaaagaaataaaaatacctctacccacattcataaaatgatgtgaaagaccttgttaatctggaacattattgatgccttttatgtagtacttgtctgaaagattcagggaagttctttagaagttcattaacaattccttcttcaatccttccatcagccgaagtgtgaatttctcgtttctgtaacaaaacaatgacagagttagggaaaagaatggcttctttttggtgtgtcacttttggcattcctttcttttagatcttcagcagacacagttatgagtggtaggatctacatgtctaatttctattaactcgaagaggtataccctataggacacagtataaataaaagtataaaacaaggagacaatttttaaaggtcacaagaaccagtcttattacatgtagccagttggccttgaagagataaggtctaagttatctatattctagatctggttcataggagaaataggcaagaacctaatcgaagcaagatttcttttttttttttttaaatagcaattcatatatatttctcttatgttatctagatttttctaccttacttaataagactgtgtatgtttctaaactccattgctagacccatcagtatcttaagggccaagttcttgtttaatttatgtttatacctccttaagatctatcttcgtacttttcacatgtaatgtagtaagtaggatttgaatggatgaatgaatgagttagatgttttccttgagaaactacttgttttgggtatcagagtggtttgttcttgtggtttggaaggatttttattggcctgatagtgtattgcttactttctgttatgcataattctttttaatgacattccctgaaatgagttgacatttttgaaattatagtaggccgggcgcggtggctcacgcctgtaatcccagcactttgggaggccgaggcgggcatatcacaaggtcaggagatcgag

SEQ ID NO: 23660 - DNA, 1048 bp, Homo sapiens
cttttaatatgcttattggcaattcagatttcttcctttgggatatcctttgttcgtcttttaagtggattgtttgtatatttctatagattttaaagcattctttgtgtattttggatactgatcttttggtaattacatgtattacaaatatctgcacaaagtctgtggcatatattcttattttagtgcccctgacatccaagagttttgattttgatgaagttatattctacagtattttcttttttagatttgaatatatgtgcctgtgtgcacgtgtgtgtgtttgtgtgtgtgtgtgtgtgtgagagagagagagagagagagaaagagagttttaagaaatctgggcctatccaaaagtcacacatctttctttacgaattttaaagttttcctgtttccttttttggtctttaaatgggaatttattttttctgtaatatggagtgagatagagatattgtctcccccaccccccccaccgtatggataattggttgacctagcctcatttattgagaaggccatccttgcccatggatgtcaagtttatatcacacatgggcctgttgccaggctttctgttttggtcagtcagcctcactgtccttgtgccagttccatactttcttaactattacagtcttgtgaaatgtcatgatagccagtaggacaaattccccccttccatcttgttctaattcttaaaaattgtcttgcttaaccctgtgttctacatacgtttttgtaacctcatttaaatagttgtatactgtttcattaggaaacataccataatttagttaacaaaaaaacttctttttaattaattgagaaagagaaatgaagagagattaccctgatgagaggcaaattgagaattgaaggttagagaagctctctctgaggaactgagatttaagttgaatcatgaaatagatgaatatactagtccccccttctcattaggggatatgttccaagacctcccctagtagatgcctgaaacctctgatggaactctgttgccgtcagtcagaac

SEQ ID NO: 23661 - DNA, 1031 bp, Homo sapiens
gttttttgaatatttttgatcaactggtttgctgaacgcatggatgtggaacccacggatagagagctgactgtagccattgtgtaactggagtgagatgatatctcattgtggttttgatttgcatttccttgataattagtgatgttgaacattttttcatatactggttgaccatttatatgtcttttgaaaagtgtctctttaggtcttttactcatttttaattggattattttcttctatttagtggcttgaattctttatatattccacatattaacctcttgttagatgtataatttgcaaatattttctcccattctgtaggttgtctctgcagtctgttgattgtttcctttgatgtgcagaagcttcttagtttgatgtaatctatatatttttgcttttgctttctgtatttttgagagcttttccaaaaaattcttactgagaccaattgtgacgaggcatttctcctatgttttcttctagtagtttcatagtttccgatcttacgtttaactctttaatcctttttgagttgatttttgtatatgatgaaaggtaagggctagtgttactcctcttcatgtggatatgcagttttcccaacaccatttattgaagagactgtcctttctccaatgtgtgttcttggcacctttgtcaaaaatcagttagctgtagaagcgtggttttatttctgggctttccattaattttagcaaccttaaatctattgtatacaagatcagtaaggtcatagtgtttaattaccacaatatttgtgatagaattcagcctcctacaatcaacataatattcgtctttagatgaacaaacacttctcagcaacacacattttaacaaatgtagtattctaatacaaacacacttaattgaaaggttatatagttttacagactcttggaagataactatcacagcaaacagaaaaggtctttgccttttttttttttgagacagaatctcgctctgtcccccaggctagaatgcagtggcacggt

SEQ ID NO: 23662 - DNA, 1028 bp, Homo sapiens
gctcatactttattcccaatctctagttgagtatctggcatttagagaggtttaataaatgtttgtggaaagaatgagccgtgttcattctttggatctgacaacaatgaggtttgataggaagtgacagaacttaattctgccagttctttgaataatgctgtttatgcagctttgaagagagattattgaaatattgtaagttatattgagcaagtctgtggctagtaaatcaaacagtttgctaacattggttttacatttgaaattatctgtggtttaaacaatttattttaatcaggggctgttttattataagaaacccactggaactaacataaattgaagaatttatttgtctttgtaaggaatcaagtaaagcctatgatgcccaagggcagaaaggacagccaggttctcagggactagaaccgggaactggaaggctggtagacatagtcgccagtcagcatctgtgtccatgtttgtgtctttctcctgcaacatattctattgtcactgtattctaaccgcccctccaccccaaccaacccccgacttctgtttctccccacattgggtagaaatgacttcctgagcccctacatgaggactcaattcaaggccaccagagaggttgtcattgagtttaaattcctgggagagaggatctgattggcagcttgggccaagtgaccacttgtgatcaagttatatggccaggatttctgggtcatgtattatcaacctgattagtagaggttagttttaacacaagataagataagcatagcctggcagatacccagaaaggtatctattaccctgtttcaggaattctttctaaagaatttccaaatgaaaatgtagacatttttttgtctttaacaatagagcagccaggcgcggtggctcacgcctgtaatcccagaactttgggaggtcgaggcgggcagatcacaaggtcaggagttgcctggccaacatagtgaaaccctgcctctactaaaaatacaaaagattagctg

SEQ ID NO: 23663 - DNA, 1043 bp, Homo sapiens
taataaaaatacaaaaattatctgggcatggtgacatgttcctgtaggctcagctccttggggggctgagatgggagaattgcttgagcctgggaggtcgaggctgcagtgagtcaagatgacaccgttgcactccagtctggatgacaaagtgagaccctgtctcaaaaaaaaaaaaaaaaaagatatcagtttatttgaagaattaatcatctggaaagtgcttttcaaatggttttcttaaactaatgtaaatttcttttagaagtttttctgatacagtcttcagaatattcatacttagaaaggaaataaaaaggacctgtcattttcttttatttcaggggatatcattttcaatgcccaatacccagaactgcctcccgattttatctttggagaagatgctgaattcctgccagacccctcagctttgcaggtgagtactgcagacttgcttgaatgatctttctttggtgaaaggaaaacaaaattggctttcagcagttgcttaacagatagatttgtcacacatctgcatttttttcccacccctcttttctctgtcctgtgaaatagatggaactctttatgtgccatagtagttaaataagaggtttttttcattgctgtttagtttcagggtatttcgaattaatgaaagtctctagcatattggttgaaatatttttacttcagtttaaagagacatgttgaaaatattttctttgttttaacataatatatcatgcctgcaatcaattttctaatgtttactaacacttcattacagggctcgttaggagagtgtttcttggctcttcaaggagccgtttttatatagaagtgaaagtggcaaatttggacttgtatccgcattatctcagtatctcagtattgttatcagaagggtaaagaccagattaagtgttctttatcaagcaacaccagaaactttgtagttgaaataaaatgtttctggaattaaagcagaaatattcaccattagggaaagggtggtggtacttgttggagcacatatg

SEQ ID NO: 23664 - DNA, 1047 bp, Homo sapiens
cactattattattatttattatctctattttatattgccttgttaacatttttgtcatggatgtgtgtatcagaagaaccagtgtgtcttagtccattttctgttgcttacaacagaatacccgaaactaataacttataaagaaaaggaatttattccttacagttatagaagttgagaagtcctaggttgagaggctgcatctgataagagccttcttgatattggggactctgtgcagagtcctgagatggtgcaaggcatcacatggcgagagggctaagcatgctagcatgctcgcttaggtcaatctctctcttcttgtaaagccgccagttcccctcttatgataacccatgaatccattaacccagtaacccatgaaaggccccacctcttaatactgccacattgggggttaaatttcagcatgagttttggagaggacagatattcaaacacagtgtttattaattgcaacaaagcacaataagcaaatttgtgaattttattttgatttgttttgatttccagaacttaaagttggcttatcatacctaacattttgattaaagtgtttttttttttgagatatgaaatgtaagttttgaggtattccaaaaccatatagtttacatataaaaatcatcaatgggtgatctgtgagagaaaacagttttttaagcaacatattttttccttaataatgatttatgcttttataatggggatgtgagacaattaccttttttgcttgtatctgacccaaatcctagtaaggttttaaaaatctttggcttatccattaagctctggcaacattaaaaatattgtggagaaaagaaaggagccattttatggtatctcctcacttgagttaatgtcttaagcttccctcatgtcatcgtgctgcaatatcatgtgcaaagggaaagtatctgagcaatgtttgagtgtgagctcctctacacagaggccatttgaagatgtgttggagagggagagtgatctagggggcaggagctttgggttttcattctgccaccc

SEQ ID NO: 23665 - DNA, 1875 bp, Homo sapiens
gggtgcagtgggtggatcacctgaggccaggagtttgaaaccagcctggccaacatggcaaaactttatctctactaaaaatacaaaaattagctgagcatggtggcgcacacctgtagtcccagctacttgggaggctgaggcccaagaatcacttgaacccaggaggcagaggttgcagtgagccgagattgcaccactgcactccagcctgggcaacacagtgagactctatctcaaaaaaaaaaaaaaaaaaaaaaaaaaacctcactgagatataagagaacacagataaaccgtacaaagaaattggaaaaacaattcaggatgtgaatgtgaaatttaccaaagagatagatatccttaaaaagaaccaaatggaaattctgaaactgaagaattcaatgaatgaaataaaatatttattcatgagcttcaacagtagactagatcaagcagaagaaaattcagaacttgaagatagctcttttgaaataacccagtcagaacaaaaaaaaaaaaaaaagaagaaggagaagaaattttaaaaaatgaacaaagtgtatatgacatatgggacaccataaagtgactaattcaaattttgagtgttccagaaggtgaagagaagcccaaaaggcatagaaaagcctgtttaatgaaataatagctgaaatctttctaagtatagcaataaattgagacattcaaataacaagaagttcagagattctcaaacagataaaatccaaaaaggttcttccctgcggcacgtgatagtcaaactatcaaaagccaaagacagaaaattctacaaacagcaagagaaaagtgtctagtcacatgtaaggaaacctccatcagactaacaagagatttctcagcagaaactttacaggccaggagaaaatggcctattcgaagtactgaaagaaaaaaaaaaaactgttagccaagtatactatgctcagcaaagttatctttcacaaatgaaggagaaataaggtctttcctagacaagcagaaactgaggaaattcatcaccactagtccagccctacagtaaatgcttaccagggctctacacctgaaagtgaaaggacaatatctatcatcatgaaaacacccaaaagtataaaactcactggtaaagcaaacacacaaatgaggaagggaaaggactcaagtgttaccactacagaaaattaccaaactgcaatgataaacaataatagagaaagaaacaaaggatatacaaaatagccagaaaacgattgaacaaaatgacaagaataagtcccctcatatcaataataatcttaaatgtaagtggattaaattttccactgaaaagatacagactggctgaatggacaaaaaaaaaaaaatgacccaattatatgctgcctaaaaaaactcacttcactggtaagacatatatagactgaaaataaagggatggaaaaagatattccacacaaatggaagccaatagcaaacaagcagaagtacttatcttaatatcagataaaacagactttaagtgagaaacagtaagaagagataaagaaggtcattatataataataaaaagatcagttccacaagagaatattacagttctagacatatatgcagacaacactggagcacccagagttataaagcaaatagtattagatctaaagggagagatagactccaatacaataatagttggagacttcaacatcccactttcagcattagacatattatctagacagaaattaacaaagaaatattgaatttaaactgcactttagaccaaatggacctaacagacatctacggtatattctacccgacagctgcagaaaatacacacattcttct

SEQ ID NO: 23666 - DNA, 1059 bp, Homo sapiens
aggctattataacaaaatactatagattgagtagcttataaaaaacagaactttatttcctacagttttggagactgggaagtccaaaatcaagcaccggcagattgagtgtctgatgaggactcacttctttcatagatggccatcttctcacatggcaggagaggctagctccctgtagtctcttttaaaagggctctaggccaggtacagtggctcacacctgtaattctagcactttgggagcccaaggcaggcagatcacctgaggttgggagttcgagaccagcctgaccaacatggagaaaccctgtctctactaaaaatacaaaaattagctaggcgtggtggtgcatgtctgtaatcttagctactcaggaagctaaggcaggaggatcacttgaactcgggaggcagagtttatggagagccgagatggcgccattgcactccagcctgggcaacaaggcaaaactctgtctcaaaaaacaaggggggggcggtgctgtaatcccatgagggcagagccctcatgatctaatcaccttccaaaggttctacttactaataccattaataccatcacctgagggttaggatttcaacatatgattttgggagagacacaaacattcaaactatgacaaacatctagaagagaacataggaaaataatcttagtgaatttgggcttagcaaaaatttcttaagtatgatacataaaacaacattaaatataaaagaaaaatcagtacattacacttcaccaaaatcaaaatatttgctcttcaaggcacggttacaaaataaaacagccagccaacaaacccaaagaggagaaaattgcaaaacatatatatgacaaagaactgttatccagagtatacaaagaactgttacaacttaggaataagaagacaaacagcttaatacaatttaggcaaaagatttgaacaaatacgtagtcattggggaaatgcaaattaaagccacaatgagattaatactatacacctactagaatgggtaaaatttaaaagtttgaccaaaacaagcatt

SEQ ID NO: 23667 - DNA, 1061 bp, Homo sapiens
aatctgatatatagattcatgtaaacaccaccacaatcatgatacagaactgttctatcaccacaaaagaagtctcttgtgctgcctctttgtatttgcattatatttaggtatttctttttattttttgagagcaaataaaaatgatattacatttttaattttgatttccatgtgttcattgctggtatatagtaatacgattaacttttgtgtgttgattttgtgtccaacaatcttgttgaccttgtgttcatgagaatagttctgtgagtgtttttatagattccttggaattttctttgtagacaatcatgtcttacacaaataagggccgttttattttttcctttctgatatacgtatgccttttttcttgcttcattgcattggctaggacttccaataccattttgaataagagtggtgacagcagacaattcttgccttgttcccaatcctaggtggggaaacatttagtttttgtcattaagtattatgtttgctgtaagatttttgttgatgttctttatcagcttgggtaagttcctctctattcctagtttgctgaagttttttttttttaatcacaaattgtgttggattttgtgaaatgcttcttctgataatgcttatgcaatttggcaagtgaaatttttcctgtgactgttgccctccccaagcactccttgcaggccccatattgccatgcttaaatatgataaaaggagaaagattccagagaaagcaatttgggatatgaattcatattattgttaattctacatcaatgaatgtcaagcagaatttattatatactgctaactagactagaccttagtcagttttcaccatctttttcactgcatttacttctgcgtgtgtgtttgtgtgtagctttgtacaatttaatccaatatatagattcatgtaaggttctggattttgtagtttttctcctttcatagtaatatttattgaggtaggtagagagcaagggattaggagtgtgcactttggaaccagactttgttctaatgtggcctttatcatttactagt

SEQ ID NO: 23668 - DNA, 1075 bp, Homo sapiens
ttttaaaaaacattttgggccaggctcagtggctcacacctgtaatcctaggactttgggaggctgaggcaggctgatcatctgaagtcaggagttcgagaccagcctgcccaacatggtgaaacctcgtctctactaaaaatacaaaaattagcagggcatagtggcggactcctataatcccagctacttgggaggctgagggaggagaatcacttgaacccaggaggtggaggttgcagtgagctaagatcgcgccattgcactccagcctgggcaacaagagcgagactctgtctcaaaaaaaaaaaaaaacaaaaaaaacccatttattttaattcttttgaattaaaaaataaaaataaacattttggggacaattaggaaattttgaaaatggacagggtactagatgaattcagagaccaattgctaaatttgttgggtacaataatggtattgtggttatgtagaagaaagttttattttttagagatgcatactgaaatatttaagagtgaactgtcatgatgtctctcatttcctttgaagtgttgattgataggttgatagatagatggatggctggaggaagcaagtaggcacaatagtcacagttgttgaatgtaggtagtgggaataccggtgttcactttactattctttctgcttctctgaatctttgaaatttcttataataaagcatttaaaagattcccactctacttctcagctttgggtttctattccaggtgcagtacgtgattcaagggtatcacaaaagaagagagtatattgctgcttttctcagtcactttggcacgtaagttctgccctgtttgaacgatataccggtgatgccctcgcttgctgatgacctcaacatgggggcttgattaagaaaatagcacttagttcttacacatgataccttttttttttttgagacagtctcgctctgtcacccaggctggagtgtaatgacatgatcttggcttactgcaacctccacttcccgagttcaagcgattctcctgcctcagtctcctgagtagctgggattataggcatgggc

SEQ ID NO: 23669 - DNA, 1033 bp, Homo sapiens
caactcgtttgtcagtacattcagtaatgtagctattgctgttgcttttgaaggtttattccccacagaatattttctccttggtaccatgtgttcagtatttcttacagctccttctctgcctttctatcttagcttttccaaatcagacatgcagaattgagtcccaaagtcatcttttcatttcattttgaattaccttcttcagaaacatagaacccccaggcactcattagaacagctacccgggaccttgggagttgtttaattgactttttccagtgtttcctggagctcttattcctgtactcccccggctgtttggtccctgtctcttagcatcactgccacactcttggctcttctggcagataagaccctgcctgtgaaccaaaggactttgatgctgtttcctgctccctcactaactcacagcctgtctttaaataaattattttcacccatttccttttttcttatctaaaatataggacttgctacctcggagtgaagcttggttagataatgtgttttacttagtcatgcagttaagcatctgacacttaccttcctttggaagcatctgctggcttggttacaatgcccaagggaccacttgttcctttttctcccttccatgaagatggggaggggaatatgaggtggcagagacttaacaaagaacattgcagtgaattattctgagatctcaagaggtgaaaaggaggaaggaagtgcctggaaatagagccattcccctgtggctgcctctactacttcatggaggttgaagacctagcaggacatgaaatagcatctctgttctccccttcctccctattctcctcgggcccaggataattgctattgataggatagctcctggcaataattatgtgcattttggatgctagaggaaagaggcactcttcttgagacagacagctctgacctcagactttgccagactttgaaaaagcagattgccttaaggaaaagcattgcacagattctgggatctctcaggaggtac

SEQ ID NO: 23670 - DNA, 1056 bp, Homo sapiens
catttcagagctgtaggattggggctggggtggcagtgtttattcagtctaatgaatgataaggttcttactctgatgtttttctttattttaaatgactaatgttcacacagatgtcttagtattattctttctgtatttgtctttaactatctgtttgttcatttgttcattcattggttttcagttgacattaagtaaaaggaaagcaattattttgtttttcagagaacacagtttctggtaagactttttttttttaagccagaggaaatcaacaacttcagactaattctggtagtcatttaaataattctttccttataggcctgtaatcaaggccaataaattagaaatcaggacagcttttgaaattttaagtaaaaatcagaagcttctgtttattgctacaaatgcttctgccgagctctgattttgtcaggctctccaattcctggtataaccaaggaaattatttgcattgatgtcgcactgtcacctcaccactaaaacacaaagctgtcgtagtagcagccactcagttcctgagctaagcgaggtagactttcatctgcccgctatagaaacagtgtttcgtcgtagaatatttagcactcaacaaacaagatggctactacataaatcggtaaaaccaaaactgtgatgttgctcaaaacctgcttacttttttggatacagttcacatctttatataaaggaatatacttgaaaagcaaatcggaatcagtaaaataattaaaattaagaaccacaatgctatgtgttagaatttgtttcaagccaaatctatagaaagtgtaatattattttagaattaccatgtttacctcatatcagacataaagattcttagtttaattttatcatttctagtattaataactatcaggctaggtgcagtggctcatgcccgtaatcccagcacttggggaggccaaggtgggtagatcacctgaggtcaggagttcgagatcagccgaaacatggtgaaaccctgtctctactaaaaatacaaaaattagccaagtgtggtgg

SEQ ID NO: 23671 - DNA, 1021 bp, Homo sapiens
ggctttccttgtgtatacataggatctgccctaagaagatgggcattatttgtggtacgtgctgaaccagatgtgtctttgtggtttccatggcaaagctatcttggtgtgtatgtgtgtgtgtgtgtttcctaagtagacattttagcaagtatgaattgagtctttaagaagttgcagaccacaagcccgtgatttcagtataggaatatcgtaagtgaagcctgtttatcttaacagattggttcagagtttcaagagacatttgctttatgttaacaccagtctaaagaaaacatctgaagtaatgtttaaaaaatctgctttctactgtagcgaagatggatccattttaaatgtaataaaagagaaagccagcagctcgtgctagcaagaagaaatagtttaagtttccattcttcagctgaactgagtaaccaccctgtgctgtgtcagaaagccagataaacaccgtgaaagaactgtcctgcagtatagtcttgagattggtggagaaggttgaagacaaaggatggaaagagaggagggtcaactgtagcattccttccacaccctgtttctttgtcctgtgaaaatactgtacgtacacagtgcgtaaaaggctataattcacttggggagctctgcccatgacataaacactctcatggtttatgaacagcagtggagccttttgagtggaatcagctgtttattccctcctgtagagcaaaattctaaacaatgtaacctcagaaaggacacttcctggcactgaccagggcttttcctaccacatgtgcttctttctttctcatggctgtctagcagattctgtccctcgcaagtgaagcagcatttacaaggtgagcacaggctttggggtcatgtgtgccccagttgctattgcaaagtctaatcctgcaagctctgtggtcttgggcagagctcttaacctctctgaacctcattcctaaaacaggactgtactcctccctattggatggacttgctatgagag

SEQ ID NO: 23672 - DNA, 1030 bp, Homo sapiens
tcttttcttgtgtttgtccttgtcaggtctttggtatcagtactatgctggcttcattaaataaactggaaagtattccttcctcccttgttttctgaaagagtttgtgcagatttagtattatttctttccaaatgtttggtagggtttcctttgtgcaaaaaatatttagtgtctttagtaaatgtagggatattcagattgctgtatttcttcttgtgttcattttagcaagctaggttttttaataagaaattgatccatcatgtctaagttgtcaaagtgattggcaatacattgtttctaatgtcttccttttcaagtttcttagagtagaagcttaggtcacaattttaatccttttttcttttttaatataaaattactttctacagattgcttaagctgcattccacaaagttttgtatgttatttttcattattattttattagaaatattttctgatttcccttgtgatttcttcttgaaccatgggttatttatagttgtgcttcttgaatttcaagtgtttagaaagacttttctaaatatcttattgatttatattaattcggttttggtcagagatcataacctgtatgatttcaagcctttggaatttgttgagaattgttttgtagaccagcatgtgatctatcttgataaatattccatgtaaacctgaaaagaatgtgtgtcctgcagttttggggtatagtgttctatatatacattaactaagttaaattacttgttagtgttattcaaatcttttagctctttactgtttttttatgtctattgtatcagttattgaaaggaggtattaacattttcacctgtggggttttggattcgtctgtttctccccttctgctaatttttactttttatatcttaaagctttatttttagatacatatttagaattgttaggtcttctcaataacttggtccttctatcattatgagatgactctatttctggcaatattctttgacttgaaatctgctccatttgatattaa

SEQ ID NO: 23673 - DNA, 1061 bp, Homo sapiens
atccctctccctccacgtcacccgaaagcgaggaaacccgcactcgcgtcctctaacgcaaatgaccatctttggcaacgtgcgccaatggaacagaccaagggcgctgggcccggggggtgagcgggggactggggagggccggggctgcctcggcgcctccgaaccgtgcgtggcgcccgctcccgcccgtgccaccgcctggcttcctcgcgcggggtgcgcggttggcgtcagcgcggccgggagccggggctgggaggggagagctgcgcccgcctcctcccctcccgcgcctcttcctcctccgcggcctcctccccccgcctcctcgtgcgctcctccctgcaaggtggagtctggggttgacgtgagtgaatccacatggtacagggctggagaataaagagtgtgagttgaactcgtgccattgtagtgactcatctcgggcagagcgctagggctccgagcgaaccagcgagcgagcgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccg

SEQ ID NO: 23674 - DNA, 1062 bp, Homo sapiens
ttcactccggaatatgctgtcctctgctgaacgaagcccttgcccgtatgtcctcactgatgaacaggaatccatgttagggaaaacgtggggaggaggctggtgacacacacctcttcccctcccacagcggcccctccacgtgcacttgctcgcttctgcttctctggctggggatgaaagaagggggctgaggtccttgcggggtgaccctggcatcctcacaggccctctcgggctgtcacgttacttctgtgtcaagcgtggtggctgaaccaaatgttctctgagggttctgggagtcctgaaatatgtgcttaagaaattggagcaaaaggccaggcgccgtggctcatgcctgtaatcccagcactttgggaggctgaggcgggtggatcacctgaggtcagaagttcaagaccagcctggtcgatgtggtgaaaccccatctctatgaaaaatacaaaattagccgggtgtggtggcaggtgcctgtagtctcagctactcgggaggctgagactggagaatagcttgaacccgggaggcagaggctgcagtgagccaaggtcatgccactgcactccagcctgggtaagacagagtgagactctgtctcaaaaaaaaaaaaaagaaagaaattggagtgaaaaaagggaggaggagaggctgtgataatcccacagggatttgctgagcacttctgagaagccaggcactgttctaggtgctagggatacaggagtgtgcatgacaaagtctccactctctagcagcctagggcttagcgtttatccatccacaggtgggctggcatggggttggggagtaagagaaggagagaggtgggtagagctgtgttccgtacccccttctccatgcagatctctgcagtactcacccctcaggggtaccgagggggcagtcctggcaccaaggccatagaacatagaccctggagtcagatacattgggaatcaaatctgggctaccccacctgctagctcggtgactttggaaaattaacagaacccctctgaacctcagtttcctcatctgcaa

SEQ ID NO: 23675 - DNA, 1025 bp, Homo sapiens
gattggcttttgcatttgatttgagcagagcttaatttctgcacaaacttagtgaaaatctatttttaaagcctgtcttgtattcgaaaggtatttgtaggtctacgcagcatttgaactttccgggctcaagtgttcttattgaatagttttatgttggtgggaaggcaaggggggaaaacgaagaggtggactagccgggagttaaatgtattgattcattgcaggatattattcaaagttaaatgcagtcttctgccaaacagtccctctaccctaaagttttcgtcatcaataattgttttgtgagtgtgtagaaaagcctttaatcctttttaaacaatttagaggcctctttgttagccgccgtccagcgattgcatatgtactgtttgctttcaaattaccttaagataattgctagagtgaagcagtatgtacttatatttggaaaatcatcaaagaatattgtaatgggggaggggtaattcctttttctcaaagtatgtgtcggtatctcaaacccaagttctgtgagtacctgttctgtaactaaatactgtgtatttgctccagatgtgaaagccatccagcagtcttaagactgaataggaagcaaaagttttaccaggaactcttatttaccttttcctttactatcaagttattcctgggaggccccctggtgcctgcagtcagtgttcactacctaagactttgtttcagatgtgaacatcttgctgggtctttgagaaatttgctttgaaaataattgtattttgtaactgttttatgagggaaatacagttaatttaaaaatgtgtatgtcttgtttacatttgggaagtagaggcctactcctttttattttttttttatttttattttttgagacggagtctcactctgtcgcccaggctggagtgcaatggcacggtctcagctcactgcaacctccgcctcccgggttcgagcgattcttccgcctcagcctcctgagtagctgggattacaggcaccccgcc

SEQ ID NO: 23676 - DNA, 1040 bp, Homo sapiens
attttgtatttttagtagaggcagggtttctccatcttggtcaggctggtctagaattctaaatctagaatatccttcaatagtaaagtaaaatgaagacaaactaaagctcagaaaatatattgctgatatgctgacactagagaatattaaagcaagttctttgtgttgcaagaaaataacagataaaagcaaagaactgcagaaagaaatgaacaatggtaaggataaatgtgagtaaatacaaattctgactgtttaaaataatagttgtggcttgtgggatttaaaatatgtggaaacaaaaatacgacaactgtagaacaaaaggctggaggcgggtggtaatcagtcaaaagtgtatttgtaatctctagagcaacctctaaatgaaaaaagaatatataacgaaaagctaatagaggagaaaatggaatagtaaaaaaataactgattactccaaagaaatgcagggaaagagagaggaatgaagaacagatgggacaaacagaacagatgacagaatggtagacttaaactcaacttcgtcgatgattatattaaatgtaaaaggagcaaatattggctgggcaccgtggctcacacctgtaatcccagcactttgggaggccaaggcggacaggtcacttgaggtcaggagttcaagaccagcctggccaacatggtgaaaccctatctctactaaaaatacaaaaattggctgggcgtgggtgcctgtaatcccagctactcaggaggctgaggcaggagaatcgcttgaatctgggaggcaaaggtttcagtgagctgagatcatgccgctgcactccagcctgggtgacagagtgagactccatctcaaaaagaaaaggagcaaacattgaaattaatgcaaagctcagaagacctaactattatagatactgtttacaagggatgtattttaaatctaaggacacaaatgaggaagtaaaaaaaaggggggggggaggggggtgtgggggagacgatatcatgcacacattaatcaaatgaaagct

SEQ ID NO: 23677 - DNA, 1032 bp, Homo sapiens
aagtggaattcctaataactctgtgttgccctttaagacattaaaaggggcagggcgcggtggcccacgcctgtaatctcagcactttgggaggccaaggtggttggatcatgaggtcaagagatcgagaccagcctggccaacatggtgaaaccccgtctctactaaaaatacaaaaaattagctggatgtggtggcgcgcgtctgtagtcccagctactcgggagactgaggcaggagaatcgctcgaacccgggaggtggaggttgcagtgagctgagatcacgctactgcactgcagcctgggtgacagagtaagattctgtctcgaaaaaaaaaaaagacgttaaaaggaacacttttcagtatctttaatttcacatagtgaatctattttgattaaatgctttttattcggtgactgttaaaatattaaaatttttagctgttagtactatgtctcatctttttatttataggattgtcaccagacctgcaatctatggagcagattcggagaattatgagacctactgatgtccctgatacaggtaagtgtagagagaagtttaattgttttgtgtaaagtgttttcatatttgaacttgattacatttagtggaagtaggattggcttatgtaataaataaaagagcttttttcatagtcaataagccagctacagattactttatttgcagtaatacacaatttttcactttgcactgatcctcaaaatgcggaacctttttatttatagtcataatgtagttatttgatcacaaaaaagattttgctgttgagtccttatacctatttttctaaattccctcattcatactagcattggttatgttcttcaaaaatttgttaaattagacaaaagttttttaattaaaataatctattctttgcttcttaggcaaggatacaactaccttcttttcaaatgtctagtagttttttgttattttctatgtcctctatttgaaatttttagagctttttttcaagggggtgtgggagggattt

SEQ ID NO: 23678 - DNA, 1029 bp, Homo sapiens
agaagatattctcttttctatggtattggcttgttttacagtgaaagaatggatttctcagaactttatgctaaaaacatataggctggtgagccgtaatttaaaaaaacacggaagagaagttctgaaatcataataaatactcagcattataaactgatgtagtgcttttaagttagggtcattgtctttttgttgggaagacatgagctgttaacatcacttttgaaatgaaagaagtcttgtggcatttgccacttgagtgagacttttgtctctgaagtcactgaatcactgagccagcccttgaccagtcagtggggcaacttctctcttgtgtgctctgagctgctctactagttaaagctatttgttgactcaaattgaagttaatgcacgtttataaaggtaaaaacttttgaggctcttttcttgacaactaagctagaatttgtggaaaaattaggagagataaaggagagttggctgcttagatatggacttacggattcatagatttttgggtatgaatctctttggttggggagtgaaggcttcgcttaggttggacctgtcaggaggggcggcctgtttctgagaagtggaaacagcattgaggcttcttggacctgttaggagagtaccaagaacatactaggttttcctatttgctgccttttttccataggggtgggagacgggggacatagaattacgagtttctcttcccattggagggatttctttttgaagtagtgagaagtaaatcacccaatagcttctctcttccccccttttaaaatgtcttttgtgggctggtgggcatttgtatttgttcattaacgatgttttagtatttgcaatactaaataaaaacattgtttttctttttttccaggaaagtccccagaggaaaaaaaggaaatcagaagctgtaggaatgagtaaccagactgacttattggctcttggcacagcagttggtagcattttattatacagcacagtaaaaggagagttacacagtaa

SEQ ID NO: 23679 - DNA, 1267 bp, Homo sapiens
tgaacaagtgagtgaacacatcgctaaattgctttccaaaagggtatgctagtttacactgctgctggcaatagtattatgtaacctcaccagcatgggcatcataaggctaaacacattgctacaggaacagactaaaaatgccactttgttttggtttgtatttctttgattactaacaaggttgaatattttggtatattttctaactgaattctttctgtggaatgtatctgttcatatcctttagttacttgcgtgtatataagacttagttcttggagtacacagctgataggaaggaaggaaagtaactgaatgtaacattttaaaatatttttcttttgaagtggtaacaatgttatttccaagtagctttagtaattttgagtaatcacttttattcttagcttagatatgtacatagtggtgtttcattgtatacgtatttactttattcctgcaagattttaatacataaagctaaaaatggtacaaaagtaaagtaactgtaggagagatgtcacaagatagcatgtgactatttgtcagatgagttccagcagtgttgggaaggcctggaggagaagtgatttcatttggaccttctgggataggtaagatttggatagaggagggtggagaatcctttcaagggtggggagaggaagttggggagatggcaagagcaaatgaggggagacaggaatgggagacagtaatgtaaaagattgacttggcactgagcaaactaattcagaggaggggcatactaggggataatggataatggataaatgtgacttcaggtagaaagaatgaaatgcttgcagtgtgggtgatttagcacctcattctgctaagtgagttagtcctggaatgtttgtgagatgggaaacatgaatgagctcttctcagtttctattcctacgtgcctcttagtgagtgggcatcttgctatgctgtaaatgtataagtattgtttatatgctatggccccatagtacaaggaagcatttagtgtttacctgaagtaacagtgatttttgttttgagacatagctttggtacatttttttacaagagatttttcgaggatatttttgactatacttgatttttaccttaaatgctgacttggggtgtggaagtagtttatttatttatttttaaacaggagaaggaaagttaacattttgaaattctagctgtttatctctctcttcttctctttttttttttttttttgatatggagtttcactgtt

SEQ ID NO: 23680 - DNA, 1098 bp, Homo sapiens
ctgtagtgagccatgattgtgccactgcacttcagcctgggtgatggagcaagacgctgtctcaaaaaaaaaaaggctgggcttggtggctcacgcctgtaatcccagcactttgggaggccaaggcgggaggatcatgaggtcaggagactgagaccatcctggctaacatggggtaccatctctactacaaagacaaaaaaaattagctgggcgtggtggcgggcctctgtagtcccagctactcgggaggctgaggcaggagaatggcgtgaacccgggaggcggagcttgtagtgagccaagatcacgccactgcactccagcctgggcgacagagcgagactccgtctcaaaaaaaaaaagccactgcaggtcagtgtctctgggatagagtattcagagtaatgctttaggaaaaagtaatctgtcagcaatgtgtagagtttaggggaaggagctagttaaaggcagagaaggcagatagattgttactgtaatctggttgtaggatggtaagtgtgggaagttaaaatgggaatgatcgcaatcattgagttgggatattgagtttagttttcagctttgctaactaggcaagtaaaccaatttagagggaggaggtactagggggataatgcatggtagaggatagaaattatggtcagaagagatacatggttttggggtttttagacaagttggctttgaaataacattatgtgaaagataagacccagcagacagggtggtgctagaggcttagatttaagtaggggtttggggttggagatgcaggtaagtaaaccatctccctgatggctcagtgagtatttgtgctccatttacttgtagcagacacagtagtttctatgttagtaacctgttagaaatgcctgcagaggttctgatccagtaggtctggggtagggcctgtgttactgtattctggatgagaggtcacaaagataggtccttcacatagggactagtaatgttcaaagagccattcaacacgtgtgcgttttattgtatgtaatcataagcctgtgaggtgaactttagccccactttgctgttttgaagtagattaaacaa

SEQ ID NO: 23681 - DNA, 1054 bp, Homo sapiens
gcctgcctcggcctcccaaagtgttgggattacaggcgtgagccaccgcgcccagccgaaacaaggtttttttaaaatttaaattttattatatacaccaactatgtatccacaaaaaagaaagttaccttttaaaaaacaaaacagattttgacacagggtctctctctgtcgcccaggctggactgcagtgacgccatcatagctcattgcagccttgacctcccaggctcaagcgatgtctcacctcagcctcctgagtagctgggagtataggcgcttgccaccaggcctagctcaaaaaagattttcttaataaaaaagtttttactatgtgatgattatggtaattttgatttctagcctacatccagcatttagtccacttactgtatttgactgtggagatttagtattatatttttggaggaggaaaaagctttcactcagggcttacggaatatttggtgctgtgatgatgccttaatattgtggtttcgactcactgagagtaaaatgaggacctacaattccttggctgtgtctgagcacccaaagtatgccttttaaaatggatagaattaagtgaatctttaattcaagaatgtaagaaacaaaggtgcggagtggtagggtcatgggagttagaaggaacatctaaattttcagtattttcagatggatttttttaaaaagtgggagaattatagcacaaataaccttatttgcttagaattgaattgaacagttacttcatcgtggagctctcctttccgatatgtatcacatatggcttgttttgataatatatactattaatttttgtccctgctttgaatctgctctcctaactgagatttaactttctctagcatttcacaggacatgcaacgccagtttcgtcactgatgttcactaccatcagacctcctaatgagagccagccctttgatggaattacaggtctttatttcttatctggagcagtacatgaccggttacttaatgtctggtatgtagttcttttggatttgggaggtagcattgaaagaat

SEQ ID NO: 23682 - DNA, 1037 bp, Homo sapiens
gtacaaactgatgagttgtaacatacatatacattgtgaaaccctcaccacaaacaagataatgaatgtgtttcctcatgtcttcttgtaatctctcagagacttgttgacaggttttgggccattacaaatacaattgctatggacattttttgtgtacaagtctttatatggacatgtgatttcatttcttttgggtaaatacctaggagtgtaatggctggatcatgataggtgtacgtttagcttttcaagacattgccagatttttttttcaagatggttgtagcattttgcatttttaccagcagtgtataaaaatgaaaattccttcacatcctcatcaacacttggtatagcatttaattttagccattctaataggtgggtagtggtattttgtgttgttaaattggctttctctaatggctgggatgttaagattcatgtttttgcattatggatatccagggatcccagtatcatttgttgaaaagattatctctgctgacttggttttgcatatacctctccccctataaccccgaacacctacacacacccacacatccctgcacccacacgcttatccctatatcggttctcgttatttataattgttaagtcctataaagtccccatgaacactgatttagtcaataacattactccttggggaaatagcttaggttcccatgagcctccagttgtaacatttttttcatctatttatttttttgtttatattatttatattgtaaaggtagccagcttgtaacatttttgtcattaatatataaaaccttgttttatgtttgtttctatttaaagatatcttatttaatgcatatgtttttgattgattaactttgaattcagagcactacaactcatgtctgagtgaagcttatttaacacatattttcactgtaaggcacatcccagtcttcttgtgcttaggaacaccatagagcacttcagaattatgcttgggggccgttgtaattagtgaaatctccaagaaagcacaaaaatgc

SEQ ID NO: 23683 - DNA, 1562 bp, Homo sapiens
tatgttatccattataatacgttggttacatttttcttttagcctgtcaagttggctgttgtttgcagagatggtcaagtccatctttttgaacacatattaaatgggtaagtaagaaattttccaagtaagaaatttgtttctttccctgacttgttacttggtcatactcccacctggttattctttgcatcatattactattcagccagattattttgaaagcatttttctttatccacatgactatatacattgccagttaaaactgggtgtcaaatttatatatttgtgattaggagattggctttttatgatgtatccttagtacatgttggataattctaatgatacatttcagaagaaagtggctaagctggagagattcacttgtgaaccttgatgatgttttatttatctttgagcgtgctttacttccccttgccagtgctgttgttttgatagacaggggagtattgttgtcaggttgtgtagcagtcatagaccaggagtcagcaaaccggcttgcaggccacattcagtggagaccatttgtggtctggagaacctgaaatttttattattttgcccttttcagaaaacttgccaaaccttgtcattatactgtaaacatggtctgagactcagttttgcgcacaaattttgttaagctttaaaatggttttaacctcttgttgtcagttggcacccttcttttaagataccagtataggaatttatttaaatataaacagattatgaaaaaagtgtatactcatttcaaaacacccaggatgcccaaacacttgattttaaaacctgagtctccctccattgagttctgctcctataggtaactgttaacattttagtgtgtaactcttgaagcttttatttatagaaggatgtgtgtacctggaatgtataattgagactcagaagaagtgggacccaaaggtagctggccacagtgaggactacctgggcagtggcaaaccattgaaggatttcaagcagaggattcgatgagctttggcctgagttttaagacagtcgttcattgagaatagactatagagggtgaaaggctaaagtagagaccccaaatcctgggtttagagatagttgtggagtcaggatgataggaggagtaagttggaaagatagggatcatgagatgcttacacctgggatattatgcaggatgtacacttgtggagaataagtggtaataagatgcgtagggtgtgaggagtttgtggctgaaatacagtgaggggcatgttcatttgagaaaggagttgacagatcagagtgtcaggagtgtccatcaacctggacactgggtgtggaaaccactaagaaaggaattcatttagagtaatgttagaagtaatgacctcaagccactgaaatctttacgaaatgtggatggtggcagagatcattggatgacggcaggagggagtggtagctggtatctggtgacaacaattgaaaagattttagggacgaaaaagggatagactattgtcttgaagtgtcagtgaagagcagggaac

SEQ ID NO: 23684 - DNA, 1010 bp, Homo sapiens
taactgccgtcagtctgagtggtgatcgtggttaacaattgagtgtggaagtcttccatactttttaatattttataaaaatgcacaagtagtcatttatttttcattttgttcttattcccagttgctttgtttgacactcttttttttttctttcctctcatcttcccctttaaaaaaaatatattttcaggctttaaactccagagaacctcatatgtgtttagtaagagatatttcaaactgctgggcccccaaagtagaaacagctataacaaaggtgagcacattacaaatttgaagttttaagaaaaagaatatttctttgggtgaatggaactgttacttagtattatgattaaactgagttttttattctttaatatctttattctcttgtcttataaattttgtgggattatggttttagatgtcaagattgtactcctgatttgttgagtgaatgaatgaatagaagactagcagttgaagaccttggatgtggttcttccctgcccaccatgcatgatcatctgggccaggaagaatgtagggataaatatcaatatcagatttatcagtagatagtttttatcaatctcagtacttaaaagagcattactttgctgagaggaatgctgtatttcagggtgtaataaaaccgtcatggggctagaatataataccacaaaagcataggagcatcatcatggtgctccattttgcatataacttggtgtctacatgtaggggacgtgtttcgtggtttagtgagaaagggaaagccaagacatgctatgatgacatccatatggtttcgctgctggctgagtttcagagatgacacctttctcttggctgtctgagcatttctggcagagattgaattctggaggtagttgtaaaatgtgtaacttcactttttaaatttttaaaaatcattgtgtctttatgtaatctgtagttttttaaagccagttgaatttagtagtgggggcttgtataccaac

SEQ ID NO: 23685 - DNA, 1078 bp, Homo sapiens
cctttaaaagctgttttctcattgaggatacttaaggactaaggtatgatttcctttttcacactttggctattcctgttgaacaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggtaatgcaactgctttgaccatatatttgagtttgtgatttaaaattactgggaaattctaacaagtgtgttggatagagccaaagttaaatctttagaaatttactgagatttctcctgttatgctctcttttatcttcaccatcatagatttcataattctagattgtcatctttgtttaacagagaagatggaaccttcagtaactaaagagggtgctgttttggccattagttagtagttagctgggtaacataaaatggaataagtcaagccaggacttgctgtgatgactatcattgggtttcgcatgttgctgagttccagtgatgcctcttttctcttggctgtctgagcaatcctggctaacctagtgccagttggtctctaaaagtgatagtcattataactgcctaagtgtttatgatcttcattttttcctcagttcccaaaatcctttgtggttactgtacatgtctgtgcagagttgttttttatcttccattcacattcttccctcttacataaggaatctggaattttaactgtttcattcttacagaaatactaggtttctttagctgattttactttaatttgtattctttttttttctttgtccaatttttgaaggataatttagctgattttaaatgcgtttattgggtggtggggtggggataacatagcttcataaaacatgttcataacatgttcataaaagttattcctcagttacatgatagctgactttaaaaataaagcgccaactttctttggcttggcctagtttcaactttttaatttccccatgtcctttttaatcttttttgtgttaggataaaccaagcacatctgt

SEQ ID NO: 23686 - DNA, 1023 bp, Homo sapiens
ttctgttcttggaaaaacagtgttaggagtataacaaaacaagctgagggctgggaacaaaatattagcaactcatgttagacaaaggatttgtatctggactttaaagcagttggtaaaggtttgaatagacacttcacaatagaattcaaatggccagtaagcacatgtaaaggtattatgcattattaattatcacagaaaggcaaattaaaaccacagtgaaataaagcttgcacacaccccttataggttgataaaaatgcgaaagacagacaataataccatctgttggtgaggatgtagagcagctgaaattcaagtatgttactggtgggaatgtaaatggtataactactttggaaaacaattagtttattaaaaattgaggatgtatccacatatgatggagccattctgctgctagatatttaccaggagaataacacacatacgttcatacaaagacttcctcatgaatgttctttgtaatggccctaaactggaaagaacacatatgtcctttaacaggtgaatggagaaacaaattgttcatctagcaatataagtaatgtgttattaatagaccagtagtattcatgaatctcaaactaaggctgtgagaaagaagccaagcaaaaagtaatataaattcctatttatataaaaattctggaaaagcagaccaatacatagttcagtagctgcctgggaatcggggtggaaggagggatacatttaaagggacccaaggagacccgagggtgatacagtgtttatttttatcatatcatagtatttgtttcatgggtaaagagtatgtcaaactgatcaagcagtacactttaaatatatggtgtttattacgcttcatttgtactgcagtaaagttgtaaaagaaaaatcttgtcttcaacaccaccttcttagtagttataactatggcttataggtttgtttctttacatacatccttgatggaaattaatgaggctgactcctctgtttattatcatttcactt

SEQ ID NO: 23687 - DNA, 1033 bp, Homo sapiens
aatggaggtttgggaacatctttaaagtggcatatgtctgtattcaaacgtctagagatgttttaataaaacacaaagaagtaaaattacttcagtaatgaagtaaatttactgatacccaaagactgtgcttgtctgttaagcacaagacgtaatataacatactccattcagtccctccaacctttatttttgctaaattcagtttgtagtttattgccttggtcttaaatgatttaaaggattcatttttacagacttttttttttctgtgatgtccttggtttgtcagtatgctcatcttaataatccttttattttctcacagaaagtacttcaaactaggaatgtaaaccttataaagaagactgtattaaggatgcccctgcatactattattccgttgttacaagaggtaactgactgcttttttcatttcagcatcctaatgccatgagttaaatggaaaattcagtagttagagaaatggatttgtaatacgtaaggacacatggcatttagagtgagtaatggatggaggaaagtactttagacaaaaaaaaaaaaaaaaaaaaagtgaaattaattcctggggcaatgaaaggaaatgtcattggcagttttacctttattctgctaatggctattgtgtgtctgtttacctggaggcacttggaacttgtggcacagaatgctgtatgtacaggatatcatctacatgggaataattgttgtaaacaccccaaacataaagctcccaaattctcattttggtttttcccagtatgtcctgtgaggtaccttaacctaacaccgaaaccatttttatatgtattgattttcttaatcacagtttggttgttaatctctgtgactggcagtatggaattggaggtgggaggactgcttgagcccaggagtttaagactgtaatgcgctatgattgcacatttaaatagccactatactctagcctaggcaacatagcaagaccccatcttaaaaaaaaaaagtatatataatttcactgaaa

SEQ ID NO: 23688 - DNA, 1055 bp, Homo sapiens
aaatgtttttgaataaacaaatgatgaatgaatttaacgtaaagttcttccaacagaaattttatatgactttctagtgctctaagtaagagttgaacatttttctcttatctttatttgtagaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggtacagtaagtaactgcaatctctgaagccagggttgttatgtccatgacctatgttcaaggacacagtatggtcagagttttgagtttttgaaaaaggttcaacatgtaggtagaaagatgcttaatggaaaatgtaaaacttagatatgaatttactgttaagttatgctttaagaatataaactacttgaacttaataaagaagacatctttatttgaataaagagtggagtggagtagaactcttgagtgaatttagaagcatgagctaagggatgatctaaggtggaggattatctttgcagtcccctctttccccagtggtacttctctgactgctgctcctccatagaaatggagcacaggagacccttgctgttcatgggtgtttgtctttgggttcccacaaatagggcagtctgagatattatgtaacctggtgataaggatttgtgtggaaaagaggactcctactcccatcatccagacaccttttttcctcccaagcttttgtttccatattgtattcatttattgccagttgctttttaaaaatatctcatatgggaggttttcttgttttttctttttttaattattttattatactttaagttctggaatacatgcacagaacatgcaggtttgttacgtaggcatacgtgtgccatggtgatttgctgcacccatcaa

SEQ ID NO: 23689 - DNA, 1029 bp, Homo sapiens
tttaaaaaatacattttatgtttaatgttaaaattcttgcttaaagtgttttatttttgtgtccaaggattaatgacatcaaaaaaagatagtgcttctgagtcaacactttcattgcctcctggtgaagaacttaaaactgtgacagagaaagatggtaatataccttgtaacctctgtttctcaaaatttaacttttgatggaactttaaaatatggtaggaaaacagtttatatggaggttaagttttaaagttggcaagggaaaaattatagtaaaaattaaacttggaaatcactgaagcagctcatagcaagctatatacattatattttttgtgtgtaaagtactgcattatgattcttttacttaaattagataactactggactagatttaagaaaataaacggaaattccataatatagagcactctacacaaatgtttcatttgcctttagctatcaaatcattagatgaattgagcatgagtattccttcttgccttctggtttaactcaaaatgtcttaatattaaacttttgttgccttaaaacatattaatatcatgtttaatttttgtataaaaggggactctactatgtcatctaaggtgagaggtgactgatggtcattagattaggtagtcagttcacatcaattgatgtggtgatacctcttacataagattgtgatcttaccgtgggaatccttaaaatattattgcttgtgttataaaatcttttatatataaactacaattgctatttggatgaaattaggcatttaatttgacactagataatccataattgaggaagttaaatgaagaatttcagaaagatttgccttgacaagctgcttcttggtccacatcttattttccaccgtttgacacgttctttatctgttacagttgccctgcttggatctgtcagcagctgctcctctacatcttctttggaacacagacagagctaccccaagaaacagaatgcaatcagcagtaacaagaagacaatgagcaa

SEQ ID NO: 23690 - DNA, 1070 bp, Homo sapiens
ttctattcacttttttgtacttaataagtgatttttatttcttgactttattctggctatattcccaccctctgtttttttttttttttcattctgtttactgcctctacttgtgtagaagttatagtctatgaatatgcttcttagtaattactgtagataatttaacattgatacttggcaaaatctaaagttaatgatttttatcctttctcaataatagaaaatcattagaaactgagttgtccagtctgtattttatttctcctataaatttgatattattgtaatagttttatattgtaatgttactctcatatttcccagtgtctttactcattaaccctcagaatttgtacttgggatcatttttaaaatttcatgtatataaaatttcttttagaaagggtctgttgggtaacaaactctttgtttttgtcttttccaatgataactttactgggtgtagaattttaggtttaaagatattttccccctgcatattgacagtatcgttgtgctgtttttggcttctgtcattgttgatgagacgtcacctgtgagtctaactaattcatattattgtttcactatcatgtctaggtagagatttctttttgtttatcctgtttatcctttttgtttggcattacggatttttctgtatctgggagttgatcaattctttacaattcttatttattataattaaaatagtttctcctttattatttttcttagctccttctgaaagtctgtttagtagtatgttggaccttctcattttctttcccatgcgctctcatatttctcacaacttgtcactctagactatattttggatatctttagacccatcattctgtttcttgattctctcttcagctatgtttattctgctgcttaatccggccataaagttgtaaaattataaaaattgtctttttttcttttttcaaatctgcttgcaagttaccattgcaattctttccccatattttcaaatttttcttttatgtctttaaatatttaaagtattatcttttattttgtgttaaataattcagtat

SEQ ID NO: 23691 - DNA, 1081 bp, Homo sapiens
agcatatatatgtatgtgtgtgtgtgtgtgtgtgtacacatgtatatatatatatatggcaaatgaaatcttaaatccagaatggggtagtcttaaaatagcgcaaaagacaaaaacttttaaaatgttaaacagaagtacagttgaactttgagtaatgagtgcaggggttaggagtgccatcccctgcttgcctgcaacagttgaaaatcagtgtgtaactttggactcccccaaaacttaactactgatagcctattgttgactggaagccttacctataacataaacagctgattaatacatattttgtatgttacatatagtatgtactgtatttttactataaagagaaaaaaatgttaaagtcatagggaaaatatatttactattcctgaaatagaagcggatcatcataaagatcttcttcttcattgtcctcactttgtgcaggctgaggagaaggaggaagagaaggggttggtcttgttgtcccaggtggcggaggtggaagaaacttctgtgtatgcgtggacccacgtacttcaaacctgtgtagttcatgggtcaactgtatactctaaaactgctatttaaaatttaaaaatcaagttgtgaccataaagtattctcttttgggaactgagtgaatgaattctgaatctggcagtggaaatgaatatgatgcattgcattacgtggcttcagcactaaataatttttcccacttttcccttccgcacagatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatatt

SEQ ID NO: 23692 - DNA, 1030 bp, Homo sapiens
aaatacttttattagttgttttctttttttttttttatgtagtctcactctgttactcaggctggagtgcagtggtgccatcttggctcactgcaacctccaccttccaggttcaagtgattcgcctgcctcagcctcccaagtagctgggattacaggcgcccaccacaacacctggctaatttttgtatttttagtagagacagggtttcgtcatgttggccaggctggtcttgaactcctgatctcaggtgatccacccacctcggcctcccaaagtgctgggattacagatgtgaaacaccgcacctggccttagttgctttctaatgctactttttagcataccaaagaaagatttttatttttagatagtcaaacctatttttttaatgtcatgatttcctttattttatagttatacaatcttcccttcaccaaagattagataaatatttgctatcttcttctagttgtgtttgtttttgctctcttcttaaatctagttggaatttaatttggtgtctagtgtgaggtaaggacctaaattgatttgcttttcaaataactactcttccaacactatgcataagataatttcctccttacccattgactcacgattaaaaacaggtctgtttctggctatattttcacttcatctatttgtctgcttcttgcattgataccattctattttactttctgtgtatttgtcttaaatctgaaaaggcatttttctctatttctctttaaaaaatatttgatttctcatttgtttttttaaaagctttatgagatgaattcttcgtgttctaaaagaatcacctttgatattttgattaaaactttaaaccactacctaatgatcagctttttgacaaagactatcttttagtgtgattgtagttttctgaggttagcaaatattaccacaaaaattgtagagaacaatagttccttcatcttctaagaaacatggggtgcttttattgtcatcatctgtgtgaaatttcaaagactcttgtga

SEQ ID NO: 23693 - DNA, 1205 bp, Homo sapiens
gagccaaaaattaatatctttaaatgtccatccagtggattccaagatctcatacaccaagatctcatacagttctctgatctttagtttcatctatcagatgcccactcattagcttcactggcctattttaataggcaactcaaatttaacatgcccaaacggaactccttctgaacccacaccatctcctctttcattctttcccaactcagcagcacctctggttatgcatttgttcaagcccaaaacccaggagtcatccttgactccgttatcccacacccctccacttcccatccaacagtcagcagtcctgttaactctacattcaagatagatcttgaggccgggcgctgtggctcatgcctgtaatctcagcattttggggtctgaggtgggcggatcacttgaggtcaggagttcgagaccagcctggccaacgtggtgaaatcccgtctctactaaaaatacaaaaattagctgggtgtggtagcacgcgtctgtaatcccagctacttgggaggctgaagtgagaggattgtttcaacctaggaggcggaggttgcagtgagctgagatggcgccactgtactccagccggggcgacagaatgacagtctaaaaaaaaaaaaaaaaatcttgaatctgactactttgcgctacctccactgccaccaccaagccacatcgctctcctgtttctctcagctagcaatgtgcaggattttcttaactggtttctttcttcacttacccacctctagtgtaaattcagtggcagagagattttttttataaagcaaagatcatatcacactcctgcttacaacccttcaaccggcatcccatggtgtttagaataaaatccacatcccccatctgagttccaaggccgtctgtgttctgacccatcccttccacccctattggccctgggctcccttagctccgaccatcaggacttgatttcattcctcagcaagcaagctaggctccttcctgcctctggctgttcacactggcttttcctgcagtctggaaagcctttctctcagatctttccaaggcctgccctttctttcaggtattgaagttacctccggtaaggagcttccccccgcccacctttgccaaaaaaaccccagctcctcctctttctgcctgattgtcttagagcacttcctaatccttgcagctatata

SEQ ID NO: 23694 - DNA, 1052 bp, Homo sapiens
acaccatgaacttggtgatggggacagagttaaataagatgtggtttctgtctttgagcttactgtgtagagggggagataaacacaaatcagtgccttcactacagaggtcattgagatttcatcatctgtaggttttctttgatgaaaagtaaacatgacggctatgaaactattatgaagaccgtaggtagtaatggtgaccctctcttttaataacgtgtgagtgccaggtgtatactgagttctgttctaagtgctttaagtttttaactcctttaaccctcccagcttccactgtgaagtaaatacaaatactgttattatcctcattttacttatgaggaaacagaagcccaaagaaggtacggggcatggatttgaacctacgcagtctagtttcagagtctgtgctcttaattactatgctataatgcctgttttaatgtactgtaaatttaaaatatactgtacttgtgtggcattaagtgtaagggattatttcaatgagtatgccttgtattacaagttatgtccaaagtttctgaatatccatgctgaatgtaacttacggtagctacttagggtgagtctgtctataatgtgggagatttaaatgagacatcctttttgccttttcccctttcatgtgttataatgattgttttgatagtcttgcatgttccattatatcatttcaaaattcagtaaaatatattaccaggtttattgtttgtgttataatcatacacataatgaaattttatgatgtagtgctcaacctggacagtgtgaattactgggttaacatacttcttaatgagagtaactgcagatttaaacttaggtttttttattttttatttttattttttaatagagacagggtctcactctgttgcccagactggattgcagtagcctgatcacagctcactgtaaccttgaatgcatggactcaagtgatcctcccatctcaagcttcccagagtagctggtactacaggcatgtgccaccgcgtctggctaatttttttttttttttgtagaga

SEQ ID NO: 23695 - DNA, 1048 bp, Homo sapiens
cctttccgggatttttttttttcccctgtacccagtgctaattctttgactgttctttctagaaaaaaaggtaataatgttacatatctatatccttaaaatattacacagtagaatattgatattcaccttttatactttttgcttaataagatatcttgatttcaaggacaatcagcattttttaattaggacatcacagaagcttaaaatagaaatagtgcttgatattctcattcttctagataacctcaccactcaattttttattatagaagcaaggatcatgggaaatactaacttttacatgttagaaatcataagatttatttatagggcatgataaaatttacctatggaaaatcataactttaatttgctgtatatctgtattgttttcttaggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggtaggttattcacacattattttaagtggttcattcattttagatgtaatgcacccactgtaaaactgacttaagcattaaagcgattccatttttttcctcactgggccaaaaacaatctctggttcttttgtctttagtggatctgctatggcagatgactttattttaatctgtttttaaaaaatattactctgaaagagaaaataaactgttctcaaggaaatggatatatagtatctgaggaccacagcattgaaggatatgaattaatagtttagtaactttttattgcaggtagtacttgtgatttcggccagaaactggtctgtgctgataaagtacttgacattgactgattcattcatattcatgtagtaagtattaattgaatatgtaggttcgaagcattcattatgctaggtgctggtactttctgaacttc

SEQ ID NO: 23696 - DNA, 1048 bp, Homo sapiens
ccatctctggctcacattgcatttataatagtaagcctctcccagggtggcatttcagttacccttttgaacagccagcatgttttaggaggcaaggaagaaagacagacaaattactgaaatactgggtgcattatatatcatgcactcagaccttttcatacagccttttattgctggaaactatgaaattggataagaccttccgttatgttaaataagatgtggttgtacagtagacttttgacatttgctagaatattttctgagacaatttccatttcctcaattttggaaatatttttgtagattagtagctgactttcttttgaggccattttacaaggaacatgatagagtgcaacaaaacctaaatgagatttgtacactgatgagtggataagcacctggatcacctaagtgacctggtgacctgcacatcatgaagcagaaattattcaaatttgcctcaggagaagtatgcatgaccgcatgtcagagacctttgatgtctcttcatgttgaattttcaaatgccatggtatcgctttagaccataaagggaattcatattgtttctttgttccttttagtcactgcccacctcgccccctttccctccagcgaaaaatctgagctgctcatttaggacagatcttcttgtgtttagtgaaaaaagtcatgattgccttaatgaaaaaggatagaagccctatctatgtacttaaaaacaaccatctaacacttatcaagttcttcttatgtaccaggtattgagttgtgcacgtttctttaccttgcccatgcagtagaatcaaccatagagctttttaaaaatacagatactgaggtccaagctcagacctattgaatcaatctggtgatggggacctagactcatagctacttctttcaccattcatacgtatcccctaattctcctacctaagctaggtggtagtttgctttgtgctgcacctgtggagcctggctccgtttagcaactttcacagggtcatactgctgctgagcagaggaactttaaact

SEQ ID NO: 23697 - DNA, 1043 bp, Homo sapiens
taatgcccttctttgtcttttttgatctttgttggtttaaagtctgttttgtcagcaagtagtactacaagccctgcttttttctgttttccatttgcttggtaaattttcctccatccctttattttgagcctatgtatgtctttgcatgtgagatgggtcttgtctttttatctagcttgccattttgtgtcttttaattggggcatttaacccatttacatttaaggtaatatgtttgaattcgaccctgtcatcataatgctggctggttattttgcagacttgtcaatgtagttgtttcacagtgtcattggtctgtgtacttcagtgtgtttttgtagtggttggtaacggttcttcccttccatgtttagtgcttccttcaggagttcttgcaaggcaggcctggttgtgacagattacctcagcatctgcttgtctgtaaaggattttatttctcctttgcttatgaagcttaagtttggtctagaagaaaagaaaaagaaagaaactcactcaaaaccatacaactacatggaaattgaacaactaacttgctcctgaatgactcctgggtaaataatgaaattaaggcagaaatcaagaagttctttgaagtcaataagaacaaagagataatgtactagaatcttgaacacagctaaagcagtgttaagagggaaatttatagcactaaatgctcacattaagctagaaagatctcaaattgacatcctaacatcacaactaaaagaactagagaaccaagagcaaacaaactccaaagctagcagaagacaagaaatagccaagatcagagttgaagtgaaagacacagagatatgaaaaacaaacacttcaaaaataaaaacaaattgggttggaaattcttttctttaagaatgttgaatactgaccccaagtctcttctggcttgtagggtttccactgagaatctgatggccttccccttagtaggtggcctggcctctctttctggctgcccttatcattttttccttcattttgacctttgagaa

SEQ ID NO: 23698 - DNA, 1061 bp, Homo sapiens
gaattgaaagaaaatatggtatcagttaaacaggaaatctaagtagatgatataaactagacaataaaaataatattctaaagttgaaaagtgtagttactgaaattaaaaatttacagacaacagcctcaacagcagattagagatagcaaaagaaagattcagtgactttgaatgcaggtctgtagaaattactaaattgatgactctcacgtagcaactttcacccgtagtttggtttcatatacaatgctttaactctttttgctattttttctcttactttctgtgatggaaacattttgtgctttgattttaatgggtgtatcacagttatatacatctttacaaactcatcaaattgtatactttatttatatatttatttttttttgagatagggtctgactctttctcccaggctggagtacagctgaaattagttgggactacaggtgggcaccactgtgccagctaatttttgtattttttgtagagatggggtttccccatgttggccagtctggtctcaaactcctgggctcaatcatttctgccgcctcagactcccagagtgttgggattataggtgtgagctactgtgcctggctggtatagctttttttttttttttttttttttttgtgacagagtctcactctgtcgcccagggtggagtgcagtggcgcgatctgggctcactgcaacctctgcctcccgggttcaacccattctcctgcctcagcctcctgagtagctgggactacagatgcgtgccaccatacccagctgatttttgtattcttagtagaaacagagtttcaccatgttggccaggatgatctcgatctcctgacctcgatccacctgccttggcctcccacagtgctggcattacaggcctgagccaccatgcctggctgttggtatactttaaatggatgtaattcattgcagattatacctcagtaaatttttatttagtttttgagactgagttgctctgttgcccaggctggagtgcagtggcacgatttcagctcactgcaacctctgcctcc

SEQ ID NO: 23699 - DNA, 1124 bp, Homo sapiens
taatttttgtatttttattagagatgggatttcaccatgttggccaggctggtctcaaactcttggcctcaagtgatgcgcctgcctcggcctccgaaagtgctgggattacaggcatgagccaccacacctggcctcatagcttacatttttagagaatcttttctagtacttaaatcggtaaatatggttatcttttaaatgtaatatattgaactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaaatggtaatatttcatgaaaatatttttctaggagcttatctattgtatctattatttacatatgatgaatatctatcttcagagtagaaagttatgtacatttgtgttgtcaaatactgtattagtttactggggccatgtaataaaataccgtaaactggctggcttaaacatcagcaatttattgtctcacagttgtggaaggtagaagtctaagatcagtcaaaatgttggcagggttgcttcctcctgagggctgtgagggaaaatgtatgttgtgtgcctctctcctggcttctggtggcttgctggcaatcttttgtattccttggcttgtagatgcatccctcctatctctgtctttatctttatgtggcattctccctgtgtctgtcaccatgtccaaatttcccctgtggattaggacccaccctaatgatctcaatttaagtttgtcatcagcaacaattctatgtccaaataatgtcacattcataggtactagggataggacttcaacacgtttttggagaacacagttcaacccattaacaaatactatcactttccacttaagcttcaagtaaagtggattttatctcaaggagccaccagataggaacacagatctgatggcataaactgagtatttctggccttctgattctgatctaaaatatgacagaagattttccctgttttaattttttttttttttttataatagagacacag

SEQ ID NO: 23700 - DNA, 1035 bp, Homo sapiens
gaggttgcagtgagctgacattgtaccactgcatccagcctgggtgacagagcaagactccatctcaaaaaaacaaaacaacattttttttaatgccctccctttaacagtacagattgtgaaatttttagttactggaagcccctgctagaaatgaagtcaaacaataatctctgacattcatatagtcagaacctgatgaaagtccattagcaagtaaaatagtcacaaatcttcctatatttatattgtgacaaaatcacaaatttaaagctattattatttttcaagtgaaaagaatgttacttcttttttttttttttttttttttgagacagagtctctctctcttgaccaggctggagtgcagtggcgctacactcaggtcactgcaacctttgcttcctgggttcaagcgattctcctacctcagcatcccgagtagctgggactacagccatgtgccaccacgcctggctaatttttgtatttttagtagagctggggtttcactacattgaccaggatggtctcaaattcctgacctcaggtgagccacccgccttgaacctcctaaagtgctgggattacaggcgtgagccactgcacccggcctgaaattttttttagatatttattttccctcagtaaatgtgctttggcttttgtgtaatctgcttatgactattttattatttcctgccactgaatcagtgagactttaaaatttcaaacttaaaatcttaaatgacacattgctacttactgaaatgataggaacaccctgaatatgaatagaaaggcagtttccggccgggcgcggtggctcatgcctgtaatcccagcactttgggaggccgaggtggttagatgacgaggtcaggagatcaagaccatcctggctaacacggtgaaaccccatctctactaaaaatgcaaaaaattagccgggcatggtggcgagtgcctgtagtcccagctactcaggaggctgaggcaggggagtggcttgaacccgggaggcggagcttgcag

SEQ ID NO: 23701 - DNA, 1543 bp, Homo sapiens
gctgggactacaggtgcatgccaccatgcctagctaatttttgaattttttggtagaaacagggtttcaccatgttggccaggctggtctcaaacttctgacctcaggtgatctgctcttggcctcccaaagtgctaagattacaggagtgagccactgtgtccagcatttttttttttttttttttttttttttaaggagacagcgtcctgccctgtcacctaggctggagtgagtggtacagatatagctcactgcagtctcaaatgtctgggctcagatgatcctcctacctcagccttcccagtagctgggattacaggtacacgccaccatgcccagctgatctttttaattttttttgtagagacagtcttgctgtgttgcctaggctggtcttgaactcttggccttaagcactcctactgccttggcctcccaaagtgttgggattacaggcacgagccactgtgcctggccctgccttacatttttatctgaacttcttctgtcctttgtctcaactgtactactcagtttggattctcttgccaatgtttctttttgatatggagctttttttttttttttttggaggggagctttgcctggttactttcgagactcatagggctcagactattccagcccttattgcagacccagtgtatttgcccactgttgtaatgtgcaaaactcctcccagttgcagctgcttttctcatattggctgtcctagatttccattaagtcttgttagccgctttggggtttttaggtcagtcagatgtgctgttgcttcctgctgcacagattgtgttaccttgaaggtcttacaccttttatttgggttttcataagggtactaggttactttctttgttttaatggaaatatttgaggcatttcaaacactgccaccactgctgccatcttgcaagaatcccaacataatttttagttttcttagttttacattatctaaatatgccataatttatttcataagtcccttagtgaatatttagattctcttctatttttcctatattaacaggtctaggataaacttttttttttttttgtttttgttttgagacggagtctcacactgtcacctgggctggagtgcaatggcatgatcttggctcactgcaacctccgcctcctgagttcaagcaactctcctgcctcagcctcccaagtagataaaaactagaaagaagctatctgtgaaactgctttgtgatgtgtagattcatctcacagagttaaacctttttattgattcaggaggttggaatctctctttttgtagaatctgcgaagagacagccgggattacagatgccccaccatgccccacgtctggctaattttttgtatttttagtagagatagggtttcactgtgttggccaggctggtctcgaactcctgatcttgtgatctgcccgcctcggcctcccaaagtgctgggattataggaatgaggcaccatgcccagcctgggataaacatttttatgggataatctttgtaaa

SEQ ID NO: 23702 - DNA, 1036 bp, Homo sapiens
aactacacaccttgagtcttatgttcatttttaaccattctttcctttatttttttaattaattaattttttaaaatatggaacgcttcatgaatttgcatgtcatctttgcacagaggccatactaatcttctctgtatcgttccaatttgagtatatgtgctgccgaagtgaccacttaaccattcttttaattgcgttaatgacattggatggcttataaacacaaagaatatagtcatcaactcagaacttggcatctagaaaccacacctatgaagtccctggttaagacccaggaatttaataaaacaagcttttgagctgctaaaagttaatatcacaaaagccatagattaacgcatgcactgtaattataggagacttttcaagttcatactctgaaaacagagtttccttattttaattactttgatttccatatcagactgaaagaggatatggcatctttaatacttaggtagtgacaactgtgaatggtagtggcaaaagaaaagggaaaaatcaaagatgacttgatttcaagacgtggcttgtcttagctaaaagtaataaactggaagtcaaattcaaggaatatagatattttctctgtctcatgattgacagtagctctcttactatttttctgtattttgtatttcaagtcatagattcagatacagtgttactaaacaatttggctaatttatgtgcagtttatgttttgtaagaatttttttcttttttgaaaatctgtgtttatttagagaccaacatggagtgtctgctggacattttatttaattttatttactctctttttttgagactgggtctggctctgttgcccagcctggagtgtagcgacatgatcttggctcactgcaacatctgcctcatgggctcaagccatcctcacacctcagcctcccaagtagctgtgactataggcgcgcaccaccacgcctggctaatttttgtattttttgtagagatggggttttgccatgttgtccagtctggtctcaaactc

SEQ ID NO: 23703 - DNA, 2052 bp, Homo sapiens
caatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaa

SEQ ID NO: 23704 - DNA, 1055 bp, Homo sapiens
cttgctcgccctggcatggtggctcacgcttgtaatcccagcacttgggaaagctaaggtgggcagattgcttagcccaggagtttgagaccagcctgggcaacatggcaaaaccccgtctctacacatacaaaaaagttagccaggcatggtggtgcatgcacctgtggtcccaattactcgggaggctgaggtgggaggatcacctgagcccagggggtcgaggctgcagtgagctgtgatcacaccactgcactacagcctgggccacatagtgagaccctatctcaaaaaaaaaaaaagaatatggatgaatctcaaaaacataatattgaacagaacacagatacaaaagaatatactttatgattctattaatgtaaagtacaaaaacaggatgttagttacccttgagtggcaaggaagtaactgaaggagagtacagagatttgggcttctaggatgttagcatgttctatttcttaatctgagagctaattacatgggtgcagttagtctgaaaaatttatcaagctgtagacttataacatgtacacctttctgaatgggtattgtgcttgaattaaaagttataagttggaggtcggatgcggtagctcacacctgtaatcccagcactttgggaggctgaggctggcagatcacttgaggtcaagaccagcctggccaacatagtgaaaccccgtccctacaaaaaatacagaaattagccaggcgtggtggcacatgcctgttatgctagctactcgggaggctgaggcaggagaatcgcttgaacctgggagacggaggtggttgcagtgagccaagattgcaccactgcattccagcttgggtgacatagtaagaacatgtctcaaaaacagggtataagttggaaacacacagaatgaagtgtcagcaaagtgttgataagtttagcgttattttaaatgttgtaaatgttcatatttttatactatggaagaacatgataatgaaccatagcttggatcatgtcttgaaacatcctgaaatctcttttgatactgtgc

SEQ ID NO: 23705 - DNA, 1033 bp, Homo sapiens
agaatcacttgaacctgggaggcagaggttgcagtgagccgagatcacgccattgcactccagcctgggcaacaagagcaaaactccgtctcaaataaataaataaatacaaaatacaaaaattagccaggcatggtggtgcatgcctgtagtcccagctactcaggaggctgaggcaggagaatggcttgaacccgggaggcagagggtgtggtgagctgagatcatgccattgcactccagcttgggcaacagagcaagaccccgtctcataaaaaaaaaaaagtaattacttcatagggttgtagtgaagactaaatgttaatgaatgtgtacgcatgcatgtgtgtctgcacctatgtatataggtgtaaaaatgtacaaatacatttatttctcagttctgtcccctcatagggcccagtagcaatgagaacacgtaacatccagatcttggcttctaaatcccttctcccttaaaaataaccatgatttggactggctctagctcagtattcctttgacaaaaaaccgagactccttgaatacatgcttagttctaagactggagcagaaaaaatacaagatgagcctggaacatcgctttgtgccatggcataggtcacagaagcctatttgaagagccccttattggccaaatctgggaccatttgaacatcagaataaaaaatgaagtcaaataaatatatcctattgagtaaagaacaagaccacagtgaggtggatggatggatatacagatagatagagcacatgagagtgagcgacaggagatgtgggagggggtagcaaatgtagtaaaatggtaacaattggtgaatctgggtgaaaagtatccaagagctctttgtactattcttgcaacttttctgtctgaaattaagccaaaataaaacatttgaaatttttaaatatatgtaaaagagcttacaatgctgcctggcacataataaggagtatatgtgtgtttgctgttactatacgggtaacttccaacaagtggtaggttgga

SEQ ID NO: 23706 - DNA, 1052 bp, Homo sapiens
taggtagaatgtttcactatatatatataatttttctctgaaatcctactgactgtaccagtcagagtttggtgcaagaaacagaaaccactggaagtattttaagcatgaaggaatttattgcagagatgtatgcacttagaaaatctttgaaagggccaaaggaatagattctaggcagggcctttaggagtgaaacctagaacagtactgaacctggccgggcgcggtggctcacgcctgtaatcccagcactttgggaggctgaggcgggtggatcaccttaggtcaggagtttgagaccagcctggccaagatggtgaaaccccgtcttaactaaaaatacaaaaaattagctgggcatggtggcaggcacctgtaatcccagctgctcgggaggctgaggcagagaattgcttgaacccagcaggtggaggttgcagtgagccgagatagcgccactgcactccagcctgggcgacagagcgagactccatctcaaaaaaaataaaaaaaataaaaataaaaaaagaacaatactgaactgactcaccacgggagctgcctctgaggccactactttgagtgagttcaagaccacaatatcttagatgcattccagggttcagtcttgttgccacagcaaatgcaccccaaccctcaggaagctggaaaaggaacattgaaggaggtcctataaaaaacaaaacctcacatttccacgacctcacctgcagcagaaaaataagcaaaggaacaggaaaatagtttccacctcacttatgccttccaaatctcaaccaaatatgtctaattggtggaagcaattcacatcccaaactgtacctgcaaaggagccagaactgtggattttagtcttctacttctgcagtacaggaagctatcctgtaggagggtagaatgcaggttgagggagccaattaatactatccactaacataacatacaaatttaaagtgcaaaaagatacactgagtaggaacaggaaagaccactgaaggtataggctagaggccagatgctgtgcaagg

SEQ ID NO: 23707 - DNA, 1027 bp, Homo sapiens
ttaggttagttgttttcttcctcattcccttcagtgtggttatattatttttatttatttatttatttatttatttatttgagacagggctcactctgttgcccaagctagagtacagtggcatgatcatgactcactacagcctcagtctcctgaatagttaggatcacaagtacatgctaccatgccaagctaattgaaaaaaatttttggggccaggcgcagtgactcacacctgtaatcccagcattttgggaagccaaggcgggcggattatgaggtcaggagtttgagaccagcctggccaacatggtgaaaccccgtctctactaaaaatacaaaaattagctaggtgcggtggtgggcgcctgtaatcccagttactcaggaggctgaagcaggagaatcgcttgaacctgggaggcggaggttgcagcaagccgagatcgcaccattacactccagcctggcgacagagcgactcccattcgggaaaagaaaaaaaactgtagatgtgaagtctgactgtgtgcccccaccgatcttagactcttgggctcaagcaatccacctgcctcaacttcccagagtgctgggtttacaggcatgagccactgcacctggcctatgttacagttaggttcacttgttatcatttatattccattttaggtttatttcataccctcattgaaatttttaaatttgtttattaaagtttattttattttattattttgttttattttattttatttatttcattttaatgagagatggcgtcttgctatgttgcctaggctggtttcaaactcctggcctccagtgatactctcgcttcagcttcccaaagtgctgggatgacaggcccgagccaccatgacccgccaagttgtgtttttagagaaaatatattctctttagaataaggattctaggctgggcgcggtggctcacgcctgtaatcccagaactttgggaggccgaggcgggcggatcatgaggtcaggagatcgagaccatcctg

SEQ ID NO: 23708 - DNA, 1890 bp, Homo sapiens
caggtaatccatgaagatttcctgaaggaagttcgcatgaatgtgagagggcaattaacttttataatttttattgagcacgtagtatatacttgtcagatgctcttctacacattttacaaatgattcttaatcctcacaacagatctttgattaggtttttaaggaaaactagttctttccaaaataacctaatgatcacaaaacatatagaacatacaactctgcatcttgactatggtgcgtaggtctacatgtgataaaatgacattgaactatacacacatcatacaactatcaaatccctccttttgagattgtactagaattatgtaatatgcaaccattgggggaaactgggtaaagagtaaattggatctctctgtactatctttgagtagtgtttaggtattttataaaaataatgtcctacagtttgggtttgtcaaatggttttctcatagttagataggggttatggcttttggagagaaagaccacagaggtctgtagtatattttcaactgtaatctatttcaaaataaaaagttttaaaaaaattctccaaggggggatgattagtaaattgattagtcctttctagacctccaacacaccccaccacacactcacacagacccacactcctattaattccggtaactcgggttgtttggaatgtggatagagaaactaagcttaactatgcgcttccagcacctcgtatctggtacttctgttcaacagaaagccttgggaatggggagggcaggcgtggtaaaaggtacaggtttgggaaggtcgctcggttccttccaatccaaacgagaggcttctgattgtttattctcacaccagagccgtgaccgagacccagaggtccgcttccggccacggccgaacagctgcaccgtgcgtaccgggaacggtcaaggcgcagctggaaccgctgcaaaaggcctccgggcgtaccggacaggtcgcaagggcgggggtccccacctagcggaaatgcacggaggccaacccctccccctgcccccgcgaggagcggggcggactcggcagccgccactccccaggctcacaggaagaaactgggacgctgcggacgcggaactggccagacccgcggcgcgtggcacgcgcgagccctcccgcgcatgctccacccgccggcctccagcccgcgccccgggccccgcctccctccctgcttctccccctctcccgtcagcctccctccgagtttggcccctccggccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtggtgagtcttccgcacgccgggcgggcgcgaagccggggaaagaagccgtccagccccggggctcggcctcgcgactcggggaagcgagatggcgagagggcagggctgggggttcgggcccagccgtgaagggaggcccggaagctgatggagggggaccttaggacttggctttttcagcggctgcagttgggaggaaagaccggcgagtcagggagtgg

SEQ ID NO: 23709 - DNA, 1025 bp, Homo sapiens
tgctgctgtcttttatatttttgtttgcccaaactgtccttagtcacacagtagtcttcaaattcctacaaatgttattatggattcttggaggtttccataccctatttcagttaggcatttatttaatgatttaagaagatttttgtcagtgttgttaatcagttatgatatcaaactactctttatatatcatttaagcctattttaattatatggttgagatgtgtagtagtgattttaacactgtactttcaggccaggcatagtggctcatgcgtataatcccaggactttgagaggtagaggtgggaagattgcttaagcccaagggttcaagaccagcctgggcaacatggtgagaccccgtctctgcaaaaattaaaagaaaaaagtagctgggcatggtggcgtgtgcctgtggtcccacctacacgggaggctgaggcaggaggattggttgaggccaggaggaggtcagggctgcagtgagctgtgttcctgccactgtactccagcctggatgacagactgagaccctgtctcaaaaaaacccacaaaaccaactgttcttttttctttgctttctcatatgatgtatactttttttgaaattcaaattgtttactttgttttttgatttaagtgatgatttactggaggattcagacagtgaagagcattccagatcagattctgtgacaggtatgtaaaaagtattagataatgtatttaaaaaattctttacacagttgtgcatacagctaactaccacttaattctgaatttcttagttaatgctaactctaaatttttgctagtatacacagaagactgaaatattgtgtgtcagagatctcaaattagtagtatgtacatagtgttccatatttaaaatttaaatggtacctatttgagccaaaggaattacagtggatagttacgttaaagttttgtcacatatgtcaggtaattaaatgtttttatttgtataatgtattctgttaactaaaagtagtgtttaa

SEQ ID NO: 23710 - DNA, 1052 bp, Homo sapiens
tggttgttgctttgtttgttttgtgaaaacaaacaaactgttgaatctgtgaaatctgaatctgtaaaatctcttctgtattgtgcagctgctgatttctgtcatttattctgcctagttttaatttttaagacttgtttcttattttgtttcttttggggcagcagagcttagtattcagccaaagattgataggtttggtgtccaaatacctttagccagtaaggctgtgctcaagtgtgccctggcttttattttctgttgtgctttctcaggtctcttttgcataggcatagaggcttagttgactgaggatgtaataatggcttcggctccctctggtctttgctggacacgtgcacagcctctgatcaaggtgggatttgtggagagtttaccaggccccctgtgcttctctcactacatgtaattctgtgttaaatccctggtgtttccagtgctttgcttgccccacacagaattgtgacctcaagtagcagatctccttgtttgtttcccattgaaatcacctgtttaaactggacgctctccatcaatcaagtcccatctggagatagcagtgaatgtgctggttttcactgcttacctcaccctcgttaaattacagttttgtctagctttatagttgcctttcaggaaggggatttatcatcttccttcttctgctatgctggaagtgaatctccaaattagaatgttagaatatactattacccattaatttttttgtcttaattaaagctaaatttgctgtcagtttttttcctgtgacagagattttaaactagaaatttgagttgccttcatttcattgtgaatgctttaaaaaataagagtatttgttaagttttgttattgttgagattaagagatctggctgtggattccagtatagctagtgcctcatctgtaaaatggccacagtaatagttctaccacaagggtttttggtaaaaagtaaatgaattaattaaagcacttaaaatactgtctcataaaagtaaatactagataaatacctgttttcatgt

SEQ ID NO: 23711 - DNA, 1055 bp, Homo sapiens
taagtgtgcccgatttctagccttgtgcattaggttggtatgtttttaagttgaaagcatactttctaggtacacctgcaatttagtgggtgataccttgtttatagtgtgatttgatccttgtttaatgtatgtataatttaagagaatttcaaaagttgatgaagattgttgataatcttagcaagaattttgggttcttaggggaaagtgtcatgttaaataagtctatttaacttttaagaaaagaagtctgctgagcttctctgcctgttagtagcagtttggagaatttggcaagggaactcttaaacccttttcactcctactttccttggttgtcttttcttgccctaaagtgttttctctgttatgtaacaatcttaccgacttttttttgtagcattgtgcagaccctttttttctaaaccctgaaacaaattagaacagtctgccctgatccccagggcatgtgtcccaagacccctcccctccccagtggagacctgaaactgtagctagtactgagccatatatatagtattgttttttcctatatatacatacctgcaataaagtttaatttataaactaggcatagtaagagattaacaataactactaataaaatagaacagttataataatatactatgataaaagttacatgaatgtggtctctcaacatgtcttattgtactgtactcacctgtgtttagactgcacttgaccatgtgtaactgaaactttagaaattgaaactgcatatacgggttcttaatgtttaaaggttcctacttgctactgtatctaggaagtgtctaagagctaatggtcagtattgactgttgtaaagataagggtttaatgcataagaaaatatttacaaccctccttagtataatcagttcccgctatcttttggtattttatatagctttaaggcaggtttttcttttaatcggtatagaatacattttaaagatttttaggtaccacaccaggtttagggttgaatttagaccttgagtaatgtctttacaatttttcttttt

SEQ ID NO: 23712 - DNA, 1052 bp, Homo sapiens
ttctttatttgagtgtctttttgttaggaattgccttatatatccaattgtggaggtagctactaagtgaaattcacagtttatgtagtgaatatgagctttttagattaaaaacctaatatttcctttatatggtgattctagaaaggtcagaattaatttgtatttgttttcttggactatatagtcattttgtagaaacttttacatttacactagaatagaaacatgccatgacaaaaaatttgaactttcagaaaattattttattataaatcaggacctttcgtggaactgtattgaaattaattatcctgggcctggcgcggtggctcatgcctgtaatcccagcactttgggaggccaaggtgggcggatcatgaggtcaagagatcgagaccatcctggctaacacagtgaaaccccgtctctactaaaaaatacaaaaaaaattagctgggcatggtggtggtgcctgtagtcccagctactcaggaggctgaggcaggagaatggcgtgaacgtgagaggtggagcttgcagtgagctgagatcgcgctactgcattccagcctgggcaaacagcaagactctgtctccaaaaaaaaaaaaaaaaaaaaaaattaagtagcctggtttgagacaagcctggtcaacatggcgaaacctcgtctctactaaaaatacaaaaagtattgctgggtgtggtggcaggcacctgcctgtagtcccagcttcttgggaggctgaggtacgagaattgcttgaacctgggaggtggaggttgcagtcagctgagattgtgccgctgcactctagcctgggtgacagagtgagactccgtctcaaaaagaaaaagaaattaagtatcctggatttttattttattttacaaaaattcatgtgtttgcaaaaggcacataatttttaaaagataaaaggttaggtttgaaaaagtttttctccacactccccacccatttctccccctgcaaagcaagcaatggaacgagtttcttgtctttacagggctagtctgtgtatatatatgc

SEQ ID NO: 23713 - DNA, 1048 bp, Homo sapiens
atcttggtcttgttcatatatgtattatattatatatatgatatatctgatatagatatatatatctcatatgtgatatatatcatatatgatatatatatatctcatatgatatatctcgtatatgatatatatatatatatatatatatatatttttttttttttttttttttttttgacatggagtctcgctctgttgccaggctggagtgatggcacaatcttggctcactgcaatctccgcctcccgggttcaagtgattcttctgcctcagcctccccagtacctgggattacaggtgcccaccaccacacccagctaatttttgtatttttagtagagacggggttttgccatgttggtcaggctggtctcgaattccggacctcaggtgatccacctgtcttggtctcccaaagtgctgggattgcaggcatcaggcaccatgcctggcccagccctatatttttttataactagagtttttgaggccctttgtagtataaaaatagaaaaagatattgaaaactcggattgtgcaaaagatttctgattagttctatagtatcaggatggcttatttttccttggattgtttacgtcttctgtttgcttgtagtgattcacttagttttccctgtgttatttgggcgttagattttaaaatcaattaaatgtaaatgttcacagtattaaaaaccatatatattaccccaaaatacaagcatggtatgaatgatttagcaagtctaacagtttccccttgactgttgggattaatagctgtcgatttgctgtggaacacttgaaggagcagatgattttattttgggactacgcatgttttatgagatgcaattgctctgctctgctctgctctcttctcttctcttctcttctcttctcttctcttctcttctcttctcttctcttctcttctcttctgttctcctctcctctcctctcctctcctctcctctcctctcctctcctctcctctcctctcctcccctcccctcccctcccctcccctcccctctcccct

SEQ ID NO: 23714 - DNA, 1046 bp, Homo sapiens
aaaaaaaaaaaaaaaaagtcattcctgtatttcctagatcttgaatgatagtattatcaatatactttattttaccattgtttccttatttatactttccagatttcttttttagaatgaaaattaactatagttttagcatcataatagtgccaaaatatttgaacatgttttgtctttaaccttttcttcatcctggtgttttttgtttttgtttttaccccttgtcttatgccagtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacaggttggagactatttggctctttgttcatgctgtctctaaacttcaaaagctgaaaaagtactttaaaaatgaccattattttcataaagaaacgtaggttgactgatctgagctaatcagtttcaacaaaaattgaggtaaagtctttgtgatatttaaattggttaaaattgtatgaatacatcttatttgatacatatttgagggaatatgattgatattttttgtgcaatcttgaagtaaatccattctctacacactcgatcaaagaatatgtacagttactagttactatttatatggagtatagttcctaaaacaaaattttatagaacagttaaatttaatgtgacttaaaattcactaataatgacagatgcttcataaattttattgtggcctaaattaggggtctccagtccctgggccatggaccagtaccaataaatagcctttcaggaactgggctgcacagcaagatgtgagcggtgggcaagcaagcaccacctgagctccatctccttttagatcagcaggggcatttgattctcataggagcatgaacattattgtgaactgtgcatgtgagggatctaggttgcatgttccttatgagagtc

SEQ ID NO: 23715 - DNA, 1022 bp, Homo sapiens
ttggttttaactaccaccaacatttttgtgctttagcagcagtagaattcaacaaaatcctcagggaaataacatggttatagtatacactgtagcatgtatcattatatgaagaattaaatagtatttgcgttcttgcaatgtggttgtttcctctttgtaagagggagtttgaaagctaaaataaaagtcttacagtattttctgcccaactaatcattcattggtaacaacattagtgttgatgacatttagagtggaaatttgttattctgaagtcttatgggagatgagcagttgtttacactgtagtttgtttttttatacatagcaatgactgtagtacataagcctcctgaggaggataactatgttctttctttttttttaataatttttcttgttagggaagtattagtaactgccttgttttcttttaaactagctctgtcgagaatagcactattcctagaagtttaatttagttgttttccttcactataaaatgtagctggtaagattactagctgacccaccccaaaacaataaggaagaaaaagaattatgacattattaatgatctgccttctgttttttaattgaacttattcttgtaatgtgggtgaaatgagggatgtaaatctgctttttctttacctatctcatctggcattgagctgaagagactgggatatgtctatactgggaaaaagcattgtttgagatccattagaggaccttcccaaggcctttttcagtggtattttgattatatatgattgtagtcctgctttcactttggatctaaaccccaatgaatgcaatatgcaacttcacaggaagttaagcagggcttaaggaaactaaatcaaataatactatttggtatttaaatgcatctagttgtgaaattaagaaaaaaagttgccaatggctgaaagaagagcagattgatcctttacaaaattaactaatatactgcatttgctgatttaattttttaaaactctgatgttttaaag

SEQ ID NO: 23716 - DNA, 1035 bp, Homo sapiens
ttgtctttcattagatttgatgttctactcagtttctggctgttggtgtctattttttagacttattacatataaatattagtgttagtaatgataagatatgttttggatttatagaatgttttgtttcacttatattatcagatctaattaggaatcctaaagtcatctggatgtttttcctttgctgtcatctctctccaggagtactagatattcccatgatcagttgggttgttatgctggtgtccaggttgctggattatgtggcaactgttgaagatgaagcagcagctgcaaagaaacctttgaatggtaaagacagggagaggtttctgacaggtatcagaagtttataataatatgttggtggggattttgagtgacttcgcagttgttccagaactggctattggcctggagctaccagctgtatgtaatttaaggaaaatacaaatgaacttcactacaattctgtttaaagataacatttatacttggtggactttatagacaagctcctttgtctggacatgacttttagtttctaaatgcagctatgacttttgcaaggtgtcttccctcaggcttgtttaaagactttataatagcatgcatgtaagttagttatgaaagggaaatcagagtttttattttttcttagtatgatgtgtcatttcatttagcattattggtatctactaattaactacaaatggcctgtatttttaaatacagaaattctcagattttgagttgtaagctttctttataggttcaaagcacagaaaaatttaaaaattaaaggaaatcaacctgcaacattattttattaccctcttcccagttaacaaggctttttatttttctttatttttatttttcctcagagattcttgttctgaaaataagggtttttaaataaaggatttgagatacctaaatccagtatgtaagccattgagatatgtaagcctacatatgcttacatatggcttacatgtagtatgtaagccattgaaatccataaaattt

SEQ ID NO: 23717 - DNA, 1047 bp, Homo sapiens
ctttaatttataggtttccatctcttcaactatattattattataataaaatttgttttcatctgtttttaattttattatgagaaatattaaatatatataaaaaataaaagagtaaaaaatagttattcctggctgggcacagtggctcacacctgtaaaaccagcactttgagaggccgaggtgggcagatcccttgagggcaggaattttagaccagcctggccaacatggtgaaaaaaatacaaaaattagccggctgtgttgacgcatgcctataataccagtttttccagtatctgttactgttttcagttgccagttttgtagagtgtgaggatttttagtaaattgtattgaagtagaaatgcctatggtttggaaagtacaacatactgagagtgataacatgtcatttcaggtgttgtgggctgagctttaaaccttatcctaaaatgttactgattcttaatgcgttagttgtatttaatggagaattccttttatttgcatgttttgaagacactggttaaggagcggatttaaagaaatagtgtcttgtttttaaatttattcttttgacttagttcttcataaacattgtttttctgaaaaatattttccctttctcttttctgcatagcatcaataactagctttctcacagtgttagcttggtatcccaatactttgctccggacatggtgccttgtgcttcatagcctaacactcatgacaaacatgcagcttaattgtaagttcataaatttattcatttaaatctctgacatatactttagtgttctactattggattcttaaaacagagttttccaaggagtggtatacttgtcaaagtggttgagttggccagatgtggtggctcacgcctgtaaacccagcactttgggaggccagcacgggtggatcacttgaggtcaggagctcgagagcagcctggccaacatggtgaaaccttatctctactaaaaatacaaaagttagtgggcgcctgtagtcccagctacttgggagggtgacgcacg

SEQ ID NO: 23718 - DNA, 1069 bp, Homo sapiens
gctattatatattcattcttcagcagttttggaaaaagtgacttttcagcttctatattttaattattatttgtttcaccatgttggccaggctggttttgaactcctgaagtcaggtgatccacctgcctcggcctcccaaagtgttgagattacaggcatgagccactgcgcctggctggatatatatacttttaatgtggtatcttttatttttcttaggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaagtaagttcaagccaacaacagttgcagtgattcaaataaatttattgcgatgtaagtggaaaattacaggacaaagataaataagtatatttattatatatcggacaatgaaaagcatcagtacaagagggctgtggattattaataaaagttggagaataaagtttctttgaagtggtattttcagagatgaccacagtgatataagagtaaaacatttaatgtgttcctgagttttagattttttaatatagtctcaagaagttcttctctttttcctaaaagtagcatagtgtaatactgaggtgttctccatagatgttatgtaagaagaagtaatgtgaaatcttttgaaatttatgttgtgtattcagcttcttttttttccattaaaagagattaggctaattaaagaaaataggttacaaaatttttcctttttgtatttcatttttacaaatgaaattgtaggaaccagattattttactttcttgtccatttcccattttgaaatgcagatattagaacagtttcttatgtcttttatatagcagtgtataattatcatttttgtaaacatttgttgaatgtgtatatttctctattagaaaatacaaaggtactttaaatggttcaaattttaaatgaaattggtgtctaaatgcatatt

SEQ ID NO: 23719 - DNA, 1028 bp, Homo sapiens
tcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggtaagacaaaaaaataacttacattttagttgttttattacataagaaagggccatgtataaaggccaggtaataataaatttagtgagggttgagtgcctttaaggatctgaatttaagctataaagtactgatatctcctttctccccctcaaaatatgctgtcactggaatcacttattctttatgatgagatgactagcagatgcattgggatgctagctagatcatacaacccttattttcaaaaatttctacaaacaaaaagaaaaagcccaaaaaaacatttcagctgctggaacagtatggacactgatcactgagtact

SEQ ID NO: 23720 - DNA, 1093 bp, Homo sapiens
gttctcctgcctcagcctcccgagtagctgggattacaggcgaccaccaccacgcctggctaatttttgtatatttgatagagacggggtttcaccatgttgaccaggctggtcttgatcttctggccttaggtgatccacttgccttggcctcccaaagtgctgggattgcaggcatgagccactacccccggctctgtggttggttttgtttaatagctgaaacaggtatcctggtgatgctactatgctgcttagttgtcctgacacattattttttcagtgttaatggtatgtcatatttttactgttaagtacttaatgtatgaataaatgtaagaaaacaattgcctattgttagcatgtagattaagagtcaggaatgatgactcttgttgacatgggtggctgagatagtgacacctttgctttctgatggttcagggtacacaaactttattacaggcacaaaattatcaaaaatacggtataaaattaccttaaggctatgtatataagggatgtgtgtatgtgtgtatacacacaaaaataaattttgtgtttccacttggatcccctccctaagataactcattgtgtacatgcaaatattagaaaatgcaaaaaaaagaaaaaaaaagaaatctgaaacagttctagtctcaagcattttggatgagggatacccatcctctattttatcaccattttcatgctgtattaaaatgaaattgccaactcagttcaaaggaatttttcttcttagctttacattgttgattcatggtggaggcgaacaaactatcgactggtgggttggataccttggtccagagaggtccttgtgacatatctcatggcccattacctaggtgatgtgagtcttgccttctgcctgcaataaagttttgttggaatgcagctatgcccatttactagtgtattgtccatagctgcttctctgctacaatgtagattagcagttgtaacagagactatatggcccccccaggttaaagtatttattagctgtccttttatagaaaaaaatgtcccacatcagatttatggaaatgtctgttcctttgtttac

SEQ ID NO: 23721 - DNA, 1077 bp, Homo sapiens
ctttgtgtttgttgaatgaagtaggggaattattctctttgatttcatgtcgtgtgtgtgtgtgtgtgtgtgtgtgtgtgtgtgtgtggttattttggtatagtagctctagactctattatagtttcctgagctgctgtaccaaaataccacaaacgggctggcttaaaacaactgaaatttattctcaatagttgaggaggctgtaagtctgaaatcaagatatcagcagggccatgctccctctgaattcaggctgtagggaagactccttccttgcttcttcctggcttctattggttgccagtagttcttgctgttcattggtttgtagctgaatcactttaatttctgcctacgtcgtcatatggccatctttcctgtgtgtccttgtatctctttctccttataaggacaccagtcatttaatgtagggtcctgcaaaccattatctcctcatcttaacttgattacatctgcaaaggccccatttccaaataaggtcatcttcataggtgctaggggttaggacttgaacatatcttgggaggacaaaatgcaacacacaataatacttattcatgttattgcttccctagtattcaaaaatataagatgatataactatgttataaggtgattgacacagaatgagcaaaattttcttactagacaatgacataattactcaaaagtttgaagcagaaaagaccccaacattttcagcattattattgctcaacataaatgattttttctaatttagtattcagtgtggttcactatattgattagtaactggaaatggggtcctggtaatacatacctaagaatgtgaaagtgactttagaattgggtacttggcagagtatggaataattttgagtagcatgatttaaaaaaaaaatctagattaccttgaatagattgttagataaaatgtggatgataaagcttctgccagtgagggcccagaaggaagtaaggatcataggggagaaaacctacagtgtcttagagaatatctgaattgtcataagcagacttggtagacatacaggtgtttaaagtgctgac

SEQ ID NO: 23722 - DNA, 1015 bp, Homo sapiens
aaagtatcatgtcttctcagtttgctgtgacatataatgagtatcagaattaaagacatcacatggttggaatatcgtaattcctaaaagcctgtgatataaatcatatcctgttcatctaatttaaaataatttatttgtgttttagacattattcaaagtgagcacgtccttattagagtcttttctttgggaaattgagctgttttatcctagtatatcagaaataaaatttctttgttgttaattgagcaaaaagcatgttttcatatacttttcagttttgactttcaaaatgtgaaataatacaagtgaatataatactttaaaaaattaaatccacttaatattaataccctaaaacagttctgtttgaatcgttatacttgtgacatttatgtaaatatcagtttatattctactgtttggtgcttttgctgaacctgtattttgaaattaatctttgttgatgcctaagcctgtggtggtctcatttgtatagctctagcatacttgctgtatatttaactataccttattgtgtgtattagtcttaatgttgactagcatttttatttccagttgttagctataatgaaaaaagttgtgaagaattgtatacatatctaatataagacttaaaaatttgtatctgtataatgggtgatgggaaatatatgatagtggttttaatttgctcttctgattttcgtgaagttgagggtctttcacttgttaaagaatttgaatgctataaattgagagctctttgattttgctgtctttttgctttcattgtatttgttttgttttgtggcatcatatgagaatagtcctttaagaaaacaattatgatgaggtaaagttctgcttctgtaacaatgttctattatataggtacttttatatgaaactatcttctgtgcagcataaaataataaatatagaggatctttaaaaatttgcctataaagggtttcaaaatggtttagaagtgaaaagtgcctcaaattcc

SEQ ID NO: 23723 - DNA, 1025 bp, Homo sapiens
aggctggtctcgagttcctgacctcaagtaatccacctgcctcagcctcccaaagtgctgggataacaggcgtgagccactgcgcccggctggaagcttgttttttaaagcaagcagctttattaatccttataatcctatattttaaagagatcatttaaagttaagtctttactttgaatctgatgttgaaaatgtgaatggccaagccaacacttttctttttctttaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtaagtgtttagtattaaatttatcaacacatatgtgaataggttgtgtaaaggtatccagatcattgcctattattcatcatttatttccttcatagttaagctgttagatgatttgtaagtggtagctcacttccagtattagttatacataataaatcctaaagaatcttcattttcatctctgtgttcattcaaaaattattttccttgtgctgacaaaactgttgggcatcactggggggatgtaaacatgaagcagttatttagagctacccccaagtagctaatgttctccagtaatagaaacaagggatgtacataaacatgtatacttagcaagttataaaatcccttcagtactcttgagtgcagtattatggagaaacacacatgtgagattatttctttactactcagcaatgtgaatgaagtggcatggtagtttttagtggggccttgaaggacagattagatttaggttgggatgag

SEQ ID NO: 23724 - DNA, 1005 bp, Homo sapiens
aatcccagctactcgggaggctgaggcaagagaatcacttgaacccaggaggcggaagttgcagtgagccaagattgtgccattgcactccagactgggcgacaagagtgaaactgtgtctcaaaaagaaaaaaaaaaataccaaaataattaatggcataagtgagtttattaataatacatcatggggtcagtctataaaaattagttaatttctacatactagcaacagacataaaatgagctttataaagatatattttagaatagtaccaaaaatagaaaatatctaagagtaaatctgaaaaatatgtataatacctctttatgaaatttttgactgggcatggtagctcatgtttgtaatcccagcactttgggacatagaggcaggcagatcacttaaggtcagaatttcgacaccaccctggccagcatagtgaaactctatctctattaaaattacaaaaattagccgggcctggtggctcacacctatattcctagctacttgggaggctgaggcaggtgaatctgtctgtgctcatgtatatcttcagtgggttagatatgatagtgcaataatattatttcttcccagatcaatccttaagtttgatacaattccagattcattttggaggaagtttacaagccaattataaaatgtatataaacatgcaaagggtcaggaatagctgagatatccttttgctatatttatcctaaaaagatctgctcatatctgtattcttttcactgttttctcaattcaattttgagtcattgactttttaggctctaaggtggtttatcccttcttttcttgataaatatttgaaaatttgtatttatttatgtgtttattgattcattcattcttaaatataagcagtttctctccatttaccccttcccccagcccctggcaattaccagtctgcattctgtctccatgcatttacctattttggatattgcatataaattgaatcatgtaatgtg

SEQ ID NO: 23725 - DNA, 1674 bp, Homo sapiens
ttttgtttgtttagattgacctgtttgatacatcagactggtcttttttaaaaagtagatgtcaaatgcataatttttttttattaaaatgtttgagactatacattttaattttagattatatagaacaattgaatagggtgcgataggtttctttttatctcacttctctattattaaactattattttcttaatccttatactgtgaagatatgacctaccaaaaattttaaatttctgttttggtctgaaattgactctcttataacactgagcttttatctttatggttcattgtcaaaaaggaaatccaggattatttacataatatttacagtaattgttgttcatgtaagtgcacttcctgggaaggtgtgtatgttaaactgatttttggtaaatgtatggaattgcagagacttagatattataccttggaactgttttagaaatttaatgtgacagatcgaagtttgacctttcttttatgatgtattattttcctggaaaaaagaaatttctttcatcaggctttagatgttcttgaatttggtaacttgtccagtggttaattctaattgatatatttggatgtggtaacaaatacttattttgagataataccttatattaagataaaatgatgtaacttatagtcagtaggttaaacggtagcatgcctcctaaatgatattaaatatggattgttttcaggaaaacacagcttaatataagtatataagtacatatataattaagtaaacataaatataaatatataaatatataattagttatcagttttggttagaatagtaataattttttaagtggctactatttatttatttgagacagggtttccctctgtcacccatgctggaatgcagtggcacgatcttggcttactgcaacctccacctctcaggttcaagcaattctcctgcctcagcctcctgagtaggtgggattacagacatacagcagcatgcccggctaatttttgtatttttggtagagatggggtttcaccatgttagccaggctggtctcaaatcctggccccatgtgatctgcccaccttggcctccaaaagtgctggaattagagacctgagccaacacaccctgccttaagtggcatttaaaaacctgaacaaattatctagccagagtcttccttagacttagtaaaatttctattttggaaaattagtctaaagtttattttccaattttttcatttgcgtatatagtattatttttggcaatgtgggagttgaggtaatgtgataggatccactccaccattttttactacatttagttgtcatgtccttttcttctgtaatctggaagagttcctagcctatctttatctttcataatactgatatttttacagaatgtaaccatttattttatagaatattctacagattggtttgtaagtgtgagagtagtcctcataattttgcctgagacattgtattcaagggatgatttgcttatattgctagcagatgatataaaaaaacgcaggcctaacataatagccttttctgagaactttagtaaaataatgcacattttctttctataacatgtttttaaatgattggtgagcaagacaagaaaatataggaacacactagtttatgccttcctttcag

SEQ ID NO: 23726 - DNA, 1049 bp, Homo sapiens
taaaatattcagtgttcattaatgctaactaaaacttcatttttctaaacattttcatagtcttctttcctatactgactaaatttccctttcctgtattcagtagattactagaggcttaaggaaaacacaaacctaaatgcagttttattttaattaatgtgtattttatatgtactcttagaaaaatggttgtagcatttttgctgttgtgtcttgtatacgttactaaatcttgtatgttttggagtagtccatcttcagtgtccatattcattgctttgtcctgtttttttcctctgtgtaaagttaaaatttacctgtttgctttgttataattttattcctcaaactggaagcatcatatagtaattgctcttagagcaagggagttaccctgggatgtatgtcttaatattctggaggtgtgcttttaaaggatagtttctaaatctttcttgttagagccaggttttgccctgaatgcagtcccttgaacgagaccttcagagtgtggtatggatgtagaccaaaacaatcactaagaggttaagtactgttccagctatacctaacatagtcaagatagattcttctttttcttctcttcttgcttcttaacatcttctgctgtagtgatgacagaagtaccagttttcccagaaaatgtcttcatctagagaaaaagagaatgattgtgaagcaaattgctagaaaatgtatttattacaaatactagtacatactagaaaattgctagaaaatactagtaaatactagaaaattgctagaaaagaaatactagctagtaaatactagaaaatgtatttactagcagagagctagtaaatgtatttattatacatgttgcatttcttgcgtagtttttcagtgtgcagtcctactttagtctgttaacgtgttggaaaatgatagtaaatgagtgtattttaatagaatttaaaatctgttgtttttaacatttgggctgaagagccgaaaatataatgaaaatgtagaagttagattctgccatttacgtattctgt

SEQ ID NO: 23727 - DNA, 1046 bp, Homo sapiens
acaaaaaactacacatacttagtgtatacaattcggtaagtttagaacatcaactcctttttaaagcaactcttttggggagcagttgagcagaatagggatttaaataattttttcctttgaagattagaggatcattgtgtcattaattttataatctagtattgaaattaattccattttactaatattttgaaaaagcaattaatagcagagtttatctcttaataaaagatttatttccacagattaaacacatcacatatttaagcttaaaataatggagttactaaatgtcagagttttaaaataattaaaagagaagtgctgcttaccctacattgcatcaggagtaaagtgttatcagatatgttgctttagtccacaatagtgatgaatgaaccttttctcttcacggagggcttgtgaacaaaagctgaacaagcttcatatcaaagatggcaaatgttttcagtatatcctgaagggatgtatcttcgctgttagtaatctgtggtaaatttcactgtaactatttgatgtaaattgctagcctctgcaagtaagtcacactgtaaataggctctattttttagtttttttaggttttttatatgctgaatcacatatttcctccaaaatgctaatgtttatggttatttcttttgaattttctgtctgatgaacctttacactgttctttttcttttcagctgtttgaagatacttttccccattgaaatgttttagttccaaatgcagaaagtgattttattcctctccctactaccagttactactataaaaatgaaaaaaattgtttattggcataagttttgtaatgtcacacacccgcatctgtagctgttgatgacaattccaagatagtcttcaagctatgcataaatcagcaaacaggcccttttgaggattggaaggatagtgacttcacttgcctggttgtaagctgtaacactgattaaacatgcatttggtgcttgctgagtaaaggagctgcaagctgcacttggagacatggtgttgca

SEQ ID NO: 23728 - DNA, 1077 bp, Homo sapiens
ttggccaggcacatttgctcatgcctgtaatcccagcactttgggaggcccaggtgggcggatcacttgaggtcaggagttcgagaccagcctggccaacatggtgaaccttgtctctactaaaaataaaaaaatgagccgagtgtggtggtgggcgcctgtaatcccagctacttgggaggctaagacaggagaatcgcttgaacccgggaggcggaggttgcagtgagctgagactgtgccattgcactccagcctgggcaacaagagtgaaactctgtctcaaaaaacaaaaaacaaacaaaccctgtaccctttagttatcatcttccatcccctcatcttctctagcactaagcggctgataatctactttctatccttatatagagttgccttttctgaatattttatgtaaattggatcatataatatgtggtctttttaaattggctttttccatgcagcaaaatgttttcagggtttattgatgttgaatgtatcagtagttgataacttcttcgggctgaacaacattccattttatggctgtgtactacattttgcttttccatcagttgatgtctatttgtttttgcattttggcagttgcaaaaatgttgcagtgagcattagcatacaaatatctattggtgtttctgctttgaattcctttggtaatatacctaggatggaattgttgagttacatggattacctgacttttaaaattacaataatcttactgggtgtgagatggtatctcattgtggttttaatttgcatttctttgatgactaagtatgttaagcatattttcatgtgttcattgactattcacctatcctttccagagaaatatcttttcaaattctctgccccatgagtgggggctggctagaagaggggattgaatgtcaacttcttagccatgtgtaccttctaacttagcagcaggaggttgctgtggtaggatgggaaatgctgacatcctgcccctcaccccgctaggaaggcaggctttcagctctgtactaaggcatagctttccaacttggacctctgggagagggaggc

SEQ ID NO: 23729 - DNA, 1013 bp, Homo sapiens
ccacacttgttcatttttttttttttctgtagctattgtaaatgagattgctttcttgatttaatccttggctagatgattattggtgtatagaaacattactggttttcatatattaatcttatatcctgaatctttattgaattcatgtatcaaatccaagagtttctcatggagtctttagggttttctagatcatatcctcagcaaacagggaaaatgttgacttcctgctttttgagtttgaatgccttttttttttcccttgcctgattactctggcaagatgtccagtacgatgttgaataagagtggtgaaaatgagaactcttgacttgttccagttcttagagggaatgctttcagctttttcccattaagtatagtgttagctgtgggtttttcatatatggcctttattatgctgtgtgttccttctatgcccagtttattggggatttatatcaattttatcacatgctttttcaacatttattgaaatgactatagagtttttgtcctttattatgttgttatgatgtgtcacatttatggatttgtgtgtgttgaaccatccttgtatccctgggataaatcatacttgatcatgatgtattatcttttttttgttgtttattttttaaaagttatttatttatttattttgagatcagcttgtgagactggctaatttttttattttgggtagacacagggtttcaccatgttggtcaggctggtctcgaactccttgcctcaagcaattcactcaccttggcctcccaaagtgctgggattacgggtgtgagctacagtgcgtggccatttatttgtttgtttgtttgtttgtttgttttgagatggagtctcgctctgtcacccaggctggagtgcaatggtattatcctggctcactgcaacctccactttctgggttcaagcgattctcctgcctcagcacccccaagtaggtgggaccacagacttgcaccacaacacccggctaatttttg

SEQ ID NO: 23730 - DNA, 1058 bp, Homo sapiens
tgagtagctgggattacagacctgtgccgccatgcctagctaattttcgtatttagtagagacggggtttcaccatgttggccaggctggtctcgaactcctgacccccggtgatccatcagcctcagcctctcaaagtggtgaaattgcaggtgtgagtcaccgcgccctgccagtaaatgtttatggaatggctgttcagtaactgtcattggaagagagatgttagatccttatctcacgttattcacaaaagtaaattccagttggtatacaacacaaaacccaacaaaacaacttataaaagccttagaagcaacgtgtgttcctcgagtaaggaattcactcttagatacaaataattttaatacaaaattcatttgatttatagctagtaattggaagttaacataggcaatattttcttttttactaaaaagaaagttgatttattgaaatagactctggataaattgcaattctgtcattcgttttcacaaaagataaaataacttcatcattcaatttagtttaaaaaagtttccacttcatactgataaatatgtttccagccataatatattatctggtgtatttaatcatttctatatgtaatataactagatatttagttacatttcttgttctcccctaaacttgatactttacttttttttgttttccaaaagtgcctattattatagtttgtatattggtgcttcttaaatatctgctgcattctttcatttagcagctaacctattaagttgacccttgaataatgcaggtattaagggtaccaacccccacatatttgagaatccaagtataactttttctttttttttttttttttttgaggcgggattttgccctatcacccaggctggagtgcagtggcatgatcttgtcctccccagttgcagggactacaggtgtgcgccaccacgcccagctaattttttgttatctttttgtagagatggaagttttaccatgttgcccaggccggtctcaaactcccaggctcaagtgatcctcccaccttggcctcccaa

SEQ ID NO: 23731 - DNA, 1047 bp, Homo sapiens
ctgtcctactgttttgggggactgagattttggtactcatcagcactcttgctctcatattatggacttaatagatagttagtttccaggtagaaatatattccatgctccagatatttgtcttaaaaagcaatctgtgttcatattggcaactgcagatttatctctagggatctccttcaatagagtacaagtgccatagcataaatggatctgggaacatggcttcctttgttctcatatacgaatccgacgtctacaatgttaggcagaaattttccaacactaatcctattacttggttatttgacggactcaggcagaaagctatgatccgtcgattgatagaagctaagtcgttaagtcaaaaagcatcttaaatcttttgtattaaggtcctggaatggcagggtgagactccatacatgttcatgtcttcctgttcctctactgtttgcttaaagctgtcacccagctaaagttgtagacatggaacacttatacaacattaaattttgtgtcctatctacccaaatctaaaagagaactcatatgatggtgagatattattaattttattaaataagtcagttttcttgattgaaaactgaaggaaattttcttggtagaaattctttgttagaatgcagaaccttggcatttgtgaggaagaacttttagatgttataccacctatgctactgtttacttaaatttttctttgccttttttttctacttagaatttttcttcagatcaacttaaaaaattaaacaagtttttcttaggcttttaaagaggaaacttcaaattacccccatagcggatggaccattatcatttgccataaataggagacagtgtaaacatgagtgaaccatttactgtgaataaaatagtgtttacttattaatccttgaaatatattagaccatgtgtgcaaagcagtacaatcgggaataatcattcagattttgtttgttaaatgaaacactggaaaaataaatgcatgtccatcaaaaggaggattgtttatactacagaata

SEQ ID NO: 23732 - DNA, 1030 bp, Homo sapiens
cctaaaattccataatatgattggctgccatttgtttaaccagtaagtggaactttagtttgtttccagtatttaaatatcatatgcaacatctcagtggctttcattacctgtaaatatttgtgcatatccaggattaattctgtaggatgaattaacagaagagaaatgattgattaaaacaggctgtgcatgttttatcaagtagccattgtctttgattgaatcatttatttaatgaaatctttgagttaatagaccctgtcctctatatgatataaaattttcccactgggcatagtaatgggcccatttcttgcatctgttagattgttttttataaaagttaaagaaaatgtatccctatagcatgtgaaagacaagagtccatccatctggcagtgctaatccatctggcagtgctaatatataggtgttatgtaaacatttacacttttgctattcttccatggttggaagttctctccagttgagtgggagaaggactagtgattgtttgtgatttttgtcattataacaattttttgcagttctgggttttattttttcttctccttttagatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggtaaaaaataatgataataaagcactctcccttatctccttggctcatctaattactcaaatttttatacaaaactggaaatactatacaaataaattatacaaaacactagaaattttggtgaccatttttagacggcagtgaaaggagcctccccacccctcccccccttttttttttggcgacaggatctcacttttgcccaagctggagtacagtgatgtgatcac

SEQ ID NO: 23733 - DNA, 1048 bp, Homo sapiens
tcttccgcctcccttgttcaagtgatttatctgcctcagcctcctgagtagctgggattacaggcatctgccaccagacctggctaacttttgtatttttattttcattatttattttatttatttatttattttagatgtaatcttgctctgttgctcagcctggagtgcagtggcttgatctcagctcactgcagccttaacctcctgggttcaagctattctcctgcctcagcctcctgagtatctgggattacagtcacctgccatcatgcccagctaatttttgcatttttagtagagacggggtttcaccatgttggccaggctggtctcgaactccaggctggtcttgaactcctgacctcaagtgagccaccgcgccccgcctgactgatagactattagatcatttcagtataagcatttctaaccctctgcgtctacctgttaaaacactcataacatttgtctaatgtttgtcttttgtactatacttttcatctgtagactatcttggcttttctgcttatactcttcttaattctttcagtgtgttttcctttttcttttttcctgagcaattgtttacctgaaggcttactttttggccttcagaactattttttttctgtctttctgtttttccttcattgtgtctgtaaccctgactttggccatttactctctaaaagtgacacttcaaactgttgtcagctgttagctttctcttgagttgtattactgacattttttacatagataccctgtcatcatctccttaaaggagattttcctcaaatcaagttttctagctttctatttacttaattttacttgattttaaaccatttttctctgtcttagaatcttcaagtattatgtatctcatccttcatccagcacccctggtcagtactaggtcctgtcagtattacttcatgaggggactgtcctctccccaacccatgatttctgttgagttcccacagctttgtctgtttgtccagcttccttgtaccaggttctccccctttcagttccttct

SEQ ID NO: 23734 - DNA, 1133 bp, Homo sapiens
tgtttctgtgacagcttggcagcatgggtaggatctactggtgggttactgaggtcttttcagcaacatcggttactttgaggttaaggattcttgtcagttttgcttacctactatatcaagtgcctgtaacagtagcttgcataaggaggggctcagtaaatatttgtaggcttaatgctttgggctttgttgaaattcagttcctgcctcaaatgatgttgtgctagagggtttgcagttctaacattagtccttttctcctgcatagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattc

SEQ ID NO: 23735 - DNA, 1060 bp, Homo sapiens
catgttgaaaggaagctccatcctgctttctctttcctcttcaaactctgcccagtttctagcagccatccaagcctcctttctctcagcttctagcctcctgatgcttcaagctctaaaggggctgacgtgaaccctgtgagcctatacatttcctgtatagaagaggcattctctggccttctttctcccttagttcctggatgtgatctcgtagtgctcccatgagctccaccaaaagtctgctttccattgcttccttcatgtgtgtccctcttcaggttgcactagctgttttcctgtgcaggaagagactgcagcccaccaccattttaattgttttcagttttattcacgtctcacttctccagggagggaatacccagtccaattatgtcagctgcaggctgccctgggccgctgggagacctacggcctcaggttagacacttctgcctgctggggtccccaggatactgcccctccccacctccctgtactcctctgggtcaaaaggtagacaggcatttccctcgttcttattcctaccacttctgttccttgctgttgctttcccccagcctttctataggttttgttctttggtttattccttccctttttcaccttgctgtctgcaaagtcagcaaatgcagccatagagtgccttccagctctggagcttttctcatctttagaggaaccagctagagctcctctgtgccgcctttctgggagctgctatttttgttattgcccttcttgccagataagtatgagatttcccaagcctggccaattttcaaatatttgtcctgttgggtttttttttttcttctctttttataagactttgtcagaattttttgatataaattcacaaatgagaaaaaatattttttcaagcccaaatcactcatatgttagttttggtttaaaaaaaaaaaaaatcttccccctggttgtctccataccccaaaggtagcagttacttcctgaagcaaggcaaatacttcctttgacccaaagggcaaagttaatctcccaaaggagtttagca

SEQ ID NO: 23736 - DNA, 1092 bp, Homo sapiens
ggccaaggctggcggatcacctgaggtcaggagttcgacaccagtctggccaacatggcgacaccctgtctctagtaaaaatacaaaaattagccaggcatctctgggcatggtggttcacgcctgtaatcctagcacttttgggaggtcgaggcaggtggatcacctgaggtcaggagtttgagaccaaactggccaacacagtgaaaccccgtttctattaaaaatacaaaagttagccgggtgtaatggcgggtgcctgtaatctcagctacttggaaggctgaggcaggagaattgcttgaacccaggaggcagagtttgcagtgaatcgagatcgttccactgcacaccagcctgagcaacacagcgagactctgtttcaaaaaaaaaaaaaaaaaaaaaattagccaggcatggtggtgcatgcctgtaatcctagctactcaagaggctgaggcaggaatattgcttgaacatggaaggtggaggttgcagtgagccaagatcgcgcaccgcactccagccgaggcgacagagtgagactctgtctccaaaaaaaaaaaaagtatgttaagcatcatttgaaaaataatatatatactgtcaacaacttaggagaattaataaatatgtggaatactagttgtagatgtcattcttgtagggttgcagaggcaagttaccttaatttcttggcagctgtaaacaacttttgacttctgcttaaaaacctgttttcctgtagtatattactatgtatacctcattttgtgctgaaattttgcctttttctttttcttttttttgagatgggagacagggtctcactgtgttgcccaggctgatcttgaactcctggcctcaagtgatcctcccacctcagcctcctgagtagctggaacttcaggagcacaccatcctgcctggcttctcttgccattcaactgaagcattattctttctattatagatttttcctgtgggtctttactatatcattcttttttccctccctccctccctccctcctttccttcgttccttcctttcttcttttcttccttcctttctgctttttttttttttttt

SEQ ID NO: 23737 - DNA, 1021 bp, Homo sapiens
atgacttcttcagaattacagagtggcaattaggatgtgaatctaagttttactgaccccaaattctgagttcttctttatgttacttaagaaaatgttattttggcaagttcataattgtcatctcatcaggaaattaaactatgccaaataaatgtattcccaggcattatgtcagctgaactatagctatattgaggtaaactttacatttaagagaggactaaaaatccagaaaatgctcatcttttctggatacttgtttttcccaaaggaagatctcagtggaatttcaatatatagagcagataaaagcacagaattgatttcaccggcagtttaactcttcattgtttggtagaaaccacttgcttattttctgaatcttagtgcatctgatgcagtttataaacctgtggttagaatagtaatgaatttatgatttgcatgtactaagttactgtggggtttttaaatagtgattttcttatattggctgatctctgtctgatccctgtggtcgctaacccccatgaagaggtgacttagacattgtgttaggctgggttggtttggaaaggagacttagagaaggtgaattcttttttttttgttttgtttttttgagacggagtttcactcttgttggccaggctagagtacaatggtgcaatcttgactcactgcaacctccgactcccaggttcaagcgattttcttgcctcagcctcctgagtagctgggattacaggcgcccaccaccatgctcatctaatttttgtatttttagtagagacagggtttcaccatgttggccaagctggtctcgaactcctgatctcaggtgatctacccgcctcagcctcccaaagtgctgggattacagctgtgagccactgtgcctagcctgagaaggtgaattcttatacattgtagattggtacaacagtggggatagcttcaggctccttccctagactcttgctgttcactggcctcctgcttgagttggatttttacc

SEQ ID NO: 23738 - DNA, 1081 bp, Homo sapiens
tatattttataagacagtgttttcttttcattctgtttttttttttttttggagatggattcttgctctgttgcccaggctggagtgcagtggcacgatcttggctcactgcaacctctgcgtcctgggttcaagcagttctctgcctcagtctcctgagtagctgggattataggcacttggcaccatgcccagctaatttttgtagttttagtagagacggggtttcaccatcttggccaggctggtcttgaactcctaacctcgtgatccacctgccttggcctccataagtgctggcattatacgcattagccactgcgcctagcctcttttcattcttaatatatgaaatatttatatacatttatatgccctttaaaatttgttaaattaatatatggaatatttggaattacattccatatatatatccacttatatatattccatatatattattattatatgtggaatgtttcatatattaagaatatttaatattccatttggaatagtctaataataaaaagaactctggtgaaaagttaactgttatgctgaatctaatgtttgtcattttcttgccttttaaaaaaaattttaatttcatgttttgtatgcttgtaagtcagttgcttaaatttgcttgtttttgagctttataaaagtggtatcttataataaatatatagtcctctgtgatttgcttgttttctctcattattgtattcctgtgatgcatgttgttatatgtagctgcaatttactttgcagtatagcattctgttggatgaatatacaacaatttgtcgttttccttttgggcatggattgtttccagatttttcctattatacacaatattgctatggatatttatgtatctcattcttgatatatctgttcaagaattcctctggtctctctatctaggatggaagtactgagtcgaggatatgtgaatgttcacaaagaatagtgccaaactgttttcttctttttttttgagatggagtcttgctctgtcactcaggctggagtgcaatggcgcaatcttggctcactgcaacctccgcct

SEQ ID NO: 23739 - DNA, 1058 bp, Homo sapiens
ataccctataaagaggcttgttttctaaagtaaaggtatgtattgaattattacaaacttctaaatagtacagattgtagaatttatacatttattacaataagcagacccctaaaaaggcagattaggtacacctgcaagtgaaacaggaatctctttttacaccaagaagtattaattatttttacttgatttttctagcgccaacttgcaagtttgctctttgagttgggatgtaccagttcagcccttcagatatttgaaaagctagaaatgtgggaagatgttgtcatttgttatgaaagagccgggcagcacggaaaggtatgtaatagtccaatttgatgtactggtgagagccttccctctgggagcatcttctcacttgttttgtttttcaaacccacttttgccaatattcacttatattccttttttcactttttttccagaaaacttttaaatgttttctctgatttccactggggcagatttttacaaaatttttaagaaagactaacaagagctttgaagacgtgggattttgatttctttcctttactcaccttctcccttaggatgacttcaaagcgaaatatttggaatcattttaatgatcactgggttgcctgatgatcagatgctgtgggcctcaatggaggttccctaggagagagggtgagagcagctgggttggtctttaaaagaaaatccaaagggtgtgacgacacctcttgaggcagaagagttgtcaagtgtgtaatgcacatttaattctacccttaaattgggccaggagggaaaatgttgcaatatttgcatctgttatttgtctgttgtttttttcccctcatacatgaacagaattttaagaagaataaggggctctgcattgttagtcactttaaaaactgacacattgaaatcatatgttaaattttggattaaaaatttaaaagacttaagttgagtacataagcaagcagagtaaagcccacaaattggatcatttatacctacagtcaaccttttgccatcaccctaaaaaagagcaatag

SEQ ID NO: 23740 - DNA, 1066 bp, Homo sapiens
agaataattaattttaattctgtaatagattatggaaatgtacaaaattataattgtacagcttgattaattctcctttattattttttaatgttcacataatcagcattaaaatttttttactttaatgtagttttatttttcaataattttgtttttgaaaataatttttgaatagaatcatcttataagtccccagatggagtaaaaccaatttattgatcaacagtttgttggttgataaatatgtttatttaaaccgtgtaatttaaattattttctttagtgctctggttcactttcaaaagtgttgcagtttgtacattacattatgtggttgcctaactaagcattatcaagtacttgtatatcagatatggatgtggttatgaattgtgctatgtcaacctatcaacagagaacagagagtttctgccaggaaatgataatggacagaactagtttccaaagggccttaaatgccctgtatcaagattacctaaccctgtagatgtgggagcctattgtggttttgaattaaaaagtgatatgacaaaagtggtattatgggaagtttaaataaggaatgaatatcatgggtgagttatcagtggcttgagtggtaagcatggaaaacatagaatgactgaagcctcattacagaggaaattttctgggacttacacattgggctggcagtattgagggagacgttggaatcagagaggaggccagttttctcaattttctgattaaaaaggaaaatgtctctattgatagccatagggatttaggaggaagggaaaatatcttttgccagcaaggtgatgtggttttggatgttgaatatgaggagatggtgctgtattgtagcagagattgttgctagtccattggagataaaagccctagtgaagcccaacagtgaggcctgagcatgcagatggggcttttctgtggaagttacttgaaaccatgaaagtgagttcttcacagaaaactgtgttggaagagaataacaggcaatgtcctgagctttgggcatctcctgaagttggaagaagat

SEQ ID NO: 23741 - DNA, 1045 bp, Homo sapiens
acacccactaggatggctactagaaaaaaaattaaaaaaaaaaaaatagaaaataggccaggcgcggtggctcacacctgtaatcccagcactttgggaggccaaggcgggcagatcatgaggtcaggagattgagaccatcctggctaacacagtaaaaccccatctctactaaaaatacaaaaaaatgaatggtggcgggcgcctgtagtcccagctatttgggagactgaggcaggagaatggagtggacccaggaggtggagcttgcagtgagccaagatggcgccactgcactccagcctgggcgacagagcgcgactccatctcaaaaaaaagaaagaaagaaaatggctgggcgcggtggctcacgcctgtaatcccagaactttgggaggccgaggcgggcggatcacgaggtcaggagatcgagaccatcctggctaacacggtgaagccctgtctctactaaaaatacaacaaaaattagccaggcgtggtggtgggcgcctgtggtcctagctactcgggaggctgaggcaggagaatggcatgaacccgggaggtggagcttaccgtgagccaagattgcaccactgcactccagcctgggcaacagagcgagactccagctcaaaaaaaaaaataataataataataataataataagtgttgacaaggacatggagaaattggaatccttgtgcgctgttggtgggaatgtaaaacagtacagctgctgtggaaaacagtatggtagttcctttaaaaatcgaaaatggaattaccatatggtccagcacttttacttctgggtatataccccaaagaatttaaagcaggatctcaaagagaaatgtgtatacttacattcatagcagcattattcacatagctaaaacctggaagcaacccaaatttccatctatggatgaatggatacacaaaatgtggtatgtacatacaatggaatattagtcttaaaaaggaaggaaattgtgacacatgctacaaaatggatgaacctggaggaggtttatgtta

SEQ ID NO: 23742 - DNA, 1085 bp, Homo sapiens
aaaattctatagcctaatgttacagtgaaaaaggaagataaaacagtttacataatattatattataaaacttacacataataaaaagattagaaagaaatttactctgttagtaatgtttgtgattggccgatggacccaataagcataatgttacagtgaaaaaggagataaaacagtttatatagtattataatataaaacttacatataataaaaagattagaaagaaatttattctaatgttagtagtgtttgtgattggccgatgaacccaataagaattttcttttttaaattttgtattagctctgacatgggggaaattctaattttaaaaaaaaattacaaaaacaaaacccattctggttctggttgattcgagatttagcaaagaaatgataaaagttactagcatacatatttcataaaagagaaacctttccaatgtaaaagaacttaatagaaaggaagaaagaggagaggggagctgtgctttgtaaattgatgtagcaaatgcttgataacaggatccaggactcagactgaattcagattcaagcctgaagcctgctttccctcggtatgacctgggagaggttcttcagctcctctgtgctccagtttgttcatctgcacaatgcacataaaaatagcatcatcctcatagggttgctgggtgggttacatgtgctcacagagcatgtggcacataggaagggctatatatgtaagaggtgttatctgcctcattgttttcatctcctcatccttatctaagctcaggagtcacaggtcactggtgatcagaatccagcttcatgactcacttgctgtgtaaccatgagaaagtttgttttacctctttaagcctcaggttttttatttgtaaagtaggggtaataaagtacctgcttcctagggttattgtgagaatttaatgaaatcgggtaggtcacgtgcttagcacagggtttggcacaaagcgagtgctcacagcagaagtagtagggaggtatcaagagctgacaccatggtggtgaattctgtttgagttctgttttgaaccatgaggaaacatggaa

SEQ ID NO: 23743 - DNA, 1032 bp, Homo sapiens
tcttgctacactaggagtgatccactcacctatattcctcctcctttaggtgacagaagtcctacatcttgattatcctgtattggtgaactggaaaggaaccttgggtaatcacacacagatgtataataaccaacaggttgttaggctctaaatgtcttcctagctggactgcattctcattagttattatttaaaataatataaaataagtaacagtatgacacaaaaattgcatatgtatttgatactattaataaagcagtttttgtttcagacttatattcatttaatttagctattaaggtctaaagttgctaggaaagtttttgtgatttgctttgtgaagtagtgtagtaacatgctgcttgataaaaataatggtaattgcctttcacagaatcagaaatgcttttcatacctagtgaggaaatgctatacttcttttaaaaaacttacatatccatatcagctttatgttcagattaatttaggatgttcataaaaaacaaggatttgatcaagctcagctttatgttcaaataatttaggatgttcatgaaaaacaaggatttgatcaagctccattaggaagtctttgacaagaaaccaaaagaaatgattgggactttcaatttcacatgtatttgttgaatatttactgtgtgccaggcagtgtgctagcagccaaactaaatagtctttagtttcaatgaataattgataactggaatgtttcttccatcatttctagtgtaagtggttttttttttcatttttagtagagagctatattttcataggacaaaacatgtaatactgtcccctctgttgatattaagtcagatattttatctgttcagtcaaagcccagttctggtgttaatgggcctggatttaattaattaaaggattaacttactgtatcattacctgtgtgcaccaggcacccttctgaattgcagacagcatgtaggaagatctaactaaactttaaccttacaagtacaaaccacttctaggtgttctcag

SEQ ID NO: 23744 - DNA, 1039 bp, Homo sapiens
caattaaattaaattgagggagtgaatggaattaaacatttttttttaccctgtatttctttttcaggaatctgagttggaatttgataaccatcagtttattataacagggtcagtactggagtgataatgggttcggaaaggcaggttctgggcaagggaaagctgataatggttgcttacggttgaggttttagatgacgaagcttggttttgtgtgtgatttagattgggactgcaccaaaatgaggaaggagagtaggtgtaaaatctcgggagtgcaggggaggaatcaaggagcagccagaaaagagagatcgaatgggaccggttttggaatctgggagtggttggggaaggctaggtagagtagggcatggaggcccatagagatttcattccttggtatggaagaaaaatgagcaagagttacttgaagggtaagcagtggtttgagatcctgggtcttgattatgggaggcagtaatcagtagttagtgagatcctgaaagcaggagagggctgctcagagagaattcacagggcatccaactgtgagtgtagacccagatgcttggagcagtgggtatgagaaactcaagctcctgagagcgctgtctgccaacacacatgacgattagcagacccttcctggtggttaaggagctcacaggtcagtggaagacatacctgcattctgcgcatatgtgtacatgcatagaataatatttctttgtaataaaggtaatgagaggagctttgcagcaggtgatctgggagttccaagaagagggatgtgccttttcctactccacagaacctaaactcatttcaaagcccttggtaaacacgttcatctactgcctcctcaaccacatatgtcactgctctccaatccacgcctcactgtctcttccctcttcctgctccttttctgctccacactttgtgttcctgcctgtcatatcctcccttgaatggtaatgtcaggtattttgcatgcattacttgtgacaggagacattcagatgattgaact

SEQ ID NO: 23745 - DNA, 1049 bp, Homo sapiens
cacatagcccaccgagtagagtcttgtgttgctcactgtcttgtctgggtcaggcctctttattatttgtttatttattttttctagctagatggctatctaaagatacagactgtgtcttttctttttctttctttttttttcttttttgagacggagtctcgctgtgtcgcccaggctggagtgcagtggcatgatctcggctcactgcaacctccgccgcctgggttcaagcgattcttctgcctcagcctcccaagtagctgggactacaggtgcccgccaccatgcccagctaatttttgtatttcagtagagatagggtttcaccatattggccaggctgttctcgaactcctgaccttgtgatccacctgcctctgcatcccaaagtgctgggattataggcgtgagccaccgtgcctggcccagactgtgtcttttctgtattcccagtgcctaatctggaatggagcacatgataaatagcattcattcctttatttattctgcaaactcttaatgaacacctgctatgtgtcaacctttgtattagggcataaacagataaataaggcaggatagtcacccttaaataacccacagtttactggaagtctcagtctctccctctgtctctctcttgctcacacacatatataattataatgataaagatatgtaccagatgcatctagttgcatttatttgaagaggtgaggtagctgagagtgataatggtatgtgtatcctttacaggatactaccaaactgtttgctatagtgactataccattttgtttccttaccagccgtgtatgaaagttttagttgctccacatcctcatcagcacttagtattgtcagttttttctttgtgccattctaataggtgtatagtcgtagctcattgggcttttaatgtgaatttttctagtgatcaatcttttcacatgcttttgagtatctttgcatatgcgtacttgccatccatagatcttctttggtgaagtggacctttagcccatgtttttaattgtgctatttat

SEQ ID NO: 23746 - DNA, 1037 bp, Homo sapiens
agaccatgaagtccagaggagggtggtggagggagagagtgtttcaggctagaatggccggttttagctgtggatggaaaggtagtatttgatggaccaagaggagaggaaatctgtaagcaattgctcagaggaggaggaagtagaagaaggaatttggctgagcatgttttacatgaagtattcctattaggggagtagccataagtgagggtgagaatgcaacacaggtgaaataacattttgggaaatttatctggtggtggaggaccaggcggtggaggaccaggcatagagaagggaagagactaaaatgagagacggtgtttaaatagttaatgcaatcacatagtcatgaagagggagggcttaagcaaaaaggaagggatagctaggagagcccttgtagagggtggagaaggcaggctgtgccctattcaaggaaagggaggcagtgggtcaggtgattccactgactcttagactctatattcacagtatagatttctgttcgttttttttttttcttcaaaagcctttaaaaatgttcaaaaggaaagcatttagaccttttatgaaatagagttgttaaaggaaaaagtatttttttttttaattatactttaagttctgggatacatgtgcagaacatggcaggtatacacatgccatggtggtttgctgcacccatcaacctgtcatctacattaggtatttctcctaatgctatccctcccctagccccctacccactgacaggccctggtgtgtgatgttcccctccctgtgtccatgtgttctcattgttcaactcccacttacgagtgagaacatgtggtgtttggttttctgttcctgtgttagtttgctgagaatgatggtttctagcttcagccatgtccctgcaaaggacatgaactcatccttttttatggctgcatagcattccatggtgtatatgtgccacattttctttatccagtctatcattgatgagcatttgggttgattccaagtccttgctattgtgaacagtg

SEQ ID NO: 23747 - DNA, 1044 bp, Homo sapiens
ctgggtaagagataaagaactttattactcatggcatagcaggcagcatgagcttcatgttcagattgggtctccacactccctaagcttcatggggtaatgcagagtagcccaggtcgatgttactcgtgtagtaggtttgtgtcgcagttgaggaaccctgagcttaggaaataccattctttaaaaggggctgctagccaactttgcctaatctttgtgccagatggagatgttattttcatttccctggatagcaaacaaatctttcctttgccacagaaggagatactatctgttttccaagactgtgtactatataaacattcttgaaaagacaggccagaagaaaagctgataaagatatgcagaaacacagaaggcacatgggtaattttttcccaacttgtattgttgggattttcttcttagtcatgtcatgtcaaatacagttagtattgtgtctttccagtatttatgcttctccccttttgctatattttactagccaggactgctagtgtaatgtagaacaggagtggtgacagtggtcatctttgccttttgttctaggttttagggtgaaagtatgttattttaccaatcagtataatacattaacaaaataatcattgtagaaacggggtctaaaatgaggaaattatcttatattactcatttgctgagtgtttccttttatcatgaaggcttgttgtatttgccagatgcattttctgtatgtagtgtgatcatcaataaaaatacgattattttttattcctttattctgtcagtatggttagttaaatcaattaagttttaaatgttaaaccaaccttgcattactaggataaattccacttgaggtgaggcatggtggttatacctgtaatcccagctttggaaggctgaggcaggaagatcacttgaggccattagtttgagaccatcctgggtaacacaatgagactccatctctacaaaaaataaaaatattagctgggtgtggtggtgcacgcctgtagcccaagctactcaggaggc

SEQ ID NO: 23748 - DNA, 1060 bp, Homo sapiens
cttgctggtacagttgggtttaaaaggattaccttgttgagtcagttttccctccccttggctagcagttggggcagaatgtggaaatacagatttgcagtaatgcatgacctgagaggatgctgcttgagtcaggcttggcttccatagtgtgcacagacttcttcatgccccatgctgctctaattgtacttaagaaccatctaggaatgctatgcctctgggtagcagcacttttgtggagcctccctgtccatgtccagaaagctgtatgaatggaggtttgcctggtacttaatgtgtgtctacgtgtgtgtatgtatgtgtgtgcatgcaatgtatgtttgcatgactctcattggtggtcgtggggagtgtgtcatctcctcccatggacacttcctatatttctggtagcctctggtcctgtggggctgtaagtagttaattgttcctagttctctctggtctatgagcagcttaagcatagatattgtgttaatactagtagtaacagagaccctttgagttctggtctctctctgttttaatgatgaagcaactaagccaaagatgggtaaatagtgcctgaggatactcagcccatgagtagaagagctgaggttcctacgtaaggcggtccaaggtcaacatctgtactctcttcactattctctgttctctcttttatctttgtatccttggcacatggtagttaatcagtaagtcttagctgaataaatgctgcttatgaacacttctaggtggaaattaagcattgcttttaccagagtataatgctgaattgtaatatactcaaggatggtggcaagaatcccctgtacttggtgccgaatcctctgactaatcgcccgaaggaagttctgtgttctcagagcatctgtcctatttgtgtctcttgggtctggatttcccagtctttagtccagtttcataatctgcctcctgagctcttccagggaaactttctgagcttttcttggtgctgtttggagttccactttcagagtgaattttcattctgatgttccctgattgg

SEQ ID NO: 23749 - DNA, 1044 bp, Homo sapiens
acctgtctgtcattggctcttcattcatatctgttgtaatagtttggtgatagtagcccacgtttagagcgctagttttcaaccatggaactattgatatattgggccaggtactttttctgttggggtggggggctgttctgtgcattataggatacttagtgtcatccctggctttttcccagtagatgccaggctgccatctccaagtcttgacacttaaaaatgtctccagacattgccaagtgtccctgagaagcaaatacagcccctggttaagaaccactggtaaaggaagatttggaattacttggttgtgttgatcatgtttcttaatgaccattactaaaaatcgcttattttctatattttttccctcaaatatctaccttctttcattttaatttctcaatcccttttgtctctttcatctcatttagtcgaagacaatttttattggtctttctcttatattttcatttctcccattttcctgactttgtgtttgctcctttcattttacttttgctgtgtttttctggcatactctggttttcccatattctttactggcagtctgtatatgctgtttgtatgcactgtccgtatgcacagtctgtatgctgaatgcacagtctatatgttgtatgcactgtctgtaagctgtacgcattgtctgtatgcagtctgtatgctgtatgcactgtctgtatgcacaatctgtaatgctctgtatgcactgtctgtatgctgtatgcactgtgtatgcacagtctgtatgctgtattcattgtcggcatagtctgtatgctgtatgcactgtctgtatgcacagtctctatgttgtatacacagtctgtatgctgtatgcattgtctgtatgcatagtctgtatgttgtatgcactgtctgtatgcataatctgtatgctgtatgcactgtttgtatgcagattctctatgctgtgtgcactgtctgtatgcacaatctctatgttgtatacacagtctgtatgcatagtctgtatgctgtatgcactgtctg

SEQ ID NO: 23750 - DNA, 1045 bp, Homo sapiens
agactgtggttttgatttgttttctgtgatttgttattggaatgaaaattcccactgtgtgtgtatttccaccctcgtgtgtatatatgtattttaaactctcaaatcttggttgaactgtgttctgaaagatgaaattatatcttagaagaatgtgaagataagtttcttatctgttctgtccatatctttcccgctcatcctgtttaaatatattttctacatagtaaggagctagtaaaagaatgtagactaatatacattatcacagtggtggtgttctctgctcaaaccccctaaaagatggctgttgttcagaaagaagctcaggaattaactgaaagagttacgcatgtaggaaagacaagaagggagatgtggctatttttgctgaggccagagctctactgagagctggagggctagttggaaagtttttaaaagagataatttggcaggaccatgaaggatactgaaatggcaaaatggagtaagaaccacaaaagatgattaaaactggaaaggaggtacaggtagtaggagggacctaaacatactgtctctgcatactcctgttctgtggtaggtaaaagaggaggctccaaagaagccttacatggaacagaaaggaaggaacagttagtcagagaagtctgaggaaaagcagaagcttttatagcatcttcatttttatatttacagaagagatcaaatgcaaacattaattttttattgtgctgaaagatttgaaggtcaaacagaagctgatagctctgattctttagaaaaatagaagatactaagatcatttgagcatgatgtatcttggagtgaaattgaagaagtgaggtatgtcattgtagtccactgccattacttttgagaagctatgggaactagagaagcggttgaaaactagaggttggcaataacaagtgttatcttctccctttaaaagtgattaaaaagggggtctacagtaatgaccagttggtatgtttaatattgatatattacaagagcaataataataatgcataccttg

SEQ ID NO: 23751 - DNA, 1073 bp, Homo sapiens
aaatacgtacatgtatatatgtatgatggctgtgtgtatatatacacacatatattcaatcaagtatatatgtgtgtatttttttaacttttaggtttaggggtacatgtgaaagtttgttacataggtaaacacgtgtcacggggtttcgttgtacagattatttcatcacccaggtattaagcccagtaccgtagttatcttttctgcccttctccctccttttaccctcccacttaaagtagaccccagggtctgttgttcccttctttgtgttcataagttcttatcatttagctcccacttacaagtgtgagaacatgtggtattcggttttctgttcctgcatagtttgctaaggataatagcctccagctccatatatgtttctgcagaagacatgatctcattcttttttatggctgcatagtatttcatggcatatatgtaccatattttctttatccagtctgttattgatgagcatttagggtgattccatgtctttgctatcgtgaatagtgctgcaatgaacattcattcacgtgcatgtgtctttaaggtagaacgatttatattcctctgggtatatatccagtaatgggattgctgggttgaatggtagttctgcttttagctctttgaggaattgccaaactgctttccacaatgattgaactaatttatactcccaccagcagtgttgtatgtgtattttttaaagtaatttttttcgcaattaaacatcatctttattaagcaaagtactatgctattaaaagactacaaaacttcattagtacgtggttgactactcagacttacatgcagtttcttaatatttagcatggtatgcaagtcaggaaaaataattcccaaatctctccctgagtaaatataattcgcatggagctaactttggtgattatcatcgttatttctcattagatccactttctgaccacttaaatacattttcctttagttctgttggaaaactttctaattagtctgattttcttcagtggaaataaattttgtaaagtcttttttttttttttttttttttttag

SEQ ID NO: 23752 - DNA, 1053 bp, Homo sapiens
tacaaaaattagctgggcgtggtgcaggtgcctgtagtcccagctgctcgggaggctgaggcaggagaatcagttgaacccgggaggtggaggttgcagtgagccgagatggtgctactgcactccagcctgggcaacagagcaagactccgtctcaaaaaaaaaaaaaaaattactccaaactgtagtgatttaaagccacaaacattaccttagagtttctgtggttcaggaatttagagggacctcagttggttggttctggctcagtttctttcatgaaattgcaaccagggtatcagtaagagctgcagttatctgaaggcttgactgggcctagaagatactttcaaggtggttcactcatgtgactgttggcaggagatttcagttctttgccccatgagtgagtgtctccttagactgcttgagtattcccgtagcatgggagttggcttccccgagagtgagtgatccaacagagacagaccacgacagaagccacagtgtcttttatgatgtagtctctgaagttgcaaagcatcattccatttttttctgttatttatttattttttagaaacagggtcttgctatattgccagggttagtctcgatctcctgaactcaagcaatcctccccctcagcctcccaaagtgcagggattacaggcattagccaccatatctggtttgttcttagacaagattcacaaaaaccagcccatgtccaaggggagattagacttttagatttcacctcttaaagatagaagtatcagggaatttgtggacatattttaaaaccatcacagtgttcaacagaaggggcactcttttgatgagagtcaaaggaaatgaggaagctgaaaatgggcaacctaaaaagaattagctgacagctggaaaacttagagtgtacaactatacatcagtaatttttttattggcaactaattgtttttcaattttatttatcacataatattggagcatagctagctatatatgatgattttgggaaaaggatattgaggctgaaatctttcctaa

SEQ ID NO: 23753 - DNA, 1042 bp, Homo sapiens
cacaccctgaagagtgtacacgtgacttgtgtattgaatcagcctgtaggtctctttaaaccgggtggtggctttaaaccacagagaggttgcttcttcccagaggatattgcctgtgctggttggtccccattgtttaagttggatgcacgctaatgtgctgttgcggcattctggacgaatgctgaggagactgtatttgttcatgacatctgatgtgagtcttgaacttgttacatttatttctctgcttttggtcacatcttggtctgatgaccaaacaaggcaactgtgcccttttctagactgatgtctgtttgtcaagcacagttttcacatttttatatttttctctattgttaacaaccccgaagcagaaatgaaagctttttatcacgggaggaggggtatcggcttcacttccatcccattcaccattcactctgaatatctgtggtttgttttaaaccgagtgccagtgcctcttcttggaggtataaatttgcacagggtctggcagacgctgcagacaggatgttgactcttgagtgtcttgactgactaggaggcccaatggcggtgctgcatggctccaggcaatctgtgcctctagccaaggcctccaaaacccaaagttttaaagtgcttgcttaagattttgggggctgattcacctaaagggatctaaaaattgcattttttttcctccaaaggaccaagcacagaagttgtgccagtggtttccctgttaactcctgactggcctgatttttgcttctcagacttataattcctaatcacctggtaggtgccactcgggatggtcttctgcctctggttagtcctgagcttgttttctcactggtgcagcaggaccttagaccaaaatgacctccagcatcctgtgagtcttggatctctgtgggatccgacagtcacccttgccccatgcttcgggttactttgtctattccacaattattgggtgcctactctctgcaaggcatcaggagtccttgaatattaccttattcaagacatg

SEQ ID NO: 23754 - DNA, 1033 bp, Homo sapiens
ctttatagcagaatgcttgtaaaacacaagcatttttatttttatatgaaataaaatatagcttctgcttccaagaagatgtgaacattgtaaaaatcagaattaagtcatatgaaactgtctctgccttttgaaaatccagatgattccaagccaaaagaaatttttttttggcaaagaaatataagaagtttttaataacaataggcccggagaatctccagtgcttataaagtgactactgtagctgggaggtgaaatgggaataatgattaagtgcttgctttctttggatgtctcagtttgcctaagtgagcataatttaggtgactgtgtgagcatctgtgtggcagctgctggtgctacaagttaatgccagagaagacaaaatagttggcacacggattctaatttcatgattgtaccaggagccagaaaaaggaggagtttatattcttttgaagtgggaaaatgttgtctctttttttcttgggtttcacacacttgaacacacaaagtatcctcaagatatttgtaagcattttccgacaacttagattataagctgatttgtttgtgctactgtgaaaaagcaaatcaaactaggtgaattttctctgctggtgaaatcaggattctgttgttttttttgaatttctaaggtagactcccagataactttaaaatgtcctgtaagcatttaaaggaggggttactgaagtgtttaagtaaagtttgattggaacacagccatgcccactcatttacatattgtttttgacaggctgctttccagctaagcgggtccacagagttgaataggaatagagtccttttcgcctacaatcctaatatagttacaatttggccctttgtagaaaaagtttgctagccctcgatttaaagtattgactgatagtagcatcctattggatgtcattttgcaaggtgccagaaggtctgcttggccactaggacatcttgccatttcagacaacatgtcttgatcctccagggttagaaccaccggtga

SEQ ID NO: 23755 - DNA, 1046 bp, Homo sapiens
caggctggagtgcagtggcgcaatctctgctcactgccacctctgcctcccgggctcaagcaatttttctacctcagccgctcgagctgggatcataggcacccgccaccacacctggctaatttctgtatttttggtagagatggggtttcaccgagttggccaggctggtcttgaactcctgacctcaagtggtccgcccacgtcggcctcccaaagtgctaggataacaggtatgagccaccgcgcctggcctcaaatttaaatagaatattcaatccagagaaagaattcaactttaaaaataacgattatggacaatttccatttctgtagccacgaagagaaaatttattaggggcttgaggagacttgccccttttaattgttggtggatgaatcgcaaaacttgaatttaatggaatccaagtgccttggactgcttttgagcaggtcattcatgtggttagagcaacgctgcttccaagggaatgttttgattgattgtgtcagcgtccttgggtggcccttccaggagcttgaatgcctgtgtaagtttggtttcctctggctagcttctaagctcctgcagatgaggtaccacatcttctttctattttgttcttctaataatgactagtgtaataaattaatcagtatggaaattcagcacaggtaggttgacctactatagaaagaggctttttcagctctgttgagagtcactagatattatagacaagtactatcaactaggtatttgggcctcgtgattagttgcagttatttctgcctcattattactggtcattgtggttcttaactcagggatagaaggtagattttattttatgtacccactctatctgttgctgaccagcacagtatgctgagaattcggagatgacatctaggcccagcaagaactatgataggttaataatttttgttagaggagaggagagtgcagcacctaccctataggtgctgctgtcatggttgttgccagcagtccagcagttatctcaatgaagactgggtctttc

SEQ ID NO: 23756 - DNA, 1026 bp, Homo sapiens
ccagaagcctcctgtaggtgggacctgtgccatcttctcacattttacacacatgccatacccttaagagttatgttccctgatggtccacacaagagatttaaacagacagatacaactaaaatctaaaaagcctatattgatcttacacactatgaggctcttattaagaaaaaaaggcattggaaatttaagttttatgaagtactctgagcagtgacagattttcttagactagaaaaacatcaaggtgctcccatttggaaatgtacttgttcatttttgtgttgtattgatttctgtccaggtattttctttccaagttttatagtttttttcctttctaattgtgtcgataacaagggaactggtttatagcgtggctgtgagggacagcagtgctctggggctgggcatcctgcactcaattaaccttcatatttcacacctaatcattgcagtgtggcaaagcgctccctggcctttcaaagcaagaggactgctgtggaactgtgggtacctcctggggctttaacaaatgccagaaatgccccaagaaaccatgtaagtaatgtttcctcactcctttgcaggttaatgtagcatatctgttttttatgattactcctttaatgatgaggcaatattagactttcaaagaactctcctactgaattctagaatgtagtactatgatgtgcatttccagaaaatttgcaagtctgaaaaagttttcatgtcaattattttgtaataagcacagttattaattatcctctttagttggattacttatggggaaaaaaagtcttaagtggtaatgagttaaaatggactttttgtctcaggggaagagaaaataagatctcttttaaaatggtaaataaatgtttcaaaccctgtaaaaagtacagttgttatttcctaggtttaaattccttaaatgagatttttattaatgtccacaacttatgttgtagtttttgttatattatcggttttcaaatttcattaaaaggaaagcta

SEQ ID NO: 23757 - DNA, 1091 bp, Homo sapiens
gtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataattacagcattgtaaggattgtagtgggaaagataggttttttttttttactgttttctgtgatcaggagtagtatacactattcagacattattgaaggttatcatttgatgaacgatcatttttcttggcttccgcatcactctcagatattcttgctaaatgttgaacccagagccttgggacatagaacagttctttatatctgacaaatgctgtgatatattgctagactaaattatgcttgcattttgaaatgggatctcaatgcacataacgggctttaattttctttttatcctctgcttcctcatatagtagtgattgaaaaaacatcacctcctgtgcctgttgaagtagctcctgaagcttctacgtctagtgccagccaagtgattgctcctactcaagtgacaggttggtgcagtattt

SEQ ID NO: 23758 - DNA, 1024 bp, Homo sapiens
tttgcttttgtgaactctcccatcctattgaattcatcaatttccaaaatagacctcaacccatctttggttctttggaaaatgctttcttgtagagatgttgcactaaatctcccgtctcttccttcctcccccctacaacaagccatctttacttcttgaatttattcacagagcatatttggttccgagttactttcagaaggtaagttaaagtatagaaccgtcatccatttagctcacgacaagctgctttttctcctttgggctaatttgaaagtttatctttaagaatctgcctggtcttctgaaggtctactgtttccatttctaaccaaatttaactttatccatgttttctttttcttctttttttgttctttccattacgcaacattcttcaagatgtggacgagtgcctggaaccaaacgtctgcgcaaatggtgattgttccaaccttgaaggctcctacatgtgttcatgccacaaaggctatacccggactccggaccacaagcactgtagaggtaaatactgtgatcaagtttcccatttttatttaaacttcatttaaatatagattagagcaattagccttagaaaagggaaccctgctacctgtgtttattttgaccgagcgacttagagcacatattggttggcttggctgaaagtggctccttgctgtggttaaatacagagcatatctatttacataaagggaaacgatgtatttttagagagtgtctgtgagccacagatcggttcatctaaatttttttttctcattataaaagcaatacacacagttgcacaactctgtgaatatattaaaaaccattgaattgtacattttaaatggaattgtatagcatgggaattatttctgaataaaattgatatgaaagtaaccaatatacactcattttagaaaatttagcaaatagagaaaaaagaaaagtaacaatcttacataatgtcattaatgaatattcatatttcgtggatattgtatataaagat

SEQ ID NO: 23759 - DNA, 1060 bp, Homo sapiens
tttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataattcagagcctcaaagcatgtatgcatcaaagtaaaccatatctgaaagcatagctcaggggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtcttgatcattctgtgtgtaaaaaatgtcttgcggctgggtgcggtggctcacaccagcacttttggaggcccaggcaggtggatcacttgagatcaggagttgaagaccaagcctggccaacatggtgaaacctcatctctactgaatatacaaaaattagccaggtgtggtggtgggtgtctgtgatcccagctacttgggaggctgaggcaggagaaccactgtaacccaggaggcagaggctgccgtgagccgagatggcaccattgcactccagcctgggcgacaagagtaagactccgtctaaaaaagaaaaaaagaatgtcttgcttgatttttctgtatcactgtgaacagatcttctagaattcttcccctaatatccttatttccaaggcagtatatttacttacctaccagtatttattatctcctaaaagctaattaagttgtaagatgttaagataatgctcttggcttcctacttacaacctctgtatgtttgcaagaatacagcactggttattttcataagatttgtgttctt

SEQ ID NO: 23760 - DNA, 1086 bp, Homo sapiens
gaccttacccacaaaatgctgttcttttccttgattggtgtacagaggaaattctgtggtaggaactgcatcttattcttaaaacagaaggtataatgaaaagaatacaatgaaaaatatatatatattataatccatacaggtattctccactttaagacaagcaaacaaaatcaggaagtataaagcatataggttggggtggttagttatattataaagtaattcttcactttactcaataatttatcataggatttctttaaatatcagttttcgctaatacagttcgctaatacatcttattcccacatcatgagctatatcctagacttctgcatttagaaaccaccttagtgattttccagctcaacttttttatttataggtaaagacactgaggcccagagaaacatctgaaatgtcattcttaaggttatatagctaatgaatggcagaattggtccaggaacccaactcaggatcttctcacttcaccatttctaattttagggctgaggacaacaagacatcaaattcttctcaaaattggcttttctcattttgtttttcattattaagataatacacattaatcatagaaaattggcaaatacaaaggtaaatttttaaaaagtctcctgcagtatcaccatccaatatctgtcaccatgttgacctctggactctgaaaggacatccatattcccctgtctcaacagaaccgttttccatttgaccttcagtgcactgaaatcaggccctctgacttttcatctaagtgagccgtcagtgagcttctatatggtaaactccttagtctcatcccagagtcgtcttctgaaacatttgacagtggtttttcatcttttcccccgtctttgccctgtgattgatttcatgacattactgttccctgcatcctcctgcatcttggactagtcttttcctgtctcattctcaggttcttcttctcctgtccattccttaaataataacatcccaggcagttacatgcttagctgtcaaattatttatgttattcccctgggatatttcatctgctttggagtcaaccattactta

SEQ ID NO: 23761 - DNA, 1027 bp, Homo sapiens
attaatgtttcctcgatgactcccctgagccaatgacagcatctgctcccacagtttgccaggacattaaagcaagagctcctctcagctctgtatgatgtatgatggacaggtcttatcaactgcattttaatcaggttctttcttctctgctcctaaggagaagtgttttccgtgttgtggcattgacgtacagaggctctcaccagctcttttcataaattcataagaaaattagtttatagttatgaaataataccttacattttccttgtccagatttgcttctgtcaaaagaggaagatttgctatttgcttagtaagggtgggttgagtcagtgtctctctctgtgtgtgtttattcattttataagaagataagacatttatctgttatgtagtttatgtcatagaaaaagttgtagatataataattctattttagaattatttctaagtggaaataattctagatccaagctgtgctttgaaactatcatttcattttatgagaattttatttctgaaatgacattcatgatctaatattaaatgacttcttgtgaagttatttcgtagcactgaaaaaaggaatcatggaaataaatgatgtaaatatatgcatttcccaaatctatcactgtttgatccaagggccattgtatgggtattgctgtggagtcttgtataatgaaagaatcttagaatgtttatcttagaaattattttaggttagtgtttccctattgatatgctttggctctctgtccccacccaaatctcatgttgaattgtaatccccagtgtagaaagaggtgcctgggaagtgattgaattggtgggtggtgtctaatgcttaagcaccatccccctagtgctgtcctgtgttagagtacttatgagatctggttgtttgaaagtgtgtagcaccttccccttcactctgttttcctctcgctcctgccgtattagacatgccagcttcccctttgccttttgccatgatcgtaagtttcctaaggcctcc

SEQ ID NO: 23762 - DNA, 1028 bp, Homo sapiens
gcccccaggagagtgcccccgcggccctgcgttccctctccttgttccccccgacgcttaggcagtcgcgggcgaggttgggtatggtgggtgggggcgagcgagtggaggatcgcccctgtccccgcgcagacgcgcacacgtgtggccgttcctgctgggactgggtggcccggccttgctccccgaggtgggggcgccgcgggcggggggcactgcagattctgccgcgcgcgagcccctcggggagcccggccctaccgccctccccgcactggcgcagtgtggcaccgtgagccgcacgccggccgcgaaagtcctttttctgttggcggaggagacgtgtctccagctcgcactccccgagtgactcttattattttttccttgagctcttccttcaccccttcctcctcctccgcagataaatcagtttcagccgcggaatatgtcagcccaggggaagttacacacggtggttactcatttatttgcccattgtaaacggtcaaaggctttctctcctgaaaggaaaggggggtgggggttgcacctgggagtaaaaagttgttgctattagtggctgctttttaatatcagatacccgcgtgtttcctgtcgtgttgccggttcctcctttttgtttgtttgacagcggggattgttctgctggcttctccagcacgcattgtgctccgcggtgtcgagattgacggtgggagaaacagattagattagtggagtctttctcgttggggagccaatgttagtgcgtgttggctttaatccctgcccgcttgcgtcggccttcagggtgcctggtctggtttggggtctagagcgaggcagtgagttattttgatgtggctaacgggggcacggttcggtaagcatcagttaaaagtgggatccctgctctggctgacgttgggctgatgatgctgttccgggggcatcctggcgagtgagcagagcgcacgcagcagcctcgtttctggggaggcggcgaggagggacaggcgccctct

SEQ ID NO: 23763 - DNA, 1026 bp, Homo sapiens
cagagaggaacaagcagagggcctataacattatgttaacagggaatgggaagagaaaccaacgaagtaaacaaggaaataattagttcctcccaaaagtaaatattggcaaaacatggagagaccaactattcactgcacttaaataaatgacaggactcagtgaccttcactttgattgccaggcttatagaatcttccctgttattgaggagtcctgtcacataaaacacttggcaaagggcagatggattgtgtattatcagaatggcaaaaatagcaagtctggagatatttgttgccattcacacatattgtacactgaccaggaaaatctccaagcaagaggttggcagtagggttgtaagcagtcagattaatatatgaagaaaactgaacagtccttaatctgtgtaggcattacatccatttgtaggaggtatttggtgacttggtacaggtttctttgttttgtgtggtttgttgaagatgcaatgaccgggatgaatgagtgaacagctgggtgaggcaggggatgggcattatgaagttgggggatatattgtagatgaaacagatgaccctaaggaggtaatgagggggtggactaaagaatgacgaatgggagaagggaaaatattgaattcatcttagcacaagtatatcatcctttgaagaataatccaaaacacattccagacattaattgtgaaattcctgaaaaatgtgggtgtgcttaacatctcccaggctatggtgcaagcagagatgatagtgttgctttagcctgtaaatacaagagggtaggaggtggtaaaatgagtggaagggaaatacatttagtgaagcgggttcctgtaacactgtgttccgtatggcacgtttggtatcaggattttggagacaccccagtaaagctcatttaattatttgagggagaaacagtagactagccaagcatgcatgaataacacattgaaagctttccttctcagaggtctaattctgcaaagctgcattttcaaa
